United States Patent 12,371,689 (ENGINEERED ENVELOPED VECTORS AND METHODS OF USE THEREOF) - sequence listing, part 2

SEQ ID NO: 3083 - protein, 315 aa, unidentified
MANITRMANHTGKLDFILMGLFRRSKHPALLSVVIFVVFLKALSGNAVLILLIHCDAHLHSPMYFFISQLSLMDMAYISVTVPKMLLDQVMGVNKVSAPECGMQMFLYLTLAGSEFFLLATMAYDRYVAICHPLRYPVLMNHRVCLFLASGCWFLGSVDGFMLTPITMSFPFCRSWEIHHFFCEVPAVTILSCSDTSLYETLMYLCCVLMLLIPVTIISSSYLLILLTVHRMNSAEGRKKAFATCSSHLTVVILFYGAAVYTYMLPSSYHTPEKDMMVSVFYTILTPVLNPLIYSLRNKDVMGALKKMLTVRFVL

SEQ ID NO: 3084 - protein, 308 aa, unidentified
MNENNETLTRGFTLMGLFTHNKCSGFFFGVICAVFFMAMIANGVMIFLINIDPHLHTPMYFLLSHLSVIDTLYISTIVPKMLVDYLMGEGTISFIACTAQCFLYMGFMGAEFFLLGLMAYDRYVAICNPLRYPVLISWRVCWMILASSWFGGALDSFLLTPITMSLPFCASHQINHFFCEAPTMLRLACGDKTTYETVMYVCCVAMLLIPFSVVTASYTRILITVHQMTSAEGRKKAFATCSSHMMVVTLFYGAALYTYTLPQSYHTPIKDKVFSAFYTILTPLLNPLIYSLRNRDVMGALKRVVARC

SEQ ID NO: 3085 - protein, 312 aa, unidentified
MENGSYTSYFILLGLFNHTRAHQVLFMMVLSIVLTSLFGNSLMILLIHWDHRLHTPMYFLLSQLSLMDVMLVSTTVPKMAADYLTGSKAISRAGCGAQIFFLPTLGGGECFLLAAMAYDRYAAVCHPLRYPTLMSWQLCLRMNLSCWLLGAADGLLQAVATLSFPYCGAHEIDHFFCETPVLVRLACADTSVFENAMYICCVLMLLVPFSLILSSYGLILAAVLHMRSTEARKKAFATCSSHVAVVGLFYGAAIFTYMRPKSHRSTNHDKVVSAFYTMFTPLLNPLIYSVKNSEVKGALTRCMGRCVALSRE

SEQ ID NO: 3086 - protein, 315 aa, unidentified
MGRWVNQSYTDGFFLLGIFSHSQTDLVLFSAVMVVFTVALCGNVLLIFLIYLDAGLHTPMYFFLSQLSLMDLMLVCNIVPKMAANFLSGRKSISFVGCGIQIGFFVSLVGSEGLLLGLMAYDRYVAVSHPLHYPILMNQRVCLQITGSSWAFGIIDGVIQMVAAMGLPYCGSRSVDHFFCEVQALLKLACADTSLFDTLLFACCVFMLLLPFSIIMASYACILGAVLRIRSAQAWKKALATCSSHLTAVTLFYGAAMFMYLRPRRYRAPSHDKVASIFYTVLTPMLNPLIYSLRNGEVMGALRKGLDRCRIGSQH

SEQ ID NO: 3087 - protein, 315 aa, unidentified
METWVNQSYTDGFFLLGIFSHSTADLVLFSVVMAVFTVALCGNVLLIFLIYMDPHLHTPMYFFLSQLSLMDLMLVCTNVPKMAANFLSGRKSISFVGCGIQIGLFVCLVGSEGLLLGLMAYDRYVAISHPLHYPILMNQRVCLQITGSSWAFGIIDGLIQMVVVMNFPYCGLRKVNHFFCEMLSLLKLACVDTSLFEKVIFACCVFMLLFPFSIIVASYAHILGTVLQMHSAQAWKKALATCSSHLTAVTLFYGAAMFIYLRPRHYRAPSHDKVASIFYTVLTPMLNPLIYSLRNREVMGALRKGLDRCRIGSQH

SEQ ID NO: 3088 - protein, 320 aa, unidentified
MDQSNYSSLHGFILLGFSNHPKMEMILSGVVAIFYLITLVGNTAIILASLLDSQLHTPMYFFLRNLSFLDLCFTTSIIPQMLVNLWGPDKTISYVGCIIQLYVYMWLGSVECLLLAVMSYDRFTAICKPLHYFVVMNPHLCLKMIIMIWSISLANSVVLCTLTLNLPTCGNNILDHFLCELPALVKIACVDTTTVEMSVFALGIIIVLTPLILILISYGYIAKAVLRTKSKASQRKAMNTCGSHLTVVSMFYGTIIYMYLQPGNRASKDQGKFLTLFYTVITPSLNPLIYTLRNKDMKDALKKLMRFHHKSTKIKRNCKS

SEQ ID NO: 3089 - protein, 314 aa, unidentified
MDGTNGSTQTHFILLGFSDRPHLERILFVVILIAYLLTLVGNTTIILVSRLDPHLHTPMYFFLAHLSFLDLSFTTSSIPQLLYNLNGCDKTISYMGCAIQLFLFLGLGGVECLLLAVMAYDRCVAICKPLHYMVIMNPRLCRGLVSVTWGCGVANSLAMSPVTLRLPRCGHHEVDHFLREMPALIRMACVSTVAIEGTVFVLAVGVVLSPLVFILLSYSYIVRAVLQIRSASGRQKAFGTCGSHLTVVSLFYGNIIYMYMQPGASSSQDQGMFLMLFYNIVTPLLNPLIYTLRNREVKGALGRLLLGKRELGKE

SEQ ID NO: 3090 - protein, 311 aa, unidentified
MGSFNTSFEDGFILVGFSDWPQLEPILFVFIFIFYSLTLFGNTIIIALSWLDLRLHTPMYFFLSHLSLLDLCFTTSTVPQLLINLCGVDRTITRGGCVAQLFIYLALGSTECVLLVVMAFDRYAAVCRPLHYMAIMHPHLCQTLAIASWGAGFVNSLIQTGLAMAMPLCGHRLNHFFCEMPVFLKLACADTEGTEAKMFVARVIVVAVPAALILGSYVHIAHAVLRVKSTAGRRKAFGTCGSHLLVVFLFYGSAIYTYLQSIHNYSEREGKFVALFYTIITPILNPLIYTLRNKDVKGALWKVLWRGRDSG

SEQ ID NO: 3091 - protein, 314 aa, unidentified
MGDVNQSVASDFILVGLFSHSGSRQLLFSLVAVMFVIGLLGNTVLLFLIRVDSRLHTPMYFLLSQLSLFDIGCPMVTIPKMASDFLRGEGATSYGGGAAQIFFLTLMGVAEGVLLVLMSYDRYVAVCQPLQYPVLMRRQVCLLMMGSSWVVGVLNASIQTSITLHFPYCASRIVDHFFCEVPALLKLSCADTCAYEMALSTSGVLILMLPLSLIATSYGHVLQAVLSMRSEEARHKAVTTCSSHITVVGLFYGAAVFMYMVPCAYHSPQQDNVVSLFYSLVTPTLNPLIYSLRNPEVWMALVKVLSRAGLRQMC

SEQ ID NO: 3092 - protein, 315 aa, unidentified
MQPESGANGTVIAEFILLGLLEAPGLQPVVFVLFLFAYLVTVRGNLSILAAVLVEPKLHTPMYFFLGNLSVLDVGCISVTVPSMLSRLLSRKRAVPCGACLTQLFFFHLFVGVDCFLLTAMAYDRFLAICRPLTYSTRMSQTVQRMLVAASWACAFTNALTHTVAMSTLNFCGPNVINHFYCDLPQLFQLSCSSTQLNELLLFAVGFIMAGTPMALIVISYIHVAAAVLRIRSVEGRKKAFSTCGSHLTVVAIFYGSGIFNYMRLGSTKLSDKDKAVGIFNTVINPMLNPIIYSFRNPDVQSAIWRMLTGRRSLA

SEQ ID NO: 3093 - protein, 321 aa, unidentified
MSLQKLMEPEAGTNRTAVAEFILLGLVQTEEMQPVVFVLLLFAYLVTTGGNLSILAAVLVEPKLHAPMYFFLGNLSVLDVGCITVTVPAMLGRLLSHKSTISYDACLSQLFFFHLLAGMDCFLLTAMAYDRLLAICQPLTYSTRMSQTVQRMLVAASLACAFTNALTHTVAMSTLNFCGPNEVNHFYCDLPQLFQLSCSSTQLNELLLFAVGFIMAGTPLVLIITAYSHVAAAVLRIRSVEGRKKAFSTCGSHLTVVCLFFGRGIFNYMRLGSEEASDKDKGVGVFNTVINPMLNPLIYSLRNPDVQGALWQIFLGRRSLT

SEQ ID NO: 3094 - protein, 321 aa, unidentified
MSLQKLMEPEAGTNRTAVAEFILLGLVQTEEMQPVVFVLLLFAYLVTTGGNLSILAAVLVEPKLHAPMYFFLGNLSVLDVGCITVTVPAMLGRLLSHKSTISYDACLSQLFFFHLLAGMDCFLLTAMAYDRLLAICQPLTYSTRMSQTVQRMLVAASWACAFTNALTHTVAMSTLNFCGPNEVNHFYCDLPQLFQLSCSSTQLNELLLFVAAAFMAVAPLVFISVSYAHVVAAVLQIRSAEGRKKAFSTCGSHLTVVGIFYGTGVFSYMRLGSVESSDKDKGVGVFMTVINPMLNPLIYSLRNTDVQGALCQLLVGKRSLT

SEQ ID NO: 3095 - protein, 344 aa, unidentified
MELLTNNLKFITDPFVCRLRHLSPTPSEEHMKNKNNVTEFILLGLTQNPEGQKVLFVTFLLIYMVTIMGNLLIIVTIMASQSLGSPMYFFLASLSFIDTVYSTAFAPKMIVDLLSEKKTISFQGCMAQLFMDHLFAGAEVILLVVMAYDRYMAICKPLHELITMNRRVCVLMLLAAWIGGFLHSLVQFLFIYQLPFCGPNVIDNFLCDLYPLLKLACTNTYVTGLSMIANGGAICAVTFFTILLSYGVILHSLKTQSLEGKRKAFYTCASHVTVVILFFVPCIFLYARPNSTFPIDKSMTVVLTFITPMLNPLIYTLKNAEMKSAMRKLWSKKVSLAGKWLYHS

SEQ ID NO: 3096 - protein, 328 aa, unidentified
MRPSSNVTEFVLLGLTQDPDVKKTLFVMFLLIYIVTMVGNLLIWVTTIGSPSLGSLMYFFLAYLSLMDAIYSTAMSPKLMIDLLCDKIAISLSACMGQLFIEHLLGGAEVFLLVVMAYDRYVAISKPLHYLNIMNRLVCILLLVVAMIGGFVHSVVQIVFLYSLPICGPNVIDHSVCDMYPLLELLCLDTYFIGLTVVANGGIICMVIFTFLLISCGVILNFLKTYSQEERHKALPTCISHIIVVALVFVPCIFMYVRPVSNFPFDKLMTVFYSIITLMLNPLIYSLRQSEMKNAMKNLWCEKLSIVRKRVSPTLNIFIPSSKATNRR

SEQ ID NO: 3097 - protein, 309 aa, unidentified
MEPRKNVTDFVLLGFTQNPKEQKVLFVMFLLFYILTMVGNLLIVVTVTVSETLGSPMYFFLAGLSFIDIIYSSSISPRLISGLFFGNNSISFQSCMAQLFIEHIFGGSEVFLLLVMAYDCYVAICKPLHYLVIMRQWVCVVLLVVSWVGGFLHSVFQLSIIYGLPFCGPNVIDHFFCDMYPLLKLVCTDTHAIGLLVVANGGLACTIVFLLLLISYGVILHSLKNLSQKGRQKALSTCSSHMTVVVFFFVPCIFMYARPARTFPIDKSVSVFYTVITPMLNPLIYTLRNSEMTSAMKKLWRRDLISSST

SEQ ID NO: 3098 - protein, 315 aa, unidentified
MRQNNNITEFVLLGFSQDPGVQKALFVMFLLTYLVTVVGNLLIVVDIIASPSLGSPMYFFLACLSFIDAAYSTTISPKLIVGLFCDKKTISFQGCMGQLFIDHFFGGAEVFLLVVMACDRYVAICKPLHYLTIMNRQVCFLLLVVAMIGGFVHSAFQIVVYSLPFCGPNVIVHFSCDMHPLLELACTDTYFIGLTVVVNSGAICMVIFNLLLISYGVILSSLKTYSQEKRGKALSTCSSGSTVVVLFFVPCIFIYVRPVSNFPTDKFMTVFYTIITHMLSPLIYTLRNSEMRNAIEKLLGKKLTIFIIGGVSVLM

SEQ ID NO: 3099 - protein, 309 aa, unidentified
MASTSNVTELIFTGLFQDPAVQSVCFVVFLPVYLATVVGNGLIVLTVSISKSLDSPMYFFLSCLSLVEISYSSTIAPKFIIDLLAKIKTISLEGCLTQIFFFHFFGVAEILLIVVMAYDCYVAICKPLHYMNIISRQLCHLLVAGSWLGGFCHSIIQILVIIQLPFCGPNVIDHYFCDLQPLFKLACTDTFMEGVIVLANSGLFSVFSFLILVSSYIVILVNLRNHSAEGRHKALSTCASHITVVILFFGPAIFLYMRPSSTFTEDKLVAVFYTVITPMLNPIIYTLRNAEVKIAIRRLWSKKENPGRE

SEQ ID NO: 3100 - protein, 310 aa, unidentified
MQQNNSVPEFILLGLTQDPLRQKIVFVIFLIFYMGTVVGNMLIIVTIKSSRTLGSPMYFFLFYLSFADSCFSTSTAPRLIVDALSEKKIITYNECMTQVFALHLFGCMEIFVLILMAVDRYVAICKPLRYPTIMSQQVCIILIVLAWIGSLIHSTAQIILALRLPFCGPYLIDHYCCDLQPLLKLACMDTYMINLLLVSNSGAICSSSFMILIISYIVILHSLRNHSAKGKKKALSACTSHIIVVILFFGPCIFIYTRPPTTFPMDKMVAVFYTIGTPFLNPLIYTLRNAEVKNAMRKLWHGKIISENKG

SEQ ID NO: 3101 - protein, 309 aa, unidentified
MEKKKNVTEFILIGLTQNPIMEKVTFVVFLVLYMITLSGNLLIVVTITTSQALSSPMYFFLTHLSLIDTVYSSSSAPKLIVDSFQEKKIISFNGCMAQAYAEHIFGATEIILLTVMACDCYVAICKPLNYTTIMSHSLCILLVAVAWVGGFLHATIQILFTVWLPFCGPNVIGHFMCDLYPLLKLVCIDTHTLGLFVAVNSGFICLLNFLILVVSYVIILRSLKNNSLEGRCKALSTCISHIIVVVLFFVPCIFVYLRSVTTLPIDKAVAVFYTMVVPMLNPVVYTLRNAEVKSAIRKLWRKKVTSDND

SEQ ID NO: 3102 - protein, 309 aa, unidentified
MANRNNVTEFILLGLTENPKMQKIIFVVFSVIYINAMIGNVLIVVTITASPSLRSPMYFFLAYLSFIDACYSSVNTPKLITDSLYENKTILFNGCMTQVFGEHFFRGVEVILLTVMAYDHYVAICKPLHYTTVMKQHVCSLLVGVSWVGGFLHATIQILFICQLPFCGPNVIDHFMCDLYTLINLACTNTHTLGLFIAANSGFICLLNCLLLLVSCVVILYSLKTHSLEARHEALSTCVSHITVVILSFIPCIFVYMRPPATLPIDKAVAVFYTMITSMLNPLIYTLRNAQMKNAIRKLCSRKAISSVK

SEQ ID NO: 3103 - protein, 316 aa, unidentified
MQNQSFVTEFVLLGLSQNPNVQEIVFVVFLFVYIATVGGNMLIVVTILSSPALLVSPMYFFLGFLSFLDACFSSVITPKMIVDSLYVTKTISFEGCMMQLFAEHFFAGVEVIVLTAMAYDRYVAICKPLHYSSIMNRRLCGILMGVAWTGGLLHSMIQILFTFQLPFCGPNVINHFMCDLYPLLELACTDTHIFGLMVVINSGFICIINFSLLLVSYAVILLSLRTHSSEGRWKALSTCGSHIAVVILFFVPCIFVYTRPPSAFSLDKMAAIFYIILNPLLNPLIYTFRNKEVKQAMRRIWNRLMVVSDEKENIKL

SEQ ID NO: 3104 - protein, 302 aa, unidentified
MDIPQNITEFFMLGLSQNSEVQRVLFVVFLLIYVVTVCGNMLIVVTITSSPTLASPVYFFLANLSFIDTFYSSSMAPKLIADSLYEGRTISYECCMAQLFGAHFLGGVEIILLTVMAYDRYVAICKPLHNTTIMTRHLCAMLVGVAWLGGFLHSLVQLLLVLWLPFCGPNVINHFACDLYPLLEVACTNTYVIGLLVVANSGLICLLNFLMLAASYIVILYSLRSHSADGRCKALSTCGAHFIVVALFFVPCIFTYVHPFSTLPIDKNMALFYGILTPMLNPLIYTLRNEEVKNAMRKLFTW

SEQ ID NO: 3105 - protein, 309 aa, unidentified
MENRNNMTEFVLLGLTENPKMQKIIFVVFFVIYIITVVGYVLIVVTITASPSLGSPMYLSLAYLSFIDACYSSVNTPNLITHSLYGKKAILFNGCMTQVFGEHFFGGAEGILLTVMAYDHYVAICKPLHYMTIMNQCVCALLMGVVWMGGFLHATIQILFIFQLPFCGPNVIDHFMCDLNPLLNLACTDTHMLELFIAANSGFICLLNFALLLVSYVVILCSLRTHSLEARHKALSTCVSHITVVILFFVPCIFVYMRPAATLPIDKAVAIFYTMITPMLNPLIYTLKNAQMKNAIRKLCSRKDISGDK

SEQ ID NO: 3106 - protein, 309 aa, unidentified
MENQNNVTEFILLGLTENLELWKIFSAVFLVMYVATVLENLLIVVTIITSQSLRSPMYFFLTFLSLLDVMFSSVVAPKVIVDTLSKSTTISLKGCLTQLFVEHFFGGVGIILLTVMAYDRYVAICKPLHYTIIMSPRVCCLMVGGAWVGGFMHAMIQLLFMYQIPFCGPNIIDHFICDLFQLLTLACTDTHILGLLVTLNSGMMCVAIFLILIASYTVILCSLKSYSSKGRHKALSTCSSHLTVVVLFFVPCIFLYMRPVVTHPIDKAMAVSDSIITPMLNPLIYTLRNAEVKSAMKKLWMKWEALAGK

SEQ ID NO: 3107 - protein, 310 aa, unidentified
MEPQNTTQVSMFVLLGFSQTQELQKFLFLLFLLVYVTTIVGNLLIMVTVTFDCRLHTPMYFLLRNLALIDLCYSTVTSPKMLVDFLHETKTISYQGCMAQIFFFHLLGGGTVFFLSVMAYDRYIAISQPLRYVTIMNTQLCVGLVVAAWVGGFVHSIVQLALILPLPFCGPNILDNFYCDVPQVLRLACTDTSLLEFLMISNSGLLVIIWFLLLLISYTVILVMLRSHSGKARRKAASTCTTHIIVVSMIFIPCIYIYTWPFTPFLMDKAVSISYTVMTPMLNPMIYTLRNQDMKAAMRRLGKCLVICRE

SEQ ID NO: 3108 - protein, 311 aa, unidentified
MEMENCTRVKEFIFLGLTQNREVSLVLFLFLLLVYVTTLLGNLLIMVTVTCESRLHTPMYFLLHNLSIADICFSSITVPKVLVDLLSERKTISFNHCFTQMFLFHLIGGVDVFSLSVMALDRYVAISKPLHYATIMSRDHCIGLTVAAWLGGFVHSIVQISLLLPLPFCGPNVLDTFYCDVHRVLKLAHTDIFILELLMISNNGLLTTLWFFLLLVSYIVILSLPKSQAGEGRRKAISTCTSHITVVTLHFVPCIYVYARPFTALPMDKAISVTFTVISPLLNPLIYTLRNHEMKSAMRRLKRRLVPSDRK

SEQ ID NO: 3109 - protein, 311 aa, unidentified
MELGNVTRVKEFIFLGLTQSQDQSLVLFLFLCLVYMTTLLGNLLIMVTVTCESRLHTPMYFLLRNLAILDICFSSTTAPKVLLDLLSKKKTISYTSCMTQIFLFHLLGGADIFSLSVMAFDCYMAISKPLHYVTIMSRGQCTALISASWMGGFVHSIVQISLLLPLPFCGPNVLDTFYCDVPQVLKLTCTDTFALEFLMISNNGLVTTLWFIFLLVSYTVILMTLRSQAGGGRRKAISTCTSHITVVTLHFVPCIYVYARPFTALPTEKAISVTFTVISPLLNPLIYTLRNQEMKSAMRRLKRRLVPSERE

SEQ ID NO: 3110 - protein, 307 aa, unidentified
METGNLTWVSDFVFLGLSQTRELQRFLFLMFLFVYITTVMGNILIIITVTSDSQLHTPMYFLLRNLAVLDLCFSSVTAPKMLVDLLSEKKTISYQGCMGQIFFFHFLGGAMVFFLSVMAFDRLIAISRPLRYVTVMNTQLWVGLVVATWVGGFVHSIVQLALMLPLPFCGPNILDNFYCDVPQVLRLACTDTSLLEFLKISNSGLLDVVWFFLLLMSYLFILVMLRSHPGEARRKAASTCTTHIIVVSMIFVPSIYLYARPFTPFPMDKLVSIGHTVMTPMLNPMIYTLRNQDMQAAVRRLGRHRLV

SEQ ID NO: 3111 - protein, 318 aa, unidentified
MNPANHSQVAGFVLLGLSQVWELRFVFFTVFSAVYFMTVVGNLLIVVIVTSDPHLHTTMYFLLGNLSFLDFCYSSITAPRMLVDLLSGNPTISFGGCLTQLFFFHFIGGIKIFLLTVMAYDRYIAISQPLHYTLIMNQTVCALLMAASWVGGFIHSIVQIALTIQLPFCGPDKLDNFYCDVPQLIKLACTDTFVLELLMVSNNGLVTLMCFLVLLGSYTALLVMLRSHSREGRSKALSTCASHIAVVTLIFVPCIYVYTRPFRTFPMDKAVSVLYTIVTPMLNPAIYTLRNKEVIMAMKKLWRRKKDPIGPLEHRPLH

SEQ ID NO: 3112 - protein, 314 aa, unidentified
MDQINHTNVKEFFFLELTRSRELEFFLFVVFFAVYVATVLGNALIVVTITCESRLHTPMYFLLRNKSVLDIVFSSITVPKFLVDLLSDRKTISYNDCMAQIFFFHFAGGADIFFLSVMAYDRYLAIAKPLHYVTMMRKEVWVALVVASWVSGGLHSIIQVILMLPFPFCGPNTLDAFYCYVLQVVKLACTDTFALELFMISNNGLVTLLWFLLLLGSYTVILVMLRSHSGEGRNKALSTCTSHMLVVTLHFVPCVYIYCRPFMTLPMDTTISINNTVITPMLNPIIYSLRNQEMKSAMQRLQRRLGPSESRKWG

SEQ ID NO: 3113 - protein, 314 aa, unidentified
MDQRNYTRVKEFTFLGITQSRELSQVLFTFLFLVYMTTLMGNFLIMVTVTCESHLHTPMYFLLRNLSILDICFSSITAPKVLIDLLSETKTISFSGCVTQMFFFHLLGGADVFSLSVMAFDRYIAISKPLHYMTIMSRGRCTGLIVASWVGGFVHSIAQISLLLPLPFCGPNVLDTFYCDVPQVLKLACTDTFTLELLMISNNGLVSWFVFFFLLISYTVILMMLRSHTGEGRRKAISTCTSHITVVTLHFVPCIYVYARPFTALPTDTAISVTFTVISPLLNPIIYTLRNQEMKLAMRKLKRRLGQSERILIQ

SEQ ID NO: 3114 - protein, 313 aa, unidentified
MDSLNQTRVTEFVFLGLTDNRVLEMLFFMAFSAIYMLTLSGNILIIIATVFTPSLHTPMYFFLSNLSFIDICHSSVTVPKMLEGLLLERKTISFDNCITQLFFLHLFACAEIFLLIIVAYDRYVAICTPLHYPNVMNMRVCIQLVFALWLGGTVHSLGQTFLTIRLPYCGPNIIDSYFCDVPLVIKLACTDTYLTGILIVTNSGTISLSCFLAVVTSYMVILVSLRKHSAEGRQKALSTCSAHFMVVALFFGPCIFIYTRPDTSFSIDKVVSVFYTVVTPLLNPFIYTLRNEEVKSAMKQLRQRQVFFTKSYT

SEQ ID NO: 3115 - protein, 312 aa, unidentified
MNGMNHSVVSEFVFMGLTNSREIQLLLFVFSLLFYFASMMGNLVIVFTVTMDAHLHSPMYFLLANLSIIDMAFCSITAPKMICDIFKKHKAISFRGCITQIFFSHALGGTEMVLLIAMAFDRYMAICKPLHYLTIMSPRMCLYFLATSSIIGLIHSLVQLVFVVDLPFCGPNIFDSFYCDLPRLLRLACTNTQELEFMVTVNSGLISVGSFVLLVISYIFILFTVWKHSSGGLAKALSTLSAHVTVVILFFGPLMFFYTWPSPTSHLDKYLAIFDAFITPFLNPVIYTFRNKDMKVAMRRLCSRLAHFTKIL

SEQ ID NO: 3116 - protein, 305 aa, unidentified
MVTEFIFLGLSDSQGLQTFLFMLFFVFYGGIVFGNLLIVITVVSDSHLHSPMYFLLANLSLIDLSLSSVTAPKMITDFFSQRKVISFKGCLVQIFLLHFFGGSEMVILIAMGFDRYIAICKPLHYTTIMCGNACVGIMAVAWGIGFLHSVSQLAFAVHLPFCGPNEVDSFYCDLPRVIKLACTDTYRLDIMVIANSGVLTVCSFVLLIISYTIILMTIQHRPLDKSSKALSTLTAHITVVLLFFGPCVFIYAWPFPIKSLDKFLAVFYSVITPLLNPIIYTLRNKDMKTAIRQLRKWDAHSSVKF

SEQ ID NO: 3117 - protein, 312 aa, unidentified
MDGENHSVVSEFLFLGLTHSWEIQLLLLVFSSVLYVASITGNIFIVFSVTTDPHLHSPMYFLLASLSFIDLGACSVTSPKMIYDLFRKRKVISFGGCIAQIFFIHVIGGVEMVLLIAMAFDRYVALCKPLHYLTIMSPRMCLSFLAVAWTLGVSHSLFQLAFLVNLAFCGPNVLDSFYCDLPRLLRLACTDTYRLQFMVTVNSGFICVGTFFILLISYVFILFTVWKHSSGGSSKALSTLSAHSTVVLLFFGPPMFVYTRPHPNSQMDKFLAIFDAVLTPFLNPVVYTFRNKEMKAAIKRVCKQLVIYKKIS

SEQ ID NO: 3118 - protein, 312 aa, unidentified
MDGENHSVVSEFLFLGLTHSWEIQLLLLVFSSVLYVASITGNILIVFSVTTDPHLHSPMYFLLASLSFIDLGACSVTSPKMIYDLFRKRKVISFGGCIAQIFFIHVVGGVEMVLLIAMAFDRYVALCKPLHYLTIMSPRMCLSFLAVAWTLGVSHSLFQLAFLVNLAFCGPNVLDSFYCDLPRLLRLACTDTYRLQFMVTVNSGFICVGTFFILLISYVFILFTVWKHSSGGSSKALSTLSAHSTVVLLFFGPPMFVYTRPHPNSQMDKFLAIFDAVLTPFLNPVVYTFRNKEMKAAIKRVCKQLVIYKRIS

SEQ ID NO: 3119 - protein, 305 aa, unidentified
MVTEFIFLGLSDSQELQTFLFMLFFVFYGGIVFGNLLIVITVVSDSHLHSPMYFLLANLSLIDLSLSSVTAPKMITDFFSQRKVISFKGCLVQIFLLHFFGGSEMVILIAMGFDRYIAICKPLHYTTIMCGNACVGIMAVAWGIGFLHSVSQLAFAVHLPFCGPNEVDSFYCDLPRVIKLACTDTYRLDIMVIANSGVLTVCSFVLLIISYTIILMTIQHCPLDKSSKALSTLTAHITVVLLFFGPCVFIYAWPFPIKSLDKFLAVFYSVITPLLNPIIYTLRNKDMKTAIRRLRKWDAHSSVKF

SEQ ID NO: 3120 - protein, 305 aa, unidentified
MVTEFIFLGLSDSQELQTFLFMLFFVFYGGIVFGNLLIVITVVSDSHLHSPMYFLLANLSLIDLSLSSVTAPKMITDFFSQRKVISFKGCLVQIFLLHFFGGSEMVILIAMGFDRYIAICKPLHYTTIMCGNACVGIMAVTWGIGFLHSVSQLAFAVHLLFCGPNEVDSFYCDLPRVIKLACTDTYRLDIMVIANSGVLTVCSFVLLIISYTIILMTIQHRPLDKSSKALSTLTAHITVVLLFFGPCVFIYAWPFPIKSLDKFLAVFYSVITPLLNPIIYTLRNKDMKTAIRQLRKWDAHSSVKF

SEQ ID NO: 3121 - protein, 312 aa, unidentified
MDEANHSVVSEFVFLGLSDSRKIQLLLFLFFSVFYVSSLMGNLLIVLTVTSDPRLQSPMYFLLANLSIINLVFCSSTAPKMIYDLFRKHKTISFGGCVVQIFFIHAVGGTEMVLLIAMAFDRYVAICKPLHYLTIMNPQRCILFLVISWIIGIIHSVIQLAFVVDLLFCGPNELDSFFCDLPRFIKLACIETYTLGFMVTANSGFISLASFLILIISYIFILVTVQKKSSGGIFKAFSMLSAHVIVVVLVFGPLIFFYIFPFPTSHLDKFLAIFDAVITPVLNPVIYTFRNKEMMVAMRRRCSQFVNYSKIF

SEQ ID NO: 3122 - protein, 311 aa, unidentified
MAHTNESMVSEFVLLGLSNSWGLQLFFFAIFSIVYVTSVLGNVLIIVIISFDSHLNSPMYFLLSNLSFIDICQSNFATPKMLVDFFIERKTISFEGCMAQIFVLHSFVGSEMMLLVAMAYDRFIAICKPLHYSTIMNRRLCVIFVSISWAVGVLHSVSHLAFTVDLPFCGPNEVDSFFCDLPLVIELACMDTYEMEIMTLTNSGLISLSCFLALIISYTIILIGVRCRSSSGSSKALSTLTAHITVVILFFGPCIYFYIWPFSRLPVDKFLSVFYTVCTPLLNPIIYSLRNEDVKAAMWKLRNRHVNSWKN

SEQ ID NO: 3123 - protein, 304 aa, unidentified
MERANHSVVSEFILLGLSKSQNLQILFFLGFSVVFVGIVLGNLLILVTVTFDSLLHTPMYFLLSNLSCIDMILASFATPKMIVDFLRERKTISWWGCYSQMFFMHLLGGSEMMLLVAMAIDRYVAICKPLHYMTIMSPRVLTGLLLSSYAVGFVHSSSQMAFMLTLPFCGPNVIDSFFCDLPLVIKLACKDTYILQLLVIADSGLLSLVCFLLLLVSYGVIIFSVRYRAASRSSKAFSTLSAHITVVTLFFAPCVFIYVWPFSRYSVDKILSVFYTIFTPLLNPIIYTLRNQEVKAAIKKRLCI

SEQ ID NO: 3124 - protein, 310 aa, unidentified
MDPQNYSLVSEFVLHGLCTSRHLQNFFFIFFFGVYVAIMLGNLLILVTVISDPCLHSSPMYFLLGNLAFLDMWLASFATPKMIRDFLSDQKLISFGGCMAQIFFLHFTGGAEMVLLVSMAYDRYVAICKPLHYMTLMSWQTCIRLVLASWVVGFVHSISQVAFTVNLPYCGPNEVDSFFCDLPLVIKLACMDTYVLGIIMISDSGLLSLSCFLLLLISYTVILLAIRQRAAGSTSKALSTCSAHIMVVTLFFGPCIFVYVRPFSRFSVDKLLSVFYTIFTPLLNPIIYTLRNEEMKAAMKKLQNRRVTFQ

SEQ ID NO: 3125 - protein, 348 aa, unidentified
MLTSLTDLCFSPIQVAEIKSLPKSMNETNHSRVTEFVLLGLSSSRELQPFLFLTFSLLYLAILLGNFLIILTVTSDSRLHTPMYFLLANLSFIDVCVASFATPKMIADFLVERKTISFDACLAQIFFVHLFTGSEMVLLVSMAYDRYVAICKPLHYMTVMSRRVCVVLVLISWFVGFIHTTSQLAFTVNLPFCGPNKVDSFFCDLPLVTKLACIDTYVVSLLIVADSGFLSLSSFLLLVVSYTVILVTVRNRSSASMAKARSTLTAHITVVTLFFGPCIFIYVWPFSSYSVDKVLAVFYTIFTLILNPVIYTLRNKEVKAAMSKLKSRYLKPSQVSVVIRNVLFLETK

SEQ ID NO: 3126 - protein, 315 aa, unidentified
MEAMKLLNQSQVSEFILLGLTSSQDVEFLLFALFSVIYVVTVLGNLLIIVTVFNTPNLNTPMYFLLGNLSFVDMTLASFATPKVILNLLKKQKVISFAGCFTQIFLLHLLGGVEMVLLVSMAFDRYVAICKPLHYMTIMNKKVCVLLVVTSWLLGLLHSGFQIPFAVNLPFCGPNVVDSIFCDLPLVTKLACIDIYFVQVVIVANSGIISLSCFIILLISYSLILITIKNHSPTGQSKARSTLTAHITVVILFFGPCIFIYIWPFGNHSVDKFLAVFYTIITPILNPIIYTLRNKEMKISMKKLWRAFVNSREDT

SEQ ID NO: 3127 - protein, 314 aa, unidentified
MDVGNKSTMSEFVLLGLSNSWELQMFFFMVFSLLYVATMVGNSLIVITVIVDPHLHSPMYFLLTNLSIIDMSLASFATPKMITDYLTGHKTISFDGCLTQIFFLHLFTGTEIILLMAMSFDRYIAICKPLHYASVISPQVCVALVVASWIMGVMHSMSQVIFALTLPFCGPYEVDSFFCDLPVVFQLACVDTYVLGLFMISTSGIIALSCFIVLFNSYVIVLVTVKHHSSRGSSKALSTCTAHFIVVFLFFGPCIFIYMWPLSSFLTDKILSVFYTIFTPTLNPIIYTLRNQEVKIAMRKLKNRFLNFNKAMPS

SEQ ID NO: 3128 - protein, 323 aa, unidentified
MDKSNSSVVSEFVLLGLCSSQKLQLFYFCFFSVLYTVIVLGNLLIILTVTSDTSLHSPMYFLLGNLSFVDICQASFATPKMIADFLSAHETISFSGCIAQIFFIHLFTGGEMVLLVSMAYDRYVAICKPLYYVVIMSRRTCTVLVMISWAVSLVHTLSQLSFTVNLPFCGPNVVDSFFCDLPRVTKLACLDSYIIEILIVVNSGILSLSTFSLLVSSYIIILVTVWLKSSAAMAKAFSTLASHIAVVILFFGPCIFIYVWPFTISPLDKFLAIFYTVFTPVLNPIIYTLRNRDMKAAVRKIVNHYLRPRRISEMSLVVRTSFH

SEQ ID NO: 3129 - protein, 312 aa, unidentified
MDLKNGSLVTEFILLGFFGRWELQIFFFVTFSLIYGATVMGNILIMVTVTCRSTLHSPLYFLLGNLSFLDMCLSTATTPKMIIDLLTDHKTISVWGCVTQMFFMHFFGGAEMTLLIIMAFDRYVAICKPLHYRTIMSHKLLKGFAILSWIIGFLHSISQIVLTMNLPFCGHNVINNIFCDLPLVIKLACIETYTLELFVIADSGLLSFTCFILLLVSYIVILVSVPKKSSHGLSKALSTLSAHIIVVTLFFGPCIFIYVWPFSSLASNKTLAVFYTVITPLLNPSIYTLRNKKMQEAIRKLRFQYVSSAQNF

SEQ ID NO: 3130 - protein, 313 aa, unidentified
METANYTKVTEFVLTGLSQTREVQLVLFVIFLSFYLFILPGNILIICTIRLDPHLTSPMYFLLANLALLDIWYSSITAPKMLIDFFVERKIISFGGCIAQLFFLHFVGASEMFLLTVMAYDRYAAICRPLHYATIMNRRLCCILVALSWMGGFIHSIIQVALIVRLPFCGPNELDSYFCDITQVVRIACANTFPEELVMICSSGLISVVCFIALLMSYAFLLALLKKHSGSGENTNRAMSTCYSHITIVVLMFGPSIYIYARPFDSFSLDKVVSVFHTVIFPLLNPIIYTLRNKEVKAAMRKVVTKYILCEEK

SEQ ID NO: 3131 - protein, 307 aa, unidentified
MESENRTVIREFILLGLTQSQDIQLLVFVLVLIFYFIILPGNFLIIFTIKSDPGLTAPLYFFLGNLAFLDASYSFIVAPRMLVDFLSAKKIISYRGCITQLFFLHFLGGGEGLLLVVMAFDRYIAICRPLHYPTVMNPRTCYAMMLALWLGGFVHSIIQVVLILRLPFCGPNQLDNFFCDVPQVIKLACTDTFVVELLMVFNSGLMTLLCFLGLLASYAVILCRIRGSSSEAKNKAMSTCITHIIVIFFMFGPGIFIYTRPFRAFPADKVVSLFHTVIFPLLNPVIYTLRNQEVKASMKKVFNKHIA

SEQ ID NO: 3132 - protein, 316 aa, unidentified
MKIANNTVVTEFILLGLTQSQDIQLLVFVLILIFYLIILPGNFLIIFTIRSDPGLTAPLYLFLGNLAFLDASYSFIVAPRMLVDFLSEKKVISYRGCITQLFFLHFLGGGEGLLLVVMAFDRYIAICRPLHCSTVMNPRACYAMMLALWLGGFVHSIIQVVLILRLPFCGPNQLDNFFCDVRQVIKLACTDMFVVELLMVFNSGLMTLLCFLGLLASYAVILCHVRRAASEGKNKAMSTCTTRVIIILLMFGPAIFIYMCPFRALPADKMVSLFHTVIFPLMNPMIYTLRNQEVKTSMKRLLSRHVVCQVDFIIRN

SEQ ID NO: 3133 - protein, 308 aa, unidentified
METQNLTVVTEFILLGLTQSQDAQLLVFVLVLIFYLIILPGNFLIIFTIKSDPGLTAPLYFFLGNLALLDASYSFIVVPRMLVDFLSEKKVISYRSCITQLFFLHFLGAGEMFLLVVMAFDRYIAICRPLHYSTIMNPRACYALSLVLWLGGFIHSIVQVALILHLPFCGPNQLDNFFCDVPQVIKLACTNTFVVELLMVSNSGLLSLLCFLGLLASYAVILCRIREHSSEGKSKAISTCTTHIIIIFLMFGPAIFIYTCPFQAFPADKVVSLFHTVIFPLMNPVIYTLRNQEVKASMRKLLSQHMFC

SEQ ID NO: 3134 - protein, 312 aa, unidentified
MEKSNNSTLFILLGFSQNKNIEVLCFVLFLFCYIAIWMGNLLIMISITCTQLIHQPMYFFLNYLSLSDLCYTSTVTPKLMVDLLAERKTISYNNCMIQLFTTHFFGGIEIFILTGMAYDRYVAICKPLHYTIIMSRQKCNTIIIVCCTGGFIHSASQFLLTIFVPFCGPNEIDHYFCDVYPLLKLACSNIHMIGLLVIANSGLIALVTFVVLLLSYVFILYTIRAYSAERRSKALATCSSHVIVVVLFFAPALFIYIRPVTTFSEDKVFALFYTIIAPMFNPLIYTLRNTEMKNAMRKVWCCQILLKRNQLF

SEQ ID NO: 3135 - protein, 313 aa, unidentified
MKKEQDSNVTEFVLLGLSSSWELQLFLFLLFLFFYIAIVLGNLLIVVTVQAHAHLLQSPMYYFLGHLSFIDLCLSCVTVPKMLGDFLQQGKSISFSGCLAQIYFLHFLGASEMFLLTVMAYDRYVAICNPLRYLTVMNPQLCLWLVLACWCGGFIHSIMQVILVIQLPFCGPNELDNFYCDVPQVIKLACMDTYVVEVLVIANSGLLSLVCFLVLLFSYAIILITLRTHFCQGQNKVFSTCASHLTVVSLIFVPCVFIYLRPFCSFSVDKIFSLFYTVITPMLNPLIYTLRNTDMKTAMKKLRIKPCGIPLPC

SEQ ID NO: 3136 - protein, 309 aa, unidentified
MGAKNNVTEFVLFGLFESREMQHTCFVVFFLFHVLTVLGNLLVIITINARKTLKSPMYFFLSQLSFADICYPSTTIPKMIADTFVEHKIISFNGCMTQLFSAHFFGGTEIFLLTAMAYDRYVAICRPLHYTAIMDCRKCGLLAGASWLAGFLHSILQTLLTVQLPFCGPNEIDNFFCDVHPLLKLACADTYMVGLIVVANSGMISLASFFILIISYVIILLNLRSQSSEDRRKAVSTCGSHVITVLLVLMPPMFMYIRPSTTLAADKLIILFNIVMPPLLNPLIYTLRNNDVKNAMRKLFRVKRSLGEK

SEQ ID NO: 3137 - protein, 311 aa, unidentified
MEKINNVTEFIFWGLSQSPEIEKVCFVVFSFFYIIILLGNLLIMLTVCLSNLFKSPMYFFLSFLSFVDICYSSVTAPKMIVDLLAKDKTISYVGCMLQLFGVHFFGCTEIFILTVMAYDRYVAICKPLHYMTIMNRETCNKMLLGTWVGGFLHSIIQVALVVQLPFCGPNEIDHYFCDVHPVLKLACTETYIVGVVVTANSGTIALGSFVILLISYSIILVSLRKQSAEGRRKALSTCGSHIAMVVIFFGPCTFMYMRPDTTFSEDKMVAVFYTIITPMLNPLIYTLRNAEVKNAMKKLWGRNVFLEAKGK

SEQ ID NO: 3138 - protein, 305 aa, unidentified
MVATNNVTEIIFVGFSQNWSEQRVISVMFLLMYTAVVLGNGLIVVTILASKVLTSPMYFFLSYLSFVEICYCSVMAPKLIFDSFIKRKVISLKGCLTQMFSLHFFGGTEAFLLMVMAYDRYVAICKPLHYMAIMNQRMCGLLVRIAWGGGLLHSVGQTFLIFQLPFCGPNIMDHYFCDVHPVLELACADTFFISLLIITNGGSISVVSFFVLMASYLIILHFLRSHNLEGQHKALSTCASHVTVVDLFFIPCSLVYIRPCVTLPADKIVAVFYTVVTPLLNPVIYSFRNAEVKNAMRRFIGGKVI

SEQ ID NO: 3139 - protein, 313 aa, unidentified
MSIINTSYVEITTFFLVGMPGLEYAHIWISIPICSMYLIAILGNGTILFIIKTEPSLHGPMYYFLSMLAMSDLGLSLSSLPTVLSIFLFNAPETSSSACFAQEFFIHGFSVLESSVLLIMSFDRFLAIHNPLRYTSILTTVRVAQIGIVFSFKSMLLVLPFPFTLRSLRYCKKNQLSHSYCLHQDVMKLACSDNRIDVIYGFFGALCLMVDFILIAVSYTLILKTVPGIASKKEELKALNTCVSHICAVIIFYLPIINLAVVHRFAGHVSPLINVLMANVLLLVPPLMKPIVYCVKTKQIRVRVVAKLCQWKI

SEQ ID NO: 3140 - protein, 313 aa, unidentified
MSIINTSYVEITTFFLVGMPGLEYAHIWISIPICSMYLIAILGNGTILFIIKTEPSLHEPMYYFLSMLAMSDLGLSLSSLPTVLSIFLFNAPEISSNACFAQEFFIHGFSVLESSVLLIMSFDRFLAIHNPLRYTSILTTVRVAQIGIVFSFKSMLLVLPFPFTLRNLRYCKKNQLSHSYCLHQDVMKLACSDNRIDVIYGFFGALCLMVDFILIAVSYTLILKTVLGIASKKEQLKALNTCVSHICAVIIFYLPIINLAVVHRFARHVSPLINVLMANVLLLVPPLTNPIVYCVKTKQIRVRVVAKLCQRKI

SEQ ID NO: 3141 - protein, 312 aa, unidentified
MSVLNNSEVKLFLLIGIPGLEHAHIWFSIPICLMYLLAIMGNCTILFIIKTEPSLHEPMYYFLAMLAVSDMGLSLSSLPTMLRVFLFNAMGISPNACFAQEFFIHGFTVMESSVLLIMSLDRFLAIHNPLRYSSILTSNRVAKMGLILAIRSILLVIPFPFTLRRLKYCQKNLLSHSYCLHQDTMKLACSDNKTNVIYGFFIALCTMLDLALIVLSYVLILKTILSIASLAERLKALNTCVSHICAVLTFYVPIITLAAMHHFAKHKSPLVVILIADMFLLVPPLMNPIVYCVKTRQIWEKILGKLLNVCGR

SEQ ID NO: 3142 - protein, 310 aa, unidentified
MWYNNSAGPFLLTGFLGSEAVHYRISMSFFVIYFSVLFGNGTLLVLIWNDHSLHEPMYYFLAMLADTDLGMTFTTMPTVLGVLLLDQREIAHAACFTQSFIHSLAIVESGILLVLAYDCFIAIRTPLRYNCILTNSRVMNIGLGVLMRGFMSILPIILSLYCYPYCGSRALLHTFCLHQDVIKLACADITFNHIYPIIQTSLTVFLDALIIIFSYILILKTVMGIASGQEEAKSLNTCVSHISCVLVFHITVMGLSFIHRFGKHAPHVVPITMSYVHFLFPPFVNPIIYSIKTKQIQRSIIRLFSGQSRA

SEQ ID NO: 3143 - protein, 312 aa, unidentified
MSSSGSSHPFLLTGFPGLEEAHHWISVFFLFMYISILFGNGTLLLLIKEDHNLHEPMYFFLAMLAATDLGLALTTMPTVLGVLWLDHREIGSAACFSQAYFIHSLSFLESGILLAMAYDRFIAICNPLRYTSVLTNTRVVKIGLGVLMRGFVSVVPPIRPLYFFLYCHSHVLSHAFCLHQDVIKLACADTTFNRLYPAVLVVFIFVLDYLIIFISYVLILKTVLSIASREERAKALITCVSHICCVLVFYVTVIGLSLIHRFGKQVPHIVHLIMSYAYFLFPPLMNPITYSVKTKQIQNAILHLFTTHRIGT

SEQ ID NO: 3144 - protein, 312 aa, unidentified
MGLNKSASTFQLTGFPGMEKAHHWIFIPLLAAYISILLGNGTLLFLIRNDHNLHEPMYYFLAMLAATDLGVTLTTMPTVLGVLWLDHREIGHGACFSQAYFIHTLSVMESGVLLAMAYDCFITIRSPLRYTSILTNTQVMKIGVRVLTRAGLSIMPIVVRLHWFPYCRSHVLSHAFCLHQDVIKLACADITFNRLYPVVVLFAMVLLDFLIIFFSYILILKTVMGIGSGGERAKALNTCVSHICCILVFYVTVVCLTFIHRFGKHVPHVVHITMSYIHFLFPPFMNPFIYSIKTKQIQSGILRLFSLPHSRA

SEQ ID NO: 3145 - protein, 324 aa, unidentified
MQKPQLLVPIIATSNGNLVHAAYFLLVGIPGLGPTIHFWLAFPLCFMYALATLGNLTIVLIIRVERRLHEPMYLFLAMLSTIDLVLSSITMPKMASLFLMGIQEIEFNICLAQMFLIHALSAVESAVLLAMAFDRFVAICHPLRHASVLTGCTVAKIGLSALTRGFVFFFPLPFILKWLSYCQTHTVTHSFCLHQDIMKLSCTDTRVNVVYGLFIILSVMGVDSLFIGFSYILILWAVLELSSRRAALKAFNTCISHLCAVLVFYVPLIGLSVVHRLGGPTSLLHVVMANTYLLLPPVVNPLVYGAKTKEICSRVLCMFSQGGK

SEQ ID NO: 3146 - protein, 317 aa, unidentified
MVDPNGNESSATYFILIGLPGLEEAQFWLAFPLCSLYLIAVLGNLTIIYIVRTEHSLHEPMYIFLCMLSGIDILISTSSMPKMLAIFWFNSTTIQFDACLLQMFAIHSLSGMESTVLLAMAFDRYVAICHPLRHATVLTLPRVTKIGVAAVVRGAALMAPLPVFIKQLPFCRSNILSHSYCLHQDVMKLACDDIRVNVVYGLIVIISAIGLDSLLISFSYLLILKTVLGLTREAQAKAFGTCVSHVCAVFIFYVPFIGLSMVHRFSKRRDSPLPVILANIYLLVPPVLNPIVYGVKTKEIRQRILRLFHVATHASEP

SEQ ID NO: 3147 - protein, 320 aa, unidentified
MSSCNFTHATFVLIGIPGLEKAHFWVGFPLLSMYVVAMFGNCIVVFIVRTERSLHAPMYLFLCMLAAIDLALSTSTMPKILALFWFDSREISFEACLTQMFFIHALSAIESTILLAMAFDRYVAICHPLRHAAVLNNTVTAQIGIVAVVRGSLFFFPLPLLIKRLAFCHSNVLSHSYCVHQDVMKLAYADTLPNVVYGLTAILLVMGVDVMFISLSYFLIIRTVLQLPSKSERAKAFGTCVSHIGVVLAFYVPLIGLSVVHRFGNSLHPIVRVVMGDIYLLLPPVINPIIYGAKTKQIRTRVLAMFKISCDKDLQAVGGK

SEQ ID NO: 3148 - protein, 342 aa, unidentified
MTETSLSSQCFPMSVLNNTIAEPLIFLLMGIPGLKATQYWISIPFCLLYVVAVSGNSMILFVVLCERSLHKPMYYFLSMLSATDLSLSLCTLSTTLGVFWFEAREINLNACIAQMFFLHGFTFMESGVLLAMAFDRFVAICYPLRYTTILTNARIAKIGMSMLIRNVAVMLPVMLFVKRLSFCSSMVLSHSYCYHVDLIQLSCTDNRINSILGLFALLSTTGFDCPCILLSYILIIRSVLSIASSEERRKAFNTCTSHISAVSIFYLPLISLSLVHRYGHSAPPFVHIIMANVFLLIPPVLNPIIYSVKIKQIQKAIIKVLIQKHSKSNHQLFLIRDKAIYE

SEQ ID NO: 3149 - protein, 314 aa, unidentified
MTLGSLGNSSSSVSATFLLSGIPGLERMHIWISIPLCFMYLVSIPGNCTILFIIKTERSLHEPMYLFLSMLALIDLGLSLCTLPTVLGIFWVGAREISHDACFAQLFFIHCFSFLESSVLLSMAFDRFVAICHPLHYVSILTNTVIGRIGLVSLGRSVALIFPLPFMLKRFPYCGSPVLSHSYCLHQEVMKLACADMKANSIYGMFVIVSTVGIDSLLILFSYALILRTVLSIASRAERFKALNTCVSHICAVLLFYTPMIGLSVIHRFGKQAPHLVQVVMGFMYLLFPPVMNPIVYSVKTKQIRDRVTHAFCY

SEQ ID NO: 3150 - protein, 314 aa, unidentified
MLGLNGTPFQPATLQLTGIPGIQTGLTWVALIFCILYMISIVGNLSILTLVFWEPALHQPMYYFLSMLALNDLGVSFSTLPTVISTFCFNYNHVAFNACLVQMFFIHTFSFMESGILLAMSLDRFVAICYPLRYVTVLTHNRILAMGLGILTKSFTTLFPFPFVVKRLPFCKGNVLHHSYCLHPDLMKVACGDIHVNNIYGLLVIIFTYGMDSTFILLSYALILRAMLVIISQEQRLKALNTCMSHICAVLAFYVPIIAVSMIHRFWKSAPPVVHVMMSNVYLFVPPMLNPIIYSVKTKEIRKGILKFFHKSQA

SEQ ID NO: 3151 - protein, 312 aa, unidentified
MGLFNVTHPAFFLLTGIPGLESSHSWLSGPLCVMYAVALGGNTVILQAVRVEPSLHEPMYYFLSMLSFSDVAISMATLPTVLRTFCLNARNITFDACLIQMFLIHFFSMMESGILLAMSFDRYVAICDPLRYATVLTTEVIAAMGLGAAARSFITLFPLPFLIKRLPICRSNVLSHSYCLHPDMMRLACADISINSIYGLFVLVSTFGMDLFFIFLSYVLILRSVMATASREERLKALNTCVSHILAVLAFYVPMIGVSTVHRFGKHVPCYIHVLMSNVYLFVPPVLNPLIYSAKTKEIRRAIFRMFHHIKI

SEQ ID NO: 3152 - protein, 315 aa, unidentified
MGDWNNSDAVEPIFILRGFPGLEYVHSWLSILFCLAYLVAFMGNVTILSVIWIESSLHQPMYYFISILAVNDLGMSLSTLPTMLAVLWLDAPEIQASACYAQLFFIHTFTFLESSVLLAMAFDRFVAICHPLHYPTILTNSVIGKIGLACLLRSLGVVLPTPLLLRHYHYCHGNALSHAFCLHQDVLRLSCTDARTNSIYGLCVVIATLGVDSIFILLSYVLILNTVLDIASREEQLKALNTCVSHICVVLIFFVPVIGVSMVHRFGKHLSPIVHILMADIYLLLPPVLNPIVYSVRTKQIRLGILHKFVLRRRF

SEQ ID NO: 3153 - protein, 317 aa, unidentified
MSQVTNTTQEGIYFILTDIPGFEASHIWISIPVCCLYTISIMGNTTILTVIRTEPSVHQRMYLFLSMLALTDLGLTLTTLPTVMQLLWFNVRRISSEACFAQFFFLHGFSFMESSVLLAMSVDCYVAICCPLHYASILTNEVIGRTGLAIICCCVLAVLPSLFLLKRLPFCHSHLLSRSYCLHQDMIRLVCADIRLNSWYGFALALLIIIVDPLLIVISYTLILKNILGTATWAERLRALNNCLSHILAVLVLYIPMVGVSMTHRFAKHASPLVHVIMANIYLLAPPVMNPIIYSVKNKQIQWGMLNFLSLKNMHSR

SEQ ID NO: 3154 - protein, 323 aa, unidentified
MSTLPTQIAPNSSTSMAPTFLLVGMPGLSGAPSWWTLPLIAVYLLSALGNGTILWIIALQPALHRPMHFFLFLLSVSDIGLVTALMPTLLGIALAGAHTVPASACLLQMVFIHVFSVMESSVLLAMSIDRALAICRPLHYPALLTNGVISKISLAISFRCLGLHLPLPFLLAYMPYCLPQVLTHSYCLHPDVARLACPEAWGAAYSLFVVLSAMGLDPLLIFFSYGLIGKVLQGVESREDRWKAGQTCAAHLSAVLLFYIPMILLALINHPELPITQHTHTLLSYVHFLLPPLINPILYSVKMKEIRKRILNRLQPRKVGGAQ

SEQ ID NO: 3155 - protein, 327 aa, unidentified
MAIFNNTTSSSSNFLLTAFPGLECAHVWISIPVCCLYTIALLGNSMIFLVIITKRRLHKPMYYFLSMLAAVDLCLTITTLPTVLGVLWFHAREISFKACFIQMFFVHAFSLLESSVLVAMAFDRFVAICNPLNYATILTDRMVLVIGLVICIRPAVFLLPLLVAINTVSFHGGHELSHPFCYHPEVIKYTYSKPWISSFWGLFLQLYLNGTDVLFILFSYVLILRTVLGIVARKKQQKALSTCVCHICAVTIFYVPLISLSLAHRLFHSTPRVLCSTLANIYLLLPPVLNPIIYSLKTKTIRQAMFQLLQSKGSWGFNVRGLRGRWD

SEQ ID NO: 3156 - protein, 321 aa, unidentified
MFLSSRMITSVSPSTSTNSSFLLTGFSGMEQQYPWLSIPFSSIYAMVLLGNCMVLHVIWTEPSLHQPMFYFLSMLALTDLCMGLSTVYTVLGILWGIIREISLDSCIAQSYFIHGLSFMESSVLLTMAFDRYIAICNPLRYSSILTNSRIIKIGLTIIGRSFFFITPPIICLKFFNYCHFHILSHSFCLHQDLLRLACSDIRFNSYYALMLVICILLLDAILILFSYILILKSVLAVASQEERHKLFQTCISHICAVLVFYIPIISLTMVHRFGKHLSPVAHVLIGNIYILFPPLMNPIIYSVKTQQIHTRMLRLFSLKRY

SEQ ID NO: 3157 - protein, 312 aa, unidentified
MSISNITVYMPSVLTLVGIPGLESVQCWIGIPFCAIYLIAMIGNSLLLSIIKSERSLHEPLYIFLGMLGATDIALASSIMPKMLGIFWFNVPEIYFDSCLLQMWFIHTLQGIESGILVAMALDRYVAICYPLRHANIFTHQLVIQIGTMVVLRAAILVAPCLVLIKCRFQFYHTTVISHSYCEHMAIVKLAAANVQVNKIYGLFVAFTVAGFDLTFITLSYIQIFITVFRLPQKEARFKAFNTCIAHICVFLQFYLLAFFSFFTHRFGSHISPYIHILFSSIYLLVPPFLNPLVYGAKTTQIRIHVVKMFCS

SEQ ID NO: 3158 - protein, 316 aa, unidentified
MPTFNGSVFMPSAFILIGIPGLESVQCWIGIPFSAMYLIGVIGNSLILVIIKYENSLHIPMYIFLAMLAATDIALNTCILPKMLGIFWFHLPEISFDACLFQMWLIHSFQAIESGILLAMALDRYVAICIPLRHATIFSQQFLTHIGLGVTLRAAILIIPSLGLIKCCLKHYRTTVISHSYCEHMAIVKLATEDIRVNKIYGLFVAFAILGFDIIFITLSYVQIFITVFQLPQKEARFKAFNTCIAHICVFLQFYLLAFFSFFTHRFGSHIPPYIHILLSNLYLLVPPFLNPIVYGVKTKQIRDHIVKVFFFKKVT

SEQ ID NO: 3159 - protein, 323 aa, unidentified
MSHTNVTIFHPAVFVLPGIPGLEAYHIWLSIPLCLIYITAVLGNSILIVVIVMERNLHVPMYFFLSMLAVMDILLSTTTVPKALAIFWLQAHNIAFDACVTQGFFVHMMFVGESAILLAMAFDRFVAICAPLRYTTVLTWPVVGRIALAVITRSFCIIFPVIFLLKRLPFCLTNIVPHSYCEHIGVARLACADITVNIWYGFSVPIVMVILDVILIAVSYSLILRAVFRLPSQDARHKALSTCGSHLCVILMFYVPSFFTLLTHHFGRNIPQHVHILLANLYVAVPPMLNPIVYGVKTKQIREGVAHRFFDIKTWCCTSPLGS

SEQ ID NO: 3160 - protein, 335 aa, unidentified
MAQVRALHKIMALFSANSIGAMNNSDTRIAGCFLTGIPGLEQLHIWLSIPFCIMYITALEGNGILICVILSQAILHEPMYIFLSMLASADVLLSTTTMPKALANLWLGYSLISFDGCLTQMFFIHFLFIHSAVLLAMAFDRYVAICSPLRYVTILTSKVIGKIVTAALSHSFIIMFPSIFLLEHLHYCQINIIAHTFCEHMGIAHLSCSDISINVWYGLAAALLSTGLDIMLITVSYIHILQAVFRLLSQDARSKALSTCGSHICVILLFYVPALFSVFAYRFGGRSVPCYVHILLASLYVVIPPMLNPVIYGVRTKPILEGAKQMFSNLAKGSK

SEQ ID NO: 3161 - protein, 318 aa, unidentified
MSDSNLSDNHLPDTFFLTGIPGLEAAHFWIAIPFCAMYLVALVGNAALILVIAMDNALHAPMYLFLCLLSLTDLALSSTTVPKMLAILWLHAGEISFGGCLAQMFCVHSIYALESSILLAMAFDRYVAICNPLRYTTILNHAVIGRIGFVGLFRSVAIVSPFIFLLRRLPYCGHRVMTHTYCEHMGIARLACANITVNIVYGLTVALLAMGLDSILIAISYGFILHAVFHLPSHDAQHKALSTCGSHIGIILVFYIPAFFSFLTHRFGHHEVPKHVHIFLANLYVLVPPVLNPILYGARTKEIRSRLLKLLHLGKTSI

SEQ ID NO: 3162 - protein, 325 aa, unidentified
MFLPNDTQFHPSSFLLLGIPGLETLHIWIGFPFCAVYMIALIGNFTILLVIKTDSSLHQPMFYFLAMLATTDVGLSTATIPKMLGIFWINLRGIIFEACLTQMFFIHNFTLMESAVLVAMAYDSYVAICNPLQYSAILTNKVVSVIGLGVFVRALIFVIPSILLILRLPFCGNHVIPHTYCEHMGLAHLSCASIKINIIYGLCAICNLVFDITVIALSYVHILCAVFRLPTHEARLKSLSTCGSHVCVILAFYTPALFSFMTHRFGRNVPRYIHILLANLYVVVPPMLNPVIYGVRTKQIYKCVKKILLQEQGMEKEEYLIHTRF

SEQ ID NO: 3163 - protein, 312 aa, unidentified
MPSINDTHFYPPFFLLLGIPGLDTLHIWISFPFCIVYLIAIVGNMTILFVIKTEHSLHQPMFYFLAMLSMIDLGLSTSTIPKMLGIFWFNLQEISFGGCLLQMFFIHMFTGMETVLLVVMAYDRFVAICNPLQYTMILTNKTISILASVVVGRNLVLVTPFVFLILRLPFCGHNIVPHTYCEHRGLAGLACAPIKINIIYGLMVISYIIVDVILIASSYVLILRAVFRLPSQDVRLKAFNTCGSHVCVMLCFYTPAFFSFMTHRFGQNIPHYIHILLANLYVVVPPALNPVIYGVRTKQIREQIVKIFVQKE

SEQ ID NO: 3164 - protein, 313 aa, unidentified
MPIANDTQFHTSSFLLLGIPGLEDVHIWIGFPFFSVYLIALLGNAAIFFVIQTEQSLHEPMYYCLAMLDSIDLSLSTATIPKMLGIFWFNIKEISFGGYLSQMFFIHFFTVMESIVLVAMAFDRYIAICKPLWYTMILTSKIISLIAGIAVLRSLYMVIPLVFLLLRLPFCGHRIIPHTYCEHMGIARLACASIKVNIMFGLGSISLLLLDVLLIILSHIRILYAVFCLPSWEARLKALNTCGSHIGVILAFSTPAFFSFFTHCFGHDIPQYIHIFLANLYVVVPPTLNPVIYGVRTKHIRETVLRIFFKTDH

SEQ ID NO: 3165 - protein, 317 aa, unidentified
MAGRMSTSNHTQFHPSSFLLLGIPGLEDVHIWIGVPFFFVYLVALLGNTALLFVIQTEQSLHEPMYYFLAMLDSIDLGLSTATIPKMLGIFWFNTKEISFGGCLSHMFFIHFFTAMESIVLVAMAFDRYIAICKPLRYTMILTSKIISLIAGIAVLRSLYMVVPLVFLLLRLPFCGHRIIPHTYCEHMGIARLACASIKVNIRFGLGNISLLLLDVILIILSYVRILYAVFCLPSWEARLKALNTCGSHIGVILAFFTPAFFSFLTHRFGHNIPQYIHIILANLYVVVPPALNPVIYGVRTKQIRERVLRIFLKTNH

SEQ ID NO: 3166 - protein, 320 aa, unidentified
MPSASAMIIFNLSSYNPGPFILVGIPGLEQFHVWIGIPFCIIYIVAVVGNCILLYLIVVEHSLHEPMFFFLSMLAMTDLILSTAGVPKALSIFWLGAREITFPGCLTQMFFLHYNFVLDSAILMAMAFDHYVAICSPLRYTTILTPKTIIKSAMGISFRSFCIILPDVFLLTCLPFCRTRIIPHTYCEHIGVAQLACADISINFWYGFCVPIMTVISDVILIAVSYAHILCAVFGLPSQDACQKALGTCGSHVCVILMFYTPAFFSILAHRFGHNVSRTFHIMFANLYIVIPPALNPMVYGVKTKQIRDKVILLFSKGTG

SEQ ID NO: 3167 - protein, 324 aa, unidentified
MLGPAYNHTMETPASFLLVGIPGLQSSHLWLAISLSAMYITALLGNTLIVTAIWMDSTRHEPMYCFLCVLAAVDIVMASSVVPKMVSIFCSGDSSISFSACFTQMFFVHLATAVETGLLLTMAFDRYVAICKPLHYKRILTPQVMLGMSMAVTIRAVTFMTPLSWMMNHLPFCGSNVVVHSYCKHIALARLACADPVPSSLYSLIGSSLMVGSDVAFIAASYILILRAVFDLSSKTAQLKALSTCGSHVGVMALYYLPGMASIYAAWLGQDIVPLHTQVLLADLYVIIPATLNPIIYGMRTKQLLEGIWSYLMHFLFDHSNLGS

SEQ ID NO: 3168 - protein, 350 aa, unidentified
MCQQILRDCILLIHHLCINRKKVSLVMLGPAYNHTMETPASFLLVGIPGLQSSHLWLAISLSAMYIIALLGNTIIVTAIWMDSTRHEPMYCFLCVLAAVDIVMASSVVPKMVSIFCSGDSSISFSACFTQMFFVHLATAVETGLLLTMAFDRYVAICKPLHYKRILTPQVMLGMSMAITIRAIIAITPLSWMVSHLPFCGSNVVVHSYCEHIALARLACADPVPSSLYSLIGSSLMVGSDVAFIAASYILILKAVFGLSSKTAQLKALSTCGSHVGVMALYYLPGMASIYAAWLGQDVVPLHTQVLLADLYVIIPATLNPIIYGMRTKQLRERIWSYLMHVLFDHSNLGS

SEQ ID NO: 3169 - protein, 311 aa, unidentified
MFYHNKSIFHPVTFFLIGIPGLEDFHMWISGPFCSVYLVALLGNATILLVIKVEQTLREPMFYFLAILSTIDLALSTTSVPRMLGIFWFDAHEINYGACVAQMFLIHAFTGMEAEVLLAMAFDRYVAVCAPLHYATILTSQVLVGISMCIVIRPVLLTLPMVYLIYRLPFCQAHIIAHSYCEHMGIAKLSCGNIRINGIYGLFVVSFFVLNLVLIGISYVYILRAVFRLPSHDAQLKALSTCGAHVGVICVFYIPSVFSFLTHRFGHQIPGYIHILVANLYLIIPPSLNPIIYGVRTKQIRERVLYVFTKK

SEQ ID NO: 3170 - protein, 314 aa, unidentified
MLPSNITSTHPAVFLLVGIPGLEHLHAWISIPFCFAYTLALLGNCTLLFIIQADAALHEPMYLFLAMLATIDLVLSSTTLPKMLAIFWFRDQEINFFACLVQMFFLHSFSIMESAVLLAMAFDRYVAICKPLHYTTVLTGSLITKIGMAAVARAVTLMTPLPFLLRRFHYCRGPVIAHCYCEHMAVVRLACGDTSFNNIYGIAVAMFIVVLDLLFVILSYVFILQAVLQLASQEARYKAFGTCVSHIGAILSTYTPVVISSVMHRVARHAAPRVHILLAIFYLLFPPMVNPIIYGVKTKQIREYVLSLFQRKNM

SEQ ID NO: 3171 - protein, 314 aa, unidentified
MSASNITLTHPTAFLLVGIPGLEHLHIWISIPFCLAYTLALLGNCTLLLIIQADAALHEPMYLFLAMLAAIDLVLSSSALPKMLAIFWFRDREINFFACLAQMFFLHSFSIMESAVLLAMAFDRYVAICKPLHYTKVLTGSLITKIGMAAVARAVTLMTPLPFLLRCFHYCRGPVIAHCYCEHMAVVRLACGDTSFNNIYGIAVAMFIVVLDLLLVILSYIFILQAVLLLASQEARYKAFGTCVSHIGAILAFYTTVVISSVMHRVARHAAPHVHILLANFYLLFPPMVNPIIYGVKTKQIRESILGVFPRKDM

SEQ ID NO: 3172 - protein, 329 aa, unidentified
MTLVSFFSFLSKPLIMLLSNSSWRLSQPSFLLVGIPGLEESQHWIALPLGILYLLALVGNVTILFIIWMDPSLHQSMYLFLSMLAAIDLVLASSTAPKALAVLLVHAHEIGYIVCLIQMFFIHAFSSMESGVLVAMALDCYVAICHPLHHSTILHPGVIGCIGMVVLVRGLLLLIPFPILLGKLIFCQATIIGHAYCEHMAVVKLACSETTVNRAYGLTMALLVIGLDVLAIGVSYAHILQAVLKVPGSEARLKAFSTCGSHICVILVFYVPGIFSFLTHRFGHHVPHHVHVLLATWYLLMPPALNPLVYGVKTQQIRQRVLRVFTQKD

SEQ ID NO: 3173 - protein, 317 aa, unidentified
MLTFHNVCSVPSSFWLTGIPGLESLHVWLSIPFGSMYLVAVVGNVTILAVVKIERSLHQPMYFFLCMLAAIDLVLSTSTIPKLLGIFWFGACDIGLDACLGQMFLIHCFATVESGIFLAMAFDRYVAICNPLRHSMVLTYTVVGRLGLVSLLRGVLYIGPLPLMIRLRLPLYKTHVISHSYCEHMAVVALTCGDSRVNNVYGLSIGFLVLILDSVAIAASYVMIFRAVMGLATPEARLKTLGTCASHLCAILIFYVPIAVSSLIHRFGQCVPPPVHTLLANFYLLIPPILNPIVYAVRTKQIRESLLQIPRIEMKIR

SEQ ID NO: 3174 - protein, 320 aa, unidentified
MSFLNGTSLTPASFILNGIPGLEDVHLWISFPLCTMYSIAITGNFGLMYLIYCDEALHRPMYVFLALLSFTDVLMCTSTLPNTLFILWFNLKEIDFKACLAQMFFVHTFTGMESGVLMLMALDHCVAICFPLRYATILTNSVIAKAGFLTFLRGVMLVIPSTFLTKRLPYCKGNVIPHTYCDHMSVAKISCGNVRVNAIYGLIVALLIGGFDILCITISYTMILQAVVSLSSADARQKAFSTCTAHFCAIVLTYVPAFFTFFTHHFGGHTIPLHIHIIMANLYLLMPPTMNPIVYGVKTRQVRESVIRFFLKGKDNSHNF

SEQ ID NO: 3175 - protein, 321 aa, unidentified
MSGDNSSSLTPGFFILNGVPGLEATHIWISLPFCFMYIIAVVGNCGLICLISHEEALHRPMYYFLALLSFTDVTLCTTMVPNMLCIFWFNLKEIDFNACLAQMFFVHMLTGMESGVLMLMALDRYVAICYPLRYATILTNPVIAKAGLATFLRNVMLIIPFTLLTKRLPYCRGNFIPHTYCDHMSVAKVSCGNFKVNAIYGLMVALLIGVFDICCISVSYTMILQAVMSLSSADARHKAFSTCTSHMCSIVITYVAAFFTFFTHRFVGHNIPNHIHIIVANLYLLLPPTMNPIVYGVKTKQIQEGVIKFLLGDKVSFTYDK

SEQ ID NO: 3176 - protein, 321 aa, unidentified
MLTLNKTDLIPASFILNGVPGLEDTQLWISFPFCSMYVVAMVGNCGLLYLIHYEDALHKPMYYFLAMLSFTDLVMCSSTIPKALCIFWFHLKDIGFDECLVQMFFTHTFTGMESGVLMLMALDRYVAICYPLRYSTILTNPVIAKVGTATFLRGVLLIIPFTFLTKLLPYCRGNILPHTYCDHMSVAKLSCGNVKVNAIYGLMVALLIWGFDILCITNSYTMILRAVVSLSSADARQKAFNTCTAHICAIVFSYTPAFFSFFSHRFGEHIIPPSCHIIVANIYLLLPPTMNPIVYGVKTKQIRDCVIRILSGSKDTKSYSM

SEQ ID NO: 3177 - protein, 324 aa, unidentified
MPLFNSLCWFPTIHVTPPSFILNGIPGLERVHVWISLPLCTMYIIFLVGNLGLVYLIYYEESLHHPMYFFFGHALSLIDLLTCTTTLPNALCIFWFSLKEINFNACLAQMFFVHGFTGVESGVLMLMALDRYVAICYPLRYATTLTNPIIAKAELATFLRGVLLMIPFPFLVKRLPFCQSNIISHTYCDHMSVVKLSCASIKVNVIYGLMVALLIGVFDICCISLSYTLILKAAISLSSSDARQKAFSTCTAHISAIIITYVPAFFTFFAHRFGGHTIPPSLHIIVANLYLLLPPTLNPIVYGVKTKQIRKSVIKFFQGDKGAG

SEQ ID NO: 3178 - protein, 320 aa, unidentified
MAETLQLNSTFLHPNFFILTGFPGLGSAQTWLTLVFGPIYLLALLGNGALPAVVWIDSTLHQPMFLLLAILAATDLGLATSIAPGLLAVLWLGPRSVPYAVCLVQMFFVHALTAMESGVLLAMACDRAAAIGRPLHYPVLVTKACVGYAALALALKAVAIVVPFPLLVAKFEHFQAKTIGHTYCAHMAVVELVVGNTQATNLYGLALSLAISGMDILGITGSYGLIAHAVLQLPTREAHAKAFGTCSSHICVILAFYIPGLFSYLTHRFGHHTVPKPVHILLSNIYLLLPPALNPLIYGARTKQIRDRLLETFTFRKSPL

SEQ ID NO: 3179 - protein, 318 aa, unidentified
MIQPMASPSNSSTVPVSEFLLICFPNFQSWQHWLSLPLSLLFLLAMGANTTLLITIQLEASLHQPLYYLLSLLSLLDIVLCLTVIPKVLAIFWYDLRSISFPACFLQMFIMNSFLPMESCTFMVMAYDRYVAICHPLRYPSIITNQFVAKASVFIVVRNALLTAPIPILTSLLHYCGENVIENCICANLSVSRLSCDNFTLNRIYQFVAGWTLLGSDLFLIFLSYTFILRAVLRFKAEGAAVKALSTCGSHFILILFFSTILLVVVLTNVARKKVPMDILILLNVLHHLIPPALNPIVYGVRTKEIKQGIQKLLQRGR

SEQ ID NO: 3180 - protein, 315 aa, unidentified
MTTHRNDTLSTEASDFLLNCFVRSPSWQHWLSLPLSLLFLLAVGANTTLLMTIWLEASLHQPLYYLLSLLSLLDIVLCLTVIPKVLTIFWFDLRPISFPACFLQMYIMNCFLAMESCTFMVMAYDRYVAICHPLRYPSIITDHFVVKAAMFILTRNVLMTLPIPILSAQLRYCGRNVIENCICANMSVSRLSCDDVTINHLYQFAGGWTLLGSDLILIFLSYTFILRAVLRLKAEGAVAKALSTCGSHFMLILFFSTILLVFVLTHVAKKKVSPDVPVLLNVLHHVIPAALNPIIYGVRTQEIKQGMQRLLKKGC

SEQ ID NO: 3181 - protein, 313 aa, unidentified
MASPSNDSTAPVSEFLLICFPNFQSWQHWLSLPLSLLFLLAMGANTTLLITIQLEASLHQPLYYLLSLLSLLDIVLCLTVIPKVLAIFWFDLRSISFPACFLQMFIMNSFLTMESCTFMVMAYDRYVAICHPLRYPSIITDQFVARAVVFVIARNAFVSLPVPMLSARLRYCAGNIIKNCICSNLSVSKLSCDDITFNQLYQFVAGWTLLGSDLILIVISYSFILKVVLRIKAEGAVAKALSTCGSHFILILFFSTVLLVLVITNLARKRIPPDVPILLNILHHLIPPALNPIVYGVRTKEIKQGIQNLLKRL

SEQ ID NO: 3182 - protein, 324 aa, unidentified
MNHMSASLKISNSSKFQVSEFILLGFPGIHSWQHWLSLPLALLYLSALAANTLILIIIWQNPSLQQPMYIFLGILCMVDMGLATTIIPKILAIFWFDAKVISLPECFAQIYAIHFFVGMESGILLCMAFDRYVAICHPLRYPSIVTSSLILKATLFMVLRNGLFVTPVPVLAAQRDYCSKNEIEHCLCSNLGVTSLACDDRRPNSICQLVLAWLGMGSDLSLIILSYILILYSVLRLNSAEAAAKALSTCSSHLTLILFFYTIVVVISVTHLTEMKATLIPVLLNVLHNIIPPSLNPTVYALQTKELRAAFQKVLFALTKEIRS

SEQ ID NO: 3183 - protein, 319 aa, unidentified
MDTSTSVTYDSSLQISQFILMGLPGIHEWQHWLSLPLTLLYLLALGANLLIIITIQHETVLHEPMYHLLGILAVVDIGLATTIMPKILAIFWFDAKAISLPMCFAQIYAIHCFFCIESGIFLCMAVDRYIAICRPLQYPSIVTKAFVFKATGFIMLRNGLLTIPVPILAAQRHYCSRNEIEHCLCSNLGVISLACDDITVNKFYQLMLAWVLVGSDMALVFSSYAVILHSVLRLNSAEAMSKALSTCSSHLILILFHTGIIVLSVTHLAEKKIPLIPVFLNVLHNVIPPALNPLACALRMHKLRLGFQRLLGLGQDVSK

SEQ ID NO: 3184 - protein, 315 aa, unidentified
MSITKAWNSSSVTMFILLGFTDHPELQALLFVTFLGIYLTTLAWNLALIFLIRGDTHLHTPMYFFLSNLSFIDICYSSAVAPNMLTDFFWEQKTISFVGCAAQFFFFVGMGLSECLLLTAMAYDRYAAISSPLLYPTIMTQGLCTRMVVGAYVGGFLSSLIQASSIFRLHFCGPNIINHFFCDLPPVLALSCSDTFLSQVVNFLVVVTVGGTSFLQLLISYGYIVSAVLKIPSAEGRWKACNTCASHLMVVTLLFGTALFVYLRPSSSYLLGRDKVVSVFYSLVIPMLNPLIYSLRNKEIKDALWKVLERKKVFS

SEQ ID NO: 3185 - protein, 324 aa, unidentified
MAVGRNNTIVTKFILLGLSDHPQMKIFLFMLFLGLYLLTLAWNLSLIALIKMDSHLHMPMYFFLSNLSFLDICYVSSTAPKMLSDIITEQKTISFVGCATQYFVFCGMGLTECFLLAAMAYDRYAAICNPLLYTVLISHTLCLKMVVGAYVGGFLSSFIETYSVYQHDFCGPYMINHFFCDLPPVLALSCSDTFTSEVVTFIVSVVVGIVSVLVVLISYGYIVAAVVKISSATGRTKAFSTCASHLTAVTLFYGSGFFMYMRPSSSYSLNRDKVVSIFYALVIPVVNPIIYSFRNKEIKNAMRKAMERDPGISHGGPFIFMTLG

SEQ ID NO: 3186 - protein, 309 aa, unidentified
MDISEGNKTLVTEFVLTGLTDRPWLHVLFFVVFLVVYLITMVGNLGLIVLIWNDPHLHMPMYLFLGGLAFSDACTSTSITPRMLVNFLDKTAMISLAECITQFYFFASSATTECFLLVMMAYDRYVAICNPLLYPVMMSNKLSAQLLSISYVIGFLHPLVHVSLLLRLTFCRFNIIHYFYCEILQLFKISCNGPSINALMIFIFGAFIQIPTLMTIIISYTRVLFDILKKKSEKGRSKAFSTCGAHLLSVSLYYGTLIFMYVRPASGLAEDQDKVYSLFYTIIIPLLNPFIYSLRNKKVMHALRRVIRK

SEQ ID NO: 3187 - protein, 309 aa, unidentified
MTLGNSTEVTEFYLLGFGAQHEFWCILFIVFLLIYVTSIMGNSGIILLINTDSRFQTLTYFFLQHLAFVDICYTSAITPKMLQSFTEEKNLMLFQGCVIQFLVYATFATSDCYLLAMMAVDPYVAICKPLHYTVIMSRTVCIRLVAGSYIMGSINASVQTGFTCSLSFCKSNSINHFFCDVPPILALSCSNVDINIMLLVVFVGSNLIFTGLVVIFSYIYIMATILKMSSSAGRKKSFSTCASHLTAVTIFYGTLSYMYLQSHSNNSQENMKVAFIFYGTVIPMLNPLIYSLRNKEVKEALKVIGKKLF

SEQ ID NO: 3188 - protein, 311 aa, unidentified
MTGGGNITEITYFILLGFSDFPRIIKVLFTIFLVIYITSLAWNLSLIVLIRMDSHLHTPMYFFLSNLSFIDVCYISSTVPKMLSNLLQEQQTITFVGCIIQYFIFSTMGLSESCLMTAMAYDRYAAICNPLLYSSIMSPTLCVWMVLGAYMTGLTASLFQIGALLQLHFCGSNVIRHFFCDMPQLLILSCTDTFFVQVMTAILTMFFGIASALVIMISYGYIGISIMKITSAKGRSKAFNTCASHLTAVSLFYTSGIFVYLSSSSGGSSSFDRFASVFYTVVIPMLNPLIYSLRNKEIKDALKRLQKRKCC

SEQ ID NO: 3189 - protein, 316 aa, unidentified
MRLMKEVRGRNQTEVTEFLLLGLSDNPDLQGVLFALFLLIYMANMVGNLGMIVLIKIDLCLHTPMYFFLSSLSFVDASYSSSVTPKMLVNLMAENKAISFHGCAAQFYFFGSFLGTECFLLAMMAYDRYAAIWNPLLYPVLVSGRICFLLIATSFLAGCGNAAIHTGMTFRLSFCGSNRINHFYCDTPPLLKLSCSDTHFNGIVIMAFSSFIVISCVMIVLISYLCIFIAVLKMPSLEGRHKAFSTCASYLMAVTIFFGTILFMYLRPTSSYSMEQDKVVSVFYTVIIPVLNPLIYSLKNKDVKKALKKILWKHIL

SEQ ID NO: 3190 - protein, 324 aa, unidentified
MLESNYTMPTEFLFVGFTDYLPLRVTLFLVFLLVYTLTMVGNILLIILVNINSSLQIPMYYFLSNLSFLDISCSTAITPKMLANFLASRKSISPYGCALQMFFFASFADAECLILAAMAYDRYAAICNPLLYTTLMSRRVCVCFIVLAYFSGSTTSLVHVCLTFRLSFCGSNIVNHFFCDIPPLLALSCTDTQINQLLLFALCSFIQTSTFVVIFISYFCILITVLSIKSSGGRSKTFSTCASHLIAVTLFYGALLFMYLQPTTSYSLDTDKVVAVFYTVVFPMFNPIIYSFRNKDVKNALKKLLERIGYSNEWYLNRLRIVNI

SEQ ID NO: 3191 - protein, 362 aa, unidentified
MTEFHLQSQMPSIRLIFRRLSLGRIKPSQSPRCSTSFMVVPSFSIAEHWRRMKGANLSQGMEFELLGLTTDPQLQRLLFVVFLGMYTATLLGNLVMFLLIHVSATLHTPMYSLLKSLSFLDFCYSSTVVPQTLVNFLAKRKVISYFGCMTQMFFYAGFATSECYLIAAMAYDRYAAICNPLLYSTIMSPEVCASLIVGSYSAGFLNSLIHTGCIFSLKFCGAHVVTHFFCDGPPILSLSCVDTSLCEILLFIFAGFNLLSCTLTILISYFLILNTILKMSSAQGRFKAFSTCASHLTAICLFFGTTLFMYLRPRSSYSLTQDRTVAVIYTVVIPVLNPLMYSLRNKDVKKALIKVWGRKTME

SEQ ID NO: 3192 - protein, 314 aa, unidentified
MENNTEVTEFILVGLTDDPELQIPLFIVFLFIYLITLVGNLGMIELILLDSCLHTPMYFFLSNLSLVDFGYSSAVTPKVMVGFLTGDKFILYNACATQFFFFVAFITAESFLLASMAYDRYAALCKPLHYTTTMTTNVCACLAIGSYICGFLNASIHTGNTFRLSFCRSNVVEHFFCDAPPLLTLSCSDNYISEMVIFFVVGFNDLFSILVILISYLFIFITIMKMRSPEGRQKAFSTCASHLTAVSIFYGTGIFMYLRPNSSHFMGTDKMASVFYAIVIPMLNPLVYSLRNKEVKSAFKKTVGKAKASIGFIF

SEQ ID NO: 3193 - protein, 314 aa, unidentified
MENNTEVSEFILLGLTNAPELQVPLFIMFTLIYLITLTGNLGMIILILLDSHLHTPMYFFLSNLSLAGIGYSSAVTPKVLTGLLIEDKAISYSACAAQMFFCAVFATVENYLLSSMAYDRYAAVCNPLHYTTTMTTRVCACLAIGCYVIGFLNASIQIGDTFRLSFCMSNVIHHFFCDKPAVITLTCSEKHISELILVLISSFNVFFALLVTLISYLFILITILKRHTGKGYQKPLSTCGSHLIAIFLFYITVIIMYIRPSSSHSMDTDKIASVFYTMIIPMLSPIVYTLRNKDVKNAFMKVVEKAKYSLDSVF

SEQ ID NO: 3194 - protein, 309 aa, unidentified
MENCTEVTKFILLGLTSVPELQIPLFILFTFIYLLTLCGNLGMMLLILMDSCLHTPMYFFLSNLSLVDFGYSSAVTPKVMAGFLRGDKVISYNACAVQMFFFVALATVENYLLASMAYDRYAAVCKPLHYTTTMTASVGACLALGSYVCGFLNASFHIGGIFSLSFCKSNLVHHFFCDVPAVMALSCSDKHTSEVILVFMSSFNIFFVLLVIFISYLFIFITILKMHSAKGHQKALSTCASHFTAVSVFYGTVIFIYLQPSSSHSMDTDKMASVFYAMIIPMLNPVVYSLRNREVQNAFKKVLRRQKFL

SEQ ID NO: 3195 - protein, 309 aa, unidentified
MENSTEVTEFILLGLTDDPNLQIPLLLAFLFIYLITLLGNGGMMVIIHSDSHLHTPMYFFLSNLSLVDLGYSSAVAPKTVAALRSGDKAISYDGCAAQFFFFVGFATVECYLLASMAYDRHAAVCRPLHYTTTMTAGVCALLATGSYVSGFLNASIHAAGTFRLSFCGSNEINHFFCDIPPLLALSCSDTRISKLVVFVAGFNVFFTLLVILISYFFICITIQRMHSAEGQKKVFSTCASHLTALSIFYGTIIFMYLQPNSSQSVDTDKIASVFYTVVIPMLNPLIYSLRNKEVKSALWKILNKLYPQY

SEQ ID NO: 3196 - protein, 314 aa, unidentified
MENKTEVTQFILLGLTNDSELQVPLFITFPFIYIITLVGNLGIIVLIFWDSCLHNPMYFFLSNLSLVDFCYSSAVTPIVMAGFLIEDKVISYNACAAQMYIFVAFATVENYLLASMAYDRYAAVCKPLHYTTTMTTTVCARLAIGSYLCGFLNASIHTGDTFSLSFCKSNEVHHFFCDIPAVMVLSCSDRHISELVLIYVVSFNIFIALLVILISYTFIFITILKMHSASVYQKPLSTCASHFIAVGIFYGTIIFMYLQPSSSHSMDTDKMAPVFYTMVIPMLNPLVYSLRNKEVKSAFKKVVEKAKLSVGWSV

SEQ ID NO: 3197 - protein, 320 aa, unidentified
MNSENLTRAAVAPAEFVLLGITNRWDLRVALFLTCLPVYLVSLLGNMGMALLIRMDARLHTPMYFFLANLSLLDACYSSAIGPKMLVDLLLPRATIPYTACALQMFVFAGLADTECCLLAAMAYDRYVAIRNPLLYTTAMSQRLCLALLGASGLGGAVSAFVHTTLTFRLSFCRSRKINSFFCDIPPLLAISCSDTSLNELLLFAICGFIQTATVLAITVSYGFIAGAVIHMRSVEGSRRAASTGGSHLTAVAMMYGTLIFMYLRPSSSYALDTDKMASVFYTLVIPSLNPLIYSLRNKEVKEALRQTWSRFHCPGQGSQ

SEQ ID NO: 3198 - protein, 314 aa, unidentified
MMMVLRNLSMEPTFALLGFTDYPKLQIPLFLVFLLMYVITVVGNLGMIIIIKINPKFHTPMYFFLSHLSFVDFCYSSIVTPKLLENLVMADKSIFYFSCMMQYFLSCTAVVTESFLLAVMAYDRFVAICNPLLYTVAMSQRLCALLVAGSYLWGMFGPLVLLCYALRLNFSGPNVINHFFCEYTALISVSGSDILIPHLLLFSFATFNEMCTLLIILTSYVFIFVTVLKIRSVSGRHKAFSTWASHLTSITIFHGTILFLYCVPNSKNSRQTVKVASVFYTVVNPMLNPLIYSLRNKDVKDAFWKLIHTQVPFH

SEQ ID NO: 3199 - protein, 328 aa, unidentified
MFLTERNTTSEATFTLLGFSDYLELQIPLFFVFLAVYGFSVVGNLGMIVIIKINPKLHTPMYFFLNHLSFVDFCYSSIIAPMMLVNLVVEDRTISFSGCLVQFFFFCTFVVTELILFAVMAYDHFVAICNPLLYTVAISQKLCAMLVVVLYAWGVACSLTLACSALKLSFHGFNTINHFFCELSSLISLSYPDSYLSQLLLFTVATFNEISTLLIILTSYAFIIVTTLKMPSASGHRKVFSTCASHLTAITIFHGTILFLYCVPNSKNSRHTVKVASVFYTVVIPLLNPLIYSLRNKDVKDAIRKIINTKYFHIKHRHWYPFNFVIEQ

SEQ ID NO: 3200 - protein, 313 aa, unidentified
MLLTDRNTSGTTFTLLGFSDYPELQVPLFLVFLAIYNVTVLGNIGLIVIIKINPKLHTPMYFFLSQLSFVDFCYSSIIAPKMLVNLVVKDRTISFLGCVVQFFFFCTFVVTESFLLAVMAYDRFVAICNPLLYTVNMSQKLCVLLVVGSYAWGVSCSLELTCSALKLCFHGFNTINHFFCEFSSLLSLSCSDTYINQWLLFFLATFNEISTLLIVLTSYAFIVVTILKMRSVSGRRKAFSTCASHLTAITIFHGTILFLYCVPNSKNSRHTVKVASVFYTVVIPMLNPLIYSLRNKDVKDTVTEILDTKVFSY

SEQ ID NO: 3201 - protein, 314 aa, unidentified
MTRKNYTSLTEFVLLGLADTLELQIILFLFFLVIYTLTVLGNLGMILLIRIDSQLHTPMYFFLANLSFVDVCNSTTITPKMLADLLSEKKTISFAGCFLQMYFFISLATTECILFGLMAYDRYAAICRPLLYSLIMSRTVYLKMAAGAFAAGLLNFMVNTSHVSSLSFCDSNVIHHFFCDSPPLFKLSCSDTILKESISSILAGVNIVGTLLVILSSYSYVLFSIFSMHSGEGRHRAFSTCASHLTAIILFYATCIYTYLRPSSSYSLNQDKVASVFYTVVIPMLNPLIYSLRSKEVKKALANVISRKRTSSFL

SEQ ID NO: 3202 - protein, 313 aa, unidentified
MEEENATLLTEFVLTGFLYQPQWKIPLFLAFLVIYLITIMGNLGLIAVIWKDPHLHIPMYLLLGNLAFVDAWISSTVTPKMLNNFLAKSKMISLSECKIQFFSFAISVTTECFLLATMAYDRYVAICKPLLYPAIMTNGLCIRLLILSYVGGILHALIHEGFLFRLTFCNSNIVHHIYCDTIPLSKISCTDSSINFLMVFIFSGSIQVFSIVTILVSYTFVLFAILKKKSDKGVRKAFSTCGAHLFSVSLYYGPLLFIYVGPASPQADDQDMVEPLFYTVIIPLLNPIIYSLRNKQVTVSFTKMLKKHVKVSY

SEQ ID NO: 3203 - protein, 310 aa, unidentified
MEEENATLLTEFVLTGFLYQPQWKIPLFLAFLVIYLITIMGNLGLIAVIWKDPHLHIPMYLLLGNLAFVDALLSSSVTLKMLINFLAKSKMISLSECKIQLFSFAISVTTECFLLATMAYDRYVAICKPLLYPAIMTNGLCIRLLILSYVGGLLHALIHEGFLFRLTFCNSNIIQHFYCDIIPLLKISYTDSSINFLMVFIFAGSIQVFTIGTVLISYIFVLYTILKKKSVKGMRKAFSTCGAHLLSVSLYYGPLAFMYMGSASPQADDQDMMESLFYTVIVPLLNPMIYSLRNKQVIASFTKMFKRNDV

SEQ ID NO: 3204 - protein, 313 aa, unidentified
MEEENATLLTEFVLTGFLYQPQWKIPLFLAFLVIYLITIMGNLGLIAVIWKDPHLHIPMYLLLGNLAFVDAWISSTVTPKMLNNFLAKSKMISLSECKIQFFSIAIGVTTECFLLATMAYDRYVAICKPLLYPAIMTNGLCIRLLILSYIAGILHALIHEGFLFRLTFCNSNIVHHIYCDTIPLSKISCTDSSINFLMVFIFSGSIQVFSIVTILISYTFVLFTVLEKKSDKGVRKAFSTCGAHLFSVCLYYGPLLLMYVGPASPQADGQNMVEPLFYTVIIPLLNPIIYSLRNKQVIVSFIKMLKRNVKVSY

SEQ ID NO: 3205 - protein, 314 aa, unidentified
MSNEDMEQDNTTLLTEFVLTGLTYQPEWKMPLFLVFLVIYLITIVWNLGLIALIWNDPQLHIPMYFFLGSLAFVDAWISSTVTPKMLVNFLAKNRMISLSECMIQFFSFAFGGTTECFLLATMAYDRYVAICKPLLYPVIMNNSLCIRLLAFSFLGGFLHALIHEVLIFRLTFCNSNIIHHFYCDIIPLFMISCTDPSINFLMVFILSGSIQVFTIVTVLNSYTFALFTILKKKSVRGVRKAFSTCGAHLLSVSLYYGPLIFMYLRPASPQADDQDMIDSVFYTIIIPLLNPIIYSLRNKQVIDSFTKMVKRNV

SEQ ID NO: 3206 - protein, 325 aa, unidentified
MFLYLCFIFQRTCSEEMEEENATLLTEFVLTGFLHQPDCKIPLFLAFLVIYLITIMGNLGLIVLIWKDPHLHIPMYLFLGSLAFVDASLSSTVTPKMLINFLAKSKMISLSECMVQFFSLVTTVTTECFLLATMAYDRYVAICKALLYPVIMTNELCIQLLVLSFIGGLLHALIHEAFSFRLTFCNSNIIQHFYCDIIPLLKISCTDSSINFLMVFIFAGSVQVFTIGTILISYTIILFTILEKKSIKGIRKAVSTCGAHLLSVSLYYGPLTFKYLGSASPQADDQDMMESLFYTVIVPLLNPMIYSLRNKQVIASFTKMFKSNV

SEQ ID NO: 3207 - protein, 314 aa, unidentified
MEFTDRNYTLVTEFILLGFPTRPELQIVLFLMFLTLYAIILIGNIGLMLLIRIDPHLQTPMYFFLSNLSFVDLCYFSDIVPKMLVNFLSENKSISYYGCALQFYFFCTFADTESFILAAMAYDRYVAICNPLLYTVVMSRGICMRLIVLSYLGGNMSSLVHTSFAFILKYCDKNVINHFFCDLPPLLKLSCTDTTINEWLLSTYGSSVEIICFIIIIISYFFILLSVLKIRSFSGRKKTFSTCASHLTSVTIYQGTLLFIYSRPSYLYSPNTDKIISVFYTIFIPVLNPLIYSLRNKDVKDAAEKVLRSKVDSS

SEQ ID NO: 3208 - protein, 312 aa, unidentified
MADDNFTVVTEFILLGLTDHAELKAVLFVVFLVIYAITLLRNLGMILLIQITSKLHTPMYFLLSCLSFVDACYSSAIAPKMLVNLLVVKATISFSACMVQHLCFGVFITTEGFLLSVMAYDRYVAIVSPLLYTVAMSDRKCVELVTGSWIGGIVNTLIHTISLRRLSFCRLNAVSHFFCDIPSLLKLSCSDTSMNELLLLTFSGVIAMATFLTVIISYIFIAFASLRIHSASGRQQAFSTCASHLTAVTIFYGTLIFSYIQPSSQYFVEQEKVVSMFYTLGIPMLNLLIHSLRNKDVKEAVKRAIEMKHFLC

SEQ ID NO: 3209 - protein, 308 aa, unidentified
MAEENHTMKNEFILTGFTDHPELKTLLFVVFFAIYLITVVGNISLVALIFTHRRLHTPMYIFLGNLALVDSCCACAITPKMLENFFSENKRISLYECAVQFYFLCTVETADCFLLAAMAYDRYVAICNPLQYHIMMSKKLCIQMTTGAFIAGNLHSMIHVGLVFRLVFCGSNHINHFYCDILPLYRLSCVDPYINELVLFIFSGSVQVFTIGSVLISYLYILLTIFKMKSKEGRAKAFSTCASHFLSVSLFYGSLFFMYVRPNLLEEGDKDIPAAILFTIVVPLLNPFIYSLRNREVISVLRKILMKK

SEQ ID NO: 3210 - protein, 316 aa, unidentified
MVEENHTMKNEFILTGFTDHPELKTLLFVVFFAIYLITVVGNISLVALIFTHCRLHTPMYIFLGNLALVDSCCACAITPKMLENFFSEGKRISLYECAVQFYFLCTVETADCFLLAAVAYDRYVAICNPLQYHIMMSKKLCIQMTTGAFIAGNLHSMIHVGLVFRLVFCGLNHINHFYCDTLPLYRLSCVDPFINELVLFIFSGSVQVFTIGSVLISYLYILLTIFRMKSKEGRAKAFSTCASHFSSVSLFYGSIFFLYIRPNLLEEGGNDIPAAILFTIVVPLLNPFIYSLRNKEVISVLRKILLKIKSQGSVNK

SEQ ID NO: 3211 - protein, 321 aa, unidentified
MNKENHSLIAEFILTGFTYHPKLKTVLFVVFFAIYLITMVGNIGLVALIYIEQRLHTPMYIFLGNLVLMDSCCSSAITPKMLENFFSEDKRITLYECMAQFYFLCLAETTDCFLLAAMAYDCYVAICNPLQYHTMMSKTLCIQMTAGAYLAGNLHPMIEVEFLLRLTFCGSHQINHFFCDVLPLYRLSCINPYINELVLFILAGSIQIFTIVLVSYFYILFTIFTMKSKEGRGKALSTCASHFLSVSIFCDSLLFMYARPGAVNEGDKDIPVAIFYTLVIPLLNPFIYSLRNKEVINIMKKIMKKRKFCHILKQMSSPLAT

SEQ ID NO: 3212 - protein, 321 aa, unidentified
MARENHSLAAEFILIGFTNYPELKTLLFVVFSAIYLVTMVGNLGLVALIYVERRLLTPMYIFLGNLALMDSCCSCAVTPKMLENFFSEDRIISLYECMAQFYFLCLAETTDCFLLATMAYDRYVAICHPLQYHTMMSKTLCIRMTTGAFKAGNLHSMIHVGLLLRLTFCRSNKIHHFFCDILPLYRLSCTDPSINELMIYIFSIPIQIFTIATVLISYLCILLTVFKMKSKEGRGKAFSTCASHFLSVSIFYICLLMYIGPSEEGDKDTPVAIFYAIVIPLLNPFIYSLRNKEVINVLKKIMRNYNILKQTCSIANLFLIY

SEQ ID NO: 3213 - protein, 311 aa, unidentified
MGKENCTTVAEFILLGLSDVPELRVCLFLLFLLIYGVTLLANLGMTALIQVSSRLHTPVYFFLSHLSFVDFCYSSIIVPKMLANIFNKDKAISFLGCMVQFYLFCTCGVTEVFLLAVMAYDRFVAICNPLLYMVTMSQKLRVELTSCCYFCGTVCSLIHSSLALRILFYRSNVINHFFCDLPPLLSLACSDVTVNETLLFLVATLNESVTIMIILTSYLLILTTILKIHSAESRHKAFSTCASHLTAITVSHGTILYIYCRPSSGNSGDVDKVATVFYTVVIPMLNPLIYSLRNKDVNKALRKVMGSKIHS

SEQ ID NO: 3214 - protein, 315 aa, unidentified
MFSPNHTIVTEFILLGLTDDPVLEKILFGVFLAIYLITLAGNLCMILLIRTNSHLQTPMYFFLGHLSFVDICYSSNVTPNMLHNFLSEQKTISYAGCFTQCLLFIALVITEFYILASMALDRYVAICSPLHYSSRMSKNICVCLVTIPYMYGFLSGFSQSLLTFHLSFCGSLEINHFYCADPPLIMLACSDTRVKKMAMFVVAGFNLSSSLFIILLSYLFIFAAIFRIRSAEGRHKAFSTCASHLTIVTLFYGTLFCMYVRPPSEKSVEESKITAVFYTFLSPMLNPLIYSLRNTDVILAMQQMIRGKSFHKIAV

SEQ ID NO: 3215 - protein, 315 aa, unidentified
MLSPNHTIVTEFILLGLTDDPVLEKILFGVFLAIYLITLAGNLCMILLIRTNSQLQTPMYFFLGHLSFVDICYSSNVTPNMLHNFLSEQKTISYAGCFTQCLLFIALVITEFYFLASMALDRYVAICSPLHYSSRMSKNICISLVTVPYMYGFLNGLSQTLLTFHLSFCGSLEINHFYCADPPLIMLACSDTRVKKMAMFVVAGFTLSSSLFIILLSYLFIFAAIFRIRSAEGRHKAFSTCASHLTIVTLFYGTLFCMYVRPPSEKSVEESKIIAVFYTFLSPMLNPLIYSLRNRDVILAIQQMIRGKSFCKIAV

SEQ ID NO: 3216 - protein, 305 aa, unidentified
MSNTNGSAITEFILLGLTDCPELQSLLFVLFLVVYLVTLLGNLGMIMLMRLDSRLHTPMYFFLTNLAFVDLCYTSNATPQMSTNIVSEKTISFAGCFTQCYIFIALLLTEFYMLAAMAYDRYVAIYDPLRYSVKTSRRVCICLATFPYVYGFSDGLFQAILTFRLTFCRSSVINHFYCADPPLIKLSCSDTYVKEHAMFISAGFNLSSSLTIVLVSYAFILAAILRIKSAEGRHKAFSTCGSHMMAVTLFYGTLFCMYIRPPTDKTVEESKIIAVFYTFVSPVLNPLIYSLRNKDVKQALKNVLR

SEQ ID NO: 3217 - protein, 307 aa, unidentified
MLNFTDVTEFILLGLTSRREWQVLFFIIFLVVYIITMVGNIGMMVLIKVSPQLNNPMYFFLSHLSFVDVWFSSNVTPKMLENLLSDKKTITYAGCLVQCFFFIALVHVEIFILAAMAFDRYMAIGNPLLYGSKMSRVVCIRLITFPYIYGFLTSLAATLWTYGLYFCGKIEINHFYCADPPLIKMACAGTFVKEYTMIILAGINFTYSLTVIIISYLFILIAILRMRSAEGRQKAFSTCGSHLTAVIIFYGTLIFMYLRRPTEESVEQGKMVAVFYTTVIPMLNPMIYSLRNKDVKKAMMKVISRSC

SEQ ID NO: 3218 - protein, 311 aa, unidentified
MRRNCTLVTEFILLGLTSRRELQILLFTLFLAIYMVTVAGNLGMIVLIQANAWLHMPMYFFLSHLSFVDLCFSSNVTPKMLEIFLSEKKSISYPACLVQCYLFIALVHVEIYILAVMAFDRYMAICNPLLYGSRMSKSVCSFLITVPYVYGALTGLMETMWTYNLAFCGPNEINHFYCADPPLIKLACSDTYNKELSMFIVAGWNLSFSLFIICISYLYIFPAILKIRSTEGRQKAFSTCGSHLTAVTIFYATLFFMYLRPPSKESVEQGKMVAVFYTTVIPMLNLIIYSLRNKNVKEALIKELSMKIYFS

SEQ ID NO: 3219 - protein, 310 aa, unidentified
MPNFTDVTEFTLLGLTCRQELQVLFFVVFLAVYMITLLGNIGMIILISISPQLQSPMYFFLSHLSFADVCFSSNVTPKMLENLLSETKTISYVGCLVQCYFFIAVVHVEVYILAVMAFDRYMAGCNPLLYGSKMSRTVCVRLISVPYVYGFSVSLICTLWTYGLYFCGNFEINHFYCADPPLIQIACGRVHIKEITMIVIAGINFTYSLSVVLISYTLIVVAVLRMRSADGRRKAFSTCGSHLTAVSMFYGTPIFMYLRRPTEESVEQGKMVAVFYTTVIPMLNPMIYSLRNKDVKEAVNKAITKTYVRQ

SEQ ID NO: 3220 - protein, 322 aa, unidentified
MNSLKDGNHTALTGFILLGLTDDPILRVILFMIILSGNLSIIILIRISSQLHHPMYFFLSHLAFADMAYSSSVTPNMLVNFLVERNTVSYLGCAIQLGSAAFFATVECVLLAAMAYDRFVAICSPLLYSTKMSTQVSVQLLLVVYIAGFLIAVSYTTSFYFLLFCGPNQVNHFFCDFAPLLELSCSDISVSTVVLSFSSGSIIVVTVCVIAVCYIYILITILKMRSTEGHHKAFSTCTSHLTVVTLFYGTITFIYVMPNFSYSTDQNKVVSVLYTVVIPMLNPLIYSLRNKEIKGALKRELVRKILSHDACYFSRTSNNDIT

SEQ ID NO: 3221 - protein, 311 aa, unidentified
MGTGNDTTVVEFTLLGLSEDTTVCAILFLVFLGIYVVTLMGNISIIVLIRRSHHLHTPMYIFLCHLAFVDIGYSSSVTPVMLMSFLRKETSLPVAGCVAQLCSVVTFGTAECFLLAAMAYDRYVAICSPLLYSTCMSPGVCIILVGMSYLGGCVNAWTFIGCLLRLSFCGPNKVNHFFCDYSPLLKLACSHDFTFEIIPAISSGSIIVATVCVIAISYIYILITILKMHSTKGRHKAFSTCTSHLTAVTLFYGTITFIYVMPKSSYSTDQNKVVSVFYTVVIPMLNPLIYSLRNKEIKGALKRELRIKIFS

SEQ ID NO: 3222 - protein, 326 aa, unidentified
MSGLPSDMDLYKLQLNNFTEVTMFILISFTEEFDVQVFLFLLFLAIYLFTLIGNLGLVVPIIGDFWLHSPMYYFLGVLSFLDVCYSTVVTPKMLVNFLAKNKSISFLGCATQMFLACTFGTTECFLLAAMAYDRYVAIYNPLLYSVSMSPRVYVPLITASYVASILHATIHTVATFSLSFCGSNEIRHVFCNMPPLLAISCSDTHVIQLLFFYFVGSIEIVTILIVLISYGFILLAILKMQSAEGRRKVFSTCGAHLTGVTIYHGTILFMYVRPSSSYTSDNDMIVSIFYTIVIPMLNPIIYSLRNKDVKEAIKRLLVRNWFINKL

SEQ ID NO: 3223 - protein, 359 aa, unidentified
MSYSIYKSTVNIPLSHGVVHSFCHNMNCNFMHIFKFVLDFNMKNVTEVTLFVLKGFTDNLELQTIFFFLFLAIYLFTLMGNLGLILVVIRDSQLHKPMYYFLSMLSSVDACYSSVITPNMLVDFTTKNKVISFLGCVAQVFLACSFGTTECFLLAAMAYDRYVAIYNPLLYSVSMSPRVYMPLINASYVAGILHATIHTVATFSLSFCGANEIRRVFCDIPPLLAISYSDTHTNQLLLFYFVGSIELVTILIVLISYGLILLAILKMYSAEGRRKVFSTCGAHLTGVSIYYGTILFMYVRPSSSYASDHDMIVSIFYTIVIPLLNPVIYSLRNKDVKDSMKKMFGKNQVINKVYFHTKK

SEQ ID NO: 3224 - protein, 340 aa, unidentified
MDSTFTGYNLYNLQVKTEMDKLSSGLDIYRNPLKNKTEVTMFILTGFTDDFELQVFLFLLFFAIYLFTLIGNLGLVVLVIEDSWLHNPMYYFLSVLSFLDACYSTVVTPKMLVNFLAKNKSISFIGCATQMLLFVTFGTTECFLLAAMAYDHYVAIYNPLLYSVSMSPRVYVPLITASYVAGILHATIHIVATFSLSFCGSNEIRHVFCDMPPLLAISCSDTHTNQLLLFYFVGSIEIVTILIVLISCDFILLSILKMHSAKGRQKAFSTCGSHLTGVTIYHGTILVSYMRPSSSYASDHDIIVSIFYTIVIPKLNPIIYSLRNKEVKKAVKKMLKLVYK

SEQ ID NO: 3225 - protein, 321 aa, unidentified
MERKNQTAITEFIILGFSNLNELQFLLFTIFFLTYFCTLGGNILIILTTVTDPHLHTPMYYFLGNLAFIDICYTTSNVPQMMVHLLSKKKSISYVGCVVQLFAFVFFVGSECLLLAAMAYDRYIAICNPLRYSVILSKVLCNQLAASCWAAGFLNSVVHTVLTFCLPFCGNNQINYFFCDIPPLLILSCGNTSVNELALLSTGVFIGWTPFLCIVLSYICIISTILRIQSSEGRRKAFSTCASHLAIVFLFYGSAIFTYVRPISTYSLKKDRLVSVLYSVVTPMLNPIIYTLRNKDIKEAVKTIGSKWQPPISSLDSKLTY

SEQ ID NO: 3226 - protein, 310 aa, unidentified
MDWENCSSLTDFFLLGITNNPEMKVTLFAVFLAVYIINFSANLGMIVLIRMDYQLHTPMYFFLSHLSFCDLCYSTATGPKMLVDLLAKNKSIPFYGCALQFLVFCIFADSECLLLSVMAFDRYKAIINPLLYTVNMSSRVCYLLLTGVYLVGIADALIHMTLAFRLCFCGSNEINHFFCDIPPLLLLSRSDTQVNELVLFTVFGFIELSTISGVFISYCYIILSVLEIHSAEGRFKALSTCTSHLSAVAIFQGTLLFMYFRPSSSYSLDQDKMTSLFYTLVVPMLNPLIYSLRNKDVKEALKKLKNKILF

SEQ ID NO: 3227 - protein, 327 aa, unidentified
MEWRNHSGRVSEFVLLGFPAPAPLQVLLFALLLLAYVLVLTENTLIIMAIRNHSTLHKPMYFFLANMSFLEIWYVTVTIPKMLAGFVGSKQDHGQLISFEGCMTQLYFFLGLGCTECVLLAVMAYDRYMAICYPLHYPVIVSGRLCVQMAAGSWAGGFGISMVKVFLISGLSYCGPNIINHFFCDVSPLLNLSCTDMSTAELTDFILAIFILLGPLSVTGASYVAITGAVMHIPSAAGRYKAFSTCASHLTVVIIFYAASIFIYARPKALSAFDTNKLVSVLYAVIVPLLNPIIYCLRNQEVKRALCCTLHLYQHQDPDPKKASRNV

SEQ ID NO: 3228 - protein, 311 aa, unidentified
MELENQTRVTKFILVGFPGSLSMRAAMFLIFLVAYILTVAENVIIILLVLQNRPLHKPMYFFLANLSFLETWYISVTVPKLLFSFWSVNNSISFTLCMIQLYFFIALMCTECVLLAAMAYDRYVAICRPLHYPTIMSHGLCFRLALGSWAIGFGISLAKIYFISCLSFCGPNVINHFFCDISPVLNLSCTDMSITELVDFILALVIFLFPLFITVLSYGCILATILCMPTGKQKAFSTCASHLVVVTIFYSAIIFMYARPRVIHAFNMNKIISIFYAIVTPSLNPFIYCLRNREVKEALKKLAYCQASRSD

SEQ ID NO: 3229 - protein, 312 aa, unidentified
MSGENVTKVSTFILVGLPTAPGLQYLLFLLFLLTYLFVLVENLAIILIVWSSTSLHRPMYYFLSSMSFLEIWYVSDITPKMLEGFLLQQKRISFVGCMTQLYFFSSLVCTECVLLASMAYDRYVAICHPLRYHVLVTPGLCLQLVGFSFVSGFTISMIKVCFISSVTFCGSNVLNHFFCDISPILKLACTDFSTAELVDFILAFIILVFPLLATILSYWHITLAVLRIPSATGCWRAFSTCASHLTVVTVFYTALLFMYVRPQAIDSQSSNKLISAVYTVVTPIINPLIYCLRNKEFKDALKKALGLGQTSH

SEQ ID NO: 3230 - protein, 331 aa, unidentified
MSGENVTRVGTFILVGFPTAPGLQYLLFLLFLLTYLFVLVENLAIILTVWSSTSLHRPMYYFLSSMSFLEIWYVSDITPKMLEGFLLQQKRISFVGCMTQLYFFSSLVCTECVLLASMAYDRYVAICHPLRYHVLVTPGLCLQLVGFSFVSGFTISMIKVCFISSVTFCGSNVLNHFFCDISPILKLACTDFSTAELVDFILAFIILVFPLLATMLSYAHITLAVLRIPSATGCWRAFFTCASHLTVVTVFYTALLFMYVRPQAIDSRSSNKLISVLYTVITPILNPLIYCLRNKEFKNALKKAFGLTSCAVEGRLSSLLELHLQIHSQPL

SEQ ID NO: 3231 - protein, 312 aa, unidentified
MRNHTEITEFILLGLTDDPNFQVVIFVFLLITYMLSITGNLTLITITLLDSHLQTPMYFFLRNFSILEISFTTVSIPKFLGNIISGDKTISFNNCIVQLFFFILLGVTEFYLLAAMSYDRYVAICKPLHCLSIMNRRVCTLLVFTSWLVSFLIIFPALMLLLKLHYCRSNIIDHFTCDYFPLLQLACSDTKFLEVMGFSCAAFTLMFTLALIFLSYIYIIRTILRIPSTSQRTKAFSTCSSHMVVVSISYGSCIFMYIKPSAKDRVSLSKGVAILNTSVAPMMNPFIYSLRNQQVKQAFINMARKTVFFTST

SEQ ID NO: 3232 - protein, 312 aa, unidentified
MKNHTVIRTFILLGLTGDPHLQVLLFIFLFLTYMLSVTGNLTIITLTLVDHHLKTPMYFFLRNFSFLEVSFTTVCIPRFLYNISMGDNTITYNACASQIFFVILFGATEFFLLAAMSYDRYVAICKPLHYVVIMNNRVCTLLVLCCWVAGLMIIVPPLSLGLQLEFCDSNAIDHFSCDAGPLLKISCSDTWVIEQMVILMAVFALIITLVCVILSYLYIVRTILKFPSVQQRKKAFSTCSSHMIVVSIAYGSCIFIYIKPSAKDEVAINKGVSVLTTSVAPLLNPFIYTLRNKQVKQAFSDSIKRIAFLSKK

SEQ ID NO: 3233 - protein, 311 aa, unidentified
MNHTMVTEFVLLGLSDDPDLQIVIFLFLFITYILSVTGNLTIITLTFVDSHLQTPMYFFLRNFSFLEISFTTVCIPRFLGAIITRNKTISYNNCAAQLFFFIFMGVTEFYILTAMSYDRYVAICKPLHYTSIMNRKLCTLLVLCAWLSGFLTIFPPLMLLLQLDYCASNVIDHFACDYFPLLQLSCSDTWLLEVIGFYFALVTLLFTLALVILSYMYIIRTILRIPSASQRKKAFSTCSSHMIVISISYGSCIFMYANPSAKEKASLTKGIAILNTSVAPMLNPFIYTLRNQQVKQAFKNVVHKVVFYANQ

SEQ ID NO: 3234 - protein, 309 aa, unidentified
MKNRTMFGEFILLGLTNQPELQVMIFIFLFLTYMLSILGNLTIITLTLLDPHLQTPMYFFLRNFSFLEISFTSIFIPRFLTSMTTGNKVISFAGCLTQYFFAIFLGATEFYLLASMSYDRYVAICKPLHYLTIMSSRVCIQLVFCSWLGGFLAILPPIILMTQVDFCVSNILNHYYCDYGPLVELACSDTSLLELMVILLAVVTLMVTLVLVTLSYTYIIRTILRIPSAQQRTKAFSTCSSHMIVISLSYGSCMFMYINPSAKEGGAFNKGIAVLITSVTPLLNPFIYTLRNQQVKQAFKDSVKKIVKL

SEQ ID NO: 3235 - protein, 314 aa, unidentified
MKNKSMEIEFILLGLTDDPQLQIVIFLFLFLNYTLSLMGNLIIIILTLLDPRLKTPMYFFLRNFSFLEVIFTTVCIPRFLITIVTRDKTISYNNCATQLFFILLPGVTEFYLLAAMSYDRYVAICKPLHYPIIMSSKVCYQLVLSSWVTGFLIIFPPLVMGLKLDFCASKTIDHFMCETSPILQISCTDTHVLELMSFTLAVVTLVVTLVLVILSYTCIIKTILKFSSAQQRNKAFSTCTSHMIVVSMTYGSCIFMYIKPSAKERVTVSKGVALLYTSIAPLLNPFIYTLRNQQVKEVFWDVLQKNLCFSKRPF

SEQ ID NO: 3236 - protein, 312 aa, unidentified
MPNMTSIREFILLGFTDNPELQVVIFFFMLITYLLSVSGNMIIIMLTLSNIHLKTPMYFFLRNFSFLEISFTTVFIPRFLINIATGDTTISYNASMAQVFFLILLGSTEFFLLAVMSYDRYVAICKPLHYTTIMSNKVCNWLVISSWLAGFLIIFPPVIMGLQLDFCDSSTIDHFICDSSPMLLIACTDTQFLELMAFLLAVFTLMVTLALVVLSYTLILKTILKIPSAQQRKKAFSTCSSHMIVVSVSYGSCIFMCVKTSAKEGMALSKGVAVLNTSVAPMLNPFIYTLRNQQVKQALREFTKKILSLNKQ

SEQ ID NO: 3237 - protein, 312 aa, unidentified
MRKHTAITTFILLGLTEDPQLQVLLFMFLFITYMLSVTGKLTIIALTMLDPHLKTPMYFFLQNLSFLEISFTATCVPRFLYSISTGNKIITYNACVIQLFFADLFGVTEFFLLATMSYDRYVAICKPLHYMAIMSNKVCKTMVICCWMAALMIILPPLSLGFHLEFCDSNVINHFGCDALPILKIPCSDTSLIEQMVVASAVLTFIITLVCVVLSYTYIIRTILKFPSVQQKKKAFSTCSSHITVVSITYGSCIFIYIKPSAKEEVNINKGVSVLISSISPMLNSFIYTLRNEQVKQAFHDSLKKIAFRLKK

SEQ ID NO: 3238 - protein, 312 aa, unidentified
MKNHTRQIEFILLGLTDNSQLQIVIFLFLLLNCVLSMIGNFTIIALILLDSQLKTPMYFFLRNFSFLEISFTTACIPRFLITIVTREKTISCNGCISQLFFYIFLGVTEFFLLAALSYDRYVAICKPLRYMSIMSNKVCYQLVFSSWVTGFLIIFTPLILGLNLDFCASNIIDHFICDISLILQLSCSDTHLLELIAFLLAVMTLIVTLFLVILSYSYIIKTILKFPSAQQKKKAFSTCSSHMIVVSITYGSCMFIYIKPSANERVALSKGVTVLNTSVAPLLNPFIYTLRNQQVKQAFKAVFRKIFSASDK

SEQ ID NO: 3239 - protein, 312 aa, unidentified
MRNHTTVANFILLGLTDDPQLQVIIFLLLFFTYMLSITGNLTIITLTLLDLHLKTPMYFFLRNFSFLEVSFTTVYIPKFLVSMATGDKTISYNDCAAQLFFTILLGATEFFLLAAMSYERYVAICKPLHYTTIMSSRVCSLLVFASWMAGFLIIFPPLLMGLQLDFCAANTVDHFFCDVSPILQLSCTDTDIIELMMLLSAILTLLVTLVLVILSYTNIIRTILKIPSSQQRKKAFSTCSSHMVVVSISYGSCIFMYVKPSAKERVSLNKGIALLSTSVAPMLNPFIYTLRNKQVKDVFKHTVKKIELFSMK

SEQ ID NO: 3240 - protein, 312 aa, unidentified
MRNSTAVTDFILLGLTSDPQWQVVLFIFLLVTYMLSVTGNLIIITLTLSDPHLQTPMYFFLRNFSFLEISFTSVCIPRFLVTVVTGNRTISYNGCVAQLFFFIFLGVTEFYLLAAMSYDRCMAICKPLHYTIIMSTRVCTLLVFSSWLAGFLIIFPPVMLLLQLDFCASNVIDHFICDSSPMLQLSCTNTHFLELMAFFLAVVTLMVTLTLVILSYTNIIRTILKIPSMSQRKKAFSTCSSHMIVVSISYSSCIFMYIKTSARERVTLSKGVAVLNTSVAPLLNPFIYTLRNKQVKQAFKSMVQKMIFSLNK

SEQ ID NO: 3241 - protein, 312 aa, unidentified
MKNRTSVTDFILLGLTDNPQLQVVIFSFLFLTYVLSVTGNLTIISLTLLDSHLKTPMYFFLRNFSLEISFTSVCNPRFLISILTGDKSISYNACAAQLFFFIFLGSTEFFLLASMSYDCYVAICKPLHYTTIMSDRICYQLIISSWLAGFLVIFPPLAMGLQLDFCDSNVIDHFTCDSAPLLQISCTDTSTLELMSFILALFTLISTLILVILSYTYIIRTILRIPSAQQRKKAFSTCSSHVIVVSISYGSCIFMYVKTSAKEGVALTKGVAILNTSVAPMLNPFIYTLRNQQVKQAFKDVLRKISHKKKKH

SEQ ID NO: 3242 - protein, 308 aa, unidentified
MDTGNKTLPQDFLLLGFPGSQTLQLSLFMLFLVMYILTVSGNVAILMLVSTSHQLHTPMYFFLSNLSFLEIWYTTAAVPKALAILLGRSQTISFTSCLLQMYFVFSLGCTEYFLLAAMAYDRCLAICYPLHYGAIMSSLLSAQLALGSWVCGFVAIAVPTALISGLSFCGPRAINHFFCDIAPWIALACTNTQAVELVAFVIAVVVILSSCLITFVSYVYIISTILRIPSASGRSKAFSTCSSHLTVVLIWYGSTVFLHVRTSIKDALDLIKAVHVLNTVVTPVLNPFIYTLRNKEVRETLLKKWKGK

SEQ ID NO: 3243 - protein, 324 aa, unidentified
MESPNRTTIQEFIFSAFPYSWVKSVVCFVPLLFIYAFIVVGNLVIITVVQLNTHLHTPMYTFISALSFLEIWYTTATIPKMLSSLLSERSISFNGCLLQMYFFHSTGICEVCLLTVMAFDHYLAICSPLHYPSIMTPKLCTQLTLSCCVCGFITPLPEIAWISTLPFCGSNHLEHIFCDFLPVLRLACTDTRAIVMIQVVDVIHAVEIITAVMLIFMSYDGIVAVILRIHSAGGRRTAFSTCVSHFIVFSLFFGSVTLMYLRFSATYSLFWDIAIALAFAVLSPFFNPIIYSLRNKEIKEAIKKHIGQAKIFFSVRPGTSSKIF

SEQ ID NO: 3244 - protein, 331 aa, unidentified
MCWTMPSPFTGSSTRNMESGNQSTVTEFIFTGFPQLQDGSLLYFFPLLFIYTFIIIDNLLIFSAVRLDTHLHNPMYNFISIFSFLEIWYTTATIPKMLSNLISEKKAISMTGCILQMYFFHSLENSEGILLTTMAIDRYVAICNPLRYQMIMTPRLCAQLSAGSCLFGFLILLPEIVMISTLPFCGPNQIHQIFCDLVPVLSLACTDTSMILIEDVIHAVTIIITFLIIALSYVRIVTVILRIPSSEGRQKAFSTCAGHLMVFPIFFGSVSLMYLRFSDTYPPVLDTAIALMFTVLAPFFNPIIYSLRNKDMNNAIKKLFCLQKVLNKPGG

SEQ ID NO: 3245 - protein, 343 aa, unidentified
MKQYSVGNQHSNYRSLLFPFLCSQMTQLTASGNQTMVTEFLFSMFPHAHRGGLLFFIPLLLIYGFILTGNLIMFIVIQVGMALHTPLYFFISVLSFLEICYTTTTIPKMLSCLISEQKSISVAGCLLQMYFFHSLGITESCVLTAMAIDRYIAICNPLRYPTIMIPKLCIQLTVGSCFCGFLLVLPEIAWISTLPFCGSNQIHQIFCDFTPVLSLACTDTFLVVIVDAIHAAEIVASFLVIALSYIRIIIVILGMHSAEGHHKAFSTCAAHLAVFLLFFGSVAVMYLRFSATYSVFWDTAIAVTFVILAPFFNPIIYSLKNKDMKEAIGRLFHYQKRAGWAGK

SEQ ID NO: 3246 - protein, 313 aa, unidentified
MGNWSTVTEITLIAFPALLEIRISLFVVLVVTYTLTATGNITIISLIWIDHRLQTPMYFFLSNLSFLDILYTTVITPKLLACLLGEEKTISFAGCMIQTYFYFFLGTVEFILLAVMSFDRYMAICDPLHYTVIMNSRACLLLVLGCWVGAFLSVLFPTIVVTRLPYCRKEINHFFCDIAPLLQVACINTHLIEKINFLLSALVILSSLAFTTGSYVYIISTILRIPSTQGRQKAFSTCASHITVVSIAHGSNIFVYVRPNQNSSLDYDKVAAVLITVVTPLLNPFIYSLRNEKVQEVLRETVNRIMTLIQRKT

SEQ ID NO: 3247 - protein, 312 aa, unidentified
MDTGNWSQVAEFIILGFPHLQGVQIYLFLLLLLIYLMTVLGNLLIFLVVCLDSRLHTPMYHFVSILSFSELGYTAATIPKMLANLLSEKKTISFSGCLLQIYFFHSLGATECYLLTAMAYDRYLAICRPLHYPTLMTPTLCAEIAIGCWLGGLAGPVVEISLISRLPFCGPNRIQHVFCDFPPVLSLACTDTSINVLVDFVINSCKILATFLLILCSYVQIICTVLRIPSAAGKRKAISTCASHFTVVLIFYGSILSMYVQLKKSYSLDYDQALAVVYSVLTPFLNPFIYSLRNKEIKEAVRRQLKRIGILA

SEQ ID NO: 3248 - protein, 317 aa, unidentified
MDQYNHSSLAEFVFLGFASVGYVRGWLFVLLLLAYLFTICGNMLIFSVIRLDAALHTPMYHFVSVLSFLELWYTATTIPKMLSNILSEKKTISFAGCLLQTYFFHSLGASECYLLTAMAYDRYLAICRPLHYPIIMTTTLCAKMAAACWTCGFLCPISEVILASQLPFCAYNEIQHIFCDFPPLLSLACKDTSANILVDFAINAFIILITFFFIMISYARIIGAVLKIKTASGRKKAFSTCASHLAVVLIFFGSIIFMYVRLKKSYSLTLDRTLAIVYSVLTPMVNPIIYSLRNKEIIKAIKRTIFQKGDKASLAHL

SEQ ID NO: 3249 - protein, 317 aa, unidentified
MRNLSGGHVEEFVLVGFPTTPPLQLLLFVLFFAIYLLTLLENALIVFTIWLAPSLHRPMYFFLGHLSFLELWYINVTIPRLLAAFLTQDGRVSYVGCMTQLYFFIALACTECVLLAVMAYDRYLAICGPLLYPSLMPSSLATRLAAASWGSGFFSSMMKLLFISQLSYCGPNIINHFFCDISPLLNLTCSDKEQAELVDFLLALVMILLPLLAVVSSYTAIIAAILRIPTSRGRHKAFSTCAAHLAVVVIYYSSTLFTYARPRAMYTFNHNKIISVLYTIIVPFFNPAIYCLRNKEVKEAFRKTVMGRCHYPRDVQD

SEQ ID NO: 3250 - protein, 331 aa, unidentified
MSPDGNHSSDPTEFVLAGLPNLNSARVELFSVFLLVYLLNLTGNVLIVGVVRADTRLQTPMYFFLGNLSCLEILLTSVIIPKMLSNFLSRQHTISFAACITQFYFYFFLGASEFLLLAVMSADRYLAICHPLRYPLLMSGAVCFRVALACWVGGLVPVLGPTVAVALLPFCKQGAVVQHFFCDSGPLLRLACTNTKKLEETDFVLASLVIVSSLLITAVSYGLIVLAVLSIPSASGRQKAFSTCTSHLIVVTLFYGSAIFLYVRPSQSGSVDTNWAVTVITTFVTPLLNPFIYALRNEQVKEALKDMFRKVVAGVLGNLLLDKCLSEKAVK

SEQ ID NO: 3251 - protein, 323 aa, unidentified
MNPENWTQVTSFVLLGFPSSHLIQFLVFLGLMVTYIVTATGKLLIIVLSWIDQRLHIQMYFFLRNFSFLELLLVTVVVPKMLVVILTGDHTISFVSCIIQSYLYFFLGTTDFFLLAVMSLDRYLAICRPLRYETLMNGHVCSQLVLASWLAGFLWVLCPTVLMASLPFCGPNGIDHFFRDSWPLLRLSCGDTHLLKLVAFMLSTLVLLGSLALTSVSYACILATVLRAPTAAERRKAFSTCASHLTVVVIIYGSSIFLYIRMSEAQSKLLNKGASVLSCIITPLLNPFIFTLRNDKVQQALREALGWPRLTAVMKLRVTSQRK

SEQ ID NO: 3252 - protein, 313 aa, unidentified
MANLSQPSEFVLLGFSSFGELQALLYGPFLMLYLLAFMGNTIIIVMVIADTHLHTPMYFFLGNFSLLEILVTMTAVPRMLSDLLVPHKVITFTGCMVQFYFHFSLGSTSFLILTDMALDRFVAICHPLRYGTLMSRAMCVQLAGAAWAAPFLAMVPTVLSRAHLDYCHGDVINHFFCDNEPLLQLSCSDTRLLEFWDFLMALTFVLSSFLVTLISYGYIVTTVLRIPSASSCQKAFSTCGSHLTLVFIGYSSTIFLYVRPGKAHSVQVRKVVALVTSVLTPFLNPFILTFCNQTVKTVLQGQMQRLKGLCKAQ

SEQ ID NO: 3253 - protein, 312 aa, unidentified
MRNGTVITEFILLGFPVIQGLQTPLFIAIFLTYILTLAGNGLIIATVWAEPRLQIPMYFFLCNLSFLEIWYTTTVIPKLLGTFVVARTVICMSCCLLQAFFHFFVGTTEFLILTIMSFDRYLTICNPLHHPTIMTSKLCLQLALSSWVVGFTIVFCQTMLLIQLPFCGNNVISHFYCDVGPSLKAACIDTSILELLGVIATILVIPGSLLFNMISYIYILSAILRIPSATGHQKTFSTCASHLTVVSLLYGAVLFMYLRPTAHSSFKINKVVSVLNTILTPLLNPFIYTIRNKEVKGALRKAMTCPKTGHAK

SEQ ID NO: 3254 - protein, 325 aa, unidentified
MTTIILEVDNHTVTTRFILLGFPTRPAFQLLFFSIFLATYLLTLLENLLIILAIHSDGQLHKPMYFFLSHLSFLEMWYVTVISPKMLVDFLSHDKSISFNGCMTQLYFFVTFVCTEYILLAIMAFDRYVAICNPLRYPVIMTNQLCGTLAGGCWFCGLMTAMIKMVFIAQLHYCGMPQINHYFCDISPLLNVSCEDASQAEMVDFFLALMVIAIPLCVVVASYAAILATILRIPSAQGRQKAFSTCASHLTVVILFYSMTLFTYARPKLMYAYNSNKVVSVLYTVIVPLLNPIIYCLRNHEVKAALRKTIHCRGSGPQGNGAFSS

SEQ ID NO: 3255 - protein, 309 aa, unidentified
MKSWNNTIILEFLLLGISEEPELQAFLFGLFLSMYLVTVLGNLLIILATISDSHLHTPMYFFLSNLSFVDICFVSTTVPKMLVNIQTHNKVITYAGCITQMCFFLLFVGLDNFLLTVMAYDRFVAICHPLHYMVIMNPQLCGLLVLASWIMSVLNSMLQSLMVLPLPFCTHMEIPHFFCEINQVVHLACSDTFLNDIVMYFAVALLGGGPLTGILYSYSKIVSSIRAISSAQGKYKAFSTCASHLSVVSLFYGTCLGVYLSSAATHNSHTGAAASVMYTVVTPMLNPFIYSLRNKHIKGAMKTFFRGKQ

SEQ ID NO: 3256 - protein, 309 aa, unidentified
MEPENDTGISEFVLLGLSEEPELQPFLFGLFLSMYLVTVLGNLLIILATISDSHLHTPMYFFLSNLSFADICFISTTIPKMLINIQTQSRVITYAGCITQMCFFVLFGGLDSLLLAVMAYDRFVAICHPLHYTVIMNPRLCGLLVLASWMIAALNSLSQSLMVLWLSFCTDLEIPHFFCELNQVIHLACSDTFLNDMGMYFAAGLLAGGPLVGILCSYSKIVSSIRAISSAQGKYKAFSTCASHLSVVSLFCCTGLGVYLTSAATHNSHTSATASVMYTVATPMLNPFIYSLRNKDIKRALKMSFRGKQ

SEQ ID NO: 3257 - protein, 319 aa, unidentified
MEPGNDTQISEFLLLGFSQEPGLQPFLFGLFLSMYLVTVLGNLLIILATISDSHLHTPMYFFLSNLSFADICVTSTTIPKMLMNIQTQNKVITYIACLMQMYFFILFAGFENFLLSVMAYDRFVAICHPLHYMVIMNPHLCGLLVLASWTMSALYSLLQILMVVRLSFCTALEIPHFFCELNQVIQLACSDSFLNHMVIYFTVALLGGGPLTGILYSYSKIISSIHAISSAQGKYKAFSTCASHLSVVSLFYGAILGVYLSSAATRNSHSSATASVMYTVVTPMLNPFIYSLRNKDIKRALGIHLLWGTMKGQFFKKCP

SEQ ID NO: 3258 - protein, 320 aa, unidentified
METGNQTHAQEFLLLGFSATSEIQFILFGLFLSMYLVTFTGNLLIILAICSDSHLHTPMYFFLSNLSFADLCFTSTTVPKMLLNILTQNKFITYAGCLSQIFFFTSFGCLDNLLLTVMAYDRFVAVCHPLHYTVIMNPQLCGLLVLGSWCISVMGSLLETLTVLRLSFCTEMEIPHFFCDLLEVLKLACSDTFINNVVIYFATGVLGVISFTGIFFSYYKIVFSILRISSAGRKHKAFSTCGSHLSVVTLFYGTGFGVYLSSAATPSSRTSLVASVMYTMVTPMLNPFIYSLRNTDMKRALGRLLSRATFFNGDITAGLS

SEQ ID NO: 3259 - protein, 319 aa, unidentified
MERGNQTEVGNFLLLGFAEDSDMQLLLHGLFLSMYLVTIIGNLLIILTISSDSHLHTPMYFFLSNLSFADICFTSTTVPKMLVNIQTQSKMITFAGCLTQIFFFIAFGCLDNLLLTMTAYDRFVAICYPLHYTVIMNPRLCGLLVLGSWCISVMGSLLETLTILRLSFCTNMEIPHFFCDPSEVLKLACSDTFINNIVMYFVTIVLGVFPLCGILFSYSQIFSSVLRVSARGQHKAFSTCGSHLSVVSLFYGTGLGVYLSSAVTPPSRTSLAASVMYTMVTPMLNPFIYSLRNKDMKGSLGRLLLRATSLKEGTIAKLS

SEQ ID NO: 3260 - protein, 312 aa, unidentified
MEAGNQTGFLEFILLGLSEDPELQPFIFGLFLSMYLVTVLGNLLIILAISSDSHLHTPMYFFLSNLSWVDICFSTCIVPKMLVNIQTENKAISYMDCLTQVYFSMFFPILDTLLLTVMAYDRFVAVCHPLHYMIIMNPHLCGLLVFVTWLIGVMTSLLHISLMMHLIFCKDFEIPHFFCELTYILQLACSDTFLNSTLIYFMTGVLGVFPLLGIIFSYSRIASSIRKMSSSGGKQKALSTCGSHLSVVSLFYGTGIGVHFTSAVTHSSQKISVASVMYTVVTPMLNPFIYSLRNKDVKGALGSLLSRAASCL

SEQ ID NO: 3261 - protein, 312 aa, unidentified
MEAENLTELSKFLLLGLSDDPELQPVLFGLFLSMYLVTVLGNLLIILAVSSDSHLHTPMYFFLSNLSFVDICFISTTVPKMLVSIQARSKDISYMGCLTQVYFLMMFAGMDTFLLAVMAYDRFVAICHPLHYTVIMNPCLCGLLVLASWFIIFWFSLVHILLMKRLTFSTGTEIPHFFCEPAQVLKVACSNTLLNNIVLYVATALLGVFPVAGILFSYSQIVSSLMGMSSTKGKYKAFSTCGSHLCVVSLFYGTGLGVYLSSAVTHSSQSSSTASVMYAMVTPMLNPFIYSLRNKDVKGALERLLSRADSCP

SEQ ID NO: 3262 - protein, 339 aa, unidentified
MSYFPILFFFFLKRCPSYTEPQNLTGVSEFLLLGLSEDPELQPVLAGLFLSMYLVTVLGNLLIILAVSSDSHLHTPMYFFLSNLSLADIGFTSTTVPKMIVDMQTHSRVISYEGCLTQMSFFVLFACMDDMLLSVMAYDRFVAICHPLHYRIIMNPRLCGFLILLSFFISLLDSQLHNLIMLQLTCFKDVDISNFFCDPSQLLHLRCSDTFINEMVIYFMGAIFGCLPISGILFSYYKIVSPILRVPTSDGKYKAFSTCGSHLAVVCLFYGTGLVGYLSSAVLPSPRKSMVASVMYTVVTPMLNPFIYSLRNKDIQSALCRLHGRIIKSHHLHPFCYMG

SEQ ID NO: 3263 - protein, 311 aa, unidentified
MGPRNQTAVSEFLLMKVTEDPELKLIPFSLFLSMYLVTILGNLLILLAVISDSHLHTPMYFLLFNLSFTDICLTTTTVPKILVNIQAQNQSITYTGCLTQICLVLVFAGLESCFLAVMAYDRYVAICHPLRYTVLMNVHFWGLLILLSMFMSTMDALVQSLMVLQLSFCKNVEIPLFFCEVVQVIKLACSDTLINNILIYFASSVFGAIPLSGIIFSYSQIVTSVLRMPSARGKYKAFSTCGCHLSVFSLFYGTAFGVYISSAVAESSRITAVASVMYTVVPQMMNPFIYSLRNKEMKKALRKLIGRLFPF

SEQ ID NO: 3264 - protein, 324 aa, unidentified
MEARNQTAISKFLLLGLIEDPELQPVLFSLFLSMYLVTILGNLLILLAVISDSHLHTPMYFFLSNLSFLDICLSTTTIPKMLVNIQAQNRSITYSGCLTQICFVLFFAGLENCLLAAMAYDRYVAICHPLRYTVIMNPRLCGLLILLSLLTSVVNALLLSLMVLRLSFCTDLEIPLFFCELAQVIQLTCSDTLINNILIYFAACIFGGVPLSGIILSYTQITSCVLRMPSASGKHKAVSTCGSHLSIVLLFYGAGLGVYISSVVTDSPRKTAVASVMYSVFPQMVNPFIYSLRNKDMKGTLRKFIGRIPSLLWCAICFGFRFLE

SEQ ID NO: 3265 - protein, 312 aa, unidentified
MKAGNFSDTPEFFLLGLSGDPELQPILFMLFLSMYLATMLGNLLIILAVNSDSHLHTPMYFLLSILSLVDICFTSTTMPKMLVNIQAQAQSINYTGCLTQICFVLVFVGLENGILVMMAYDRFVAICHPLRYNVIMNPKLCGLLLLLSFIVSVLDALLHTLMVLQLTFCIDLEIPHFFCELAHILKLACSDVLINNILVYLVTSLLGVVPLSGIIFSYTRIVSSVMKIPSAGGKYKAFSICGSHLIVVSLFYGTGFGVYLSSGATHSSRKGAIASVMYTVVTPMLNPLIYSLRNKDMLKALRKLISRIPSFH

SEQ ID NO: 3266 - protein, 326 aa, unidentified
MGFLSPMHPCRPPTQRRMAAGNHSTVTEFILKGLTKRADLQLPLFLLFLGIYLVTIVGNLGMITLICLNSQLHTPMYYFLSNLSLMDLCYSSVITPKMLVNFVSEKNIISYAGCMSQLYFFLVFVIAECYMLTVMAYDRYVAICHPLLYNIIMSHHTCLLLVAVVYAIGLIGSTIETGLMLKLPYCEHLISHYFCDILPLMKLSCSSTYDVEMTVFFSAGFNIIVTSLTVLVSYTFILSSILGISTTEGRSKAFSTCSSHLAAVGMFYGSTAFMYLKPSTISSLTQENVASVFYTTVIPMLNPLIYSLRNKEVKAAVQKTLRGKLF

SEQ ID NO: 3267 - protein, 310 aa, unidentified
MAAKNSSVTEFILEGLTHQPGLRIPLFFLFLGFYTVTVVGNLGLITLIGLNSHLHTPMYFFLFNLSLIDFCFSTTITPKMLMSFVSRKNIISFTGCMTQLFFFCFFVVSESFILSAMAYDRYVAICNPLLYTVTMSCQVCLLLLLGAYGMGFAGAMAHTGSIMNLTFCADNLVNHFMCDILPLLELSCNSSYMNELVVFIVVAVDVGMPIVTVFISYALILSSILHNSSTEGRSKAFSTCSSHIIVVSLFFGSGAFMYLKPLSILPLEQGKVSSLFYTIIVPVLNPLIYSLRNKDVKVALRRTLGRKIFS

SEQ ID NO: 3268 - protein, 313 aa, unidentified
MLARNNSLVTEFILAGLTDHPEFRQPLFFLFLVIYIVTMVGNLGLITLFGLNSHLHTPMYYFLFNLSFIDLCYSSVFTPKMLMNFVSKKNIISNVGCMTRLFFFLFFVISECYMLTSMAYDRYVAICNPLLYKVTMSHQVCSMLTFAAYIMGLAGATAHTGCMLRLTFCSANIINHYLCDILPLLQLSCTSTYVNEVVVLIVVGTNITVPSCTILISYVFIVTSILHIKSTQGRSKAFSTCSSHVIALSLFFGSAAFMYIKYSSGSMEQGKVSSVFYTNVVPMLNPLIYSLRNKDVKVALRKALIKIQRRNIF

SEQ ID NO: 3269 - protein, 313 aa, unidentified
MLARNNSLVTEFILAGLTDHPEFQQPLFFLFLVVYIVTMVGNLGLIILFGLNSHLHTPMYYFLFNLSFIDLCYSSVFTPKMLMNFVSKKNIISYVGCMTQLFFFLFFVISECYMLTSMAYDRYVAICNPLLYKVTMSHQVCSMLTFAAYIMGLAGATAHTGCMLRLTFCSANIINHYLCDILPLLQLSCTSTYVNEVVVLIVVGINIMVPSCTILISYVFIVTSILHIKSTQGRSKAFSTCSSHVIALSLFFGSAAFMYIKYSSGSMEQGKVSSVFYTNVVPMLNPLIYSLRNKDVKVALRKALIKIQRRNIF

SEQ ID NO: 3270 - protein, 311 aa, unidentified
MAAENSSFVTQFILAGLTDQPGVQIPLFFLFLGFYVVTVVGNLGLITLIRLNSHLHTPMYFFLYNLSFIDFCYSSVITPKMLMSFVLKKNSISYAGCMTQLFFFLFFVVSESFILSAMAYDRYVAICNPLLYMVTMSPQVCFLLLLGVYGMGFAGAMAHTACMMGVTFCANNLVNHYMCDILPLLECACTSTYVNELVVFVVVGIDIGVPTVTIFISYALILSSIFHIDSTEGRSKAFSTCSSHIIAVSLFFGSGAFMYLKPFSLLAMNQGKVSSLFYTTVVPMLNPLIYSLRNKDVKVALKKILNKNAFS

SEQ ID NO: 3271 - protein, 308 aa, unidentified
MTMENYSMAAQFVLDGLTQQAELQLPLFLLFLGIYVVTVVGNLGMILLIAVSPLLHTPMYYFLSSLSFVDFCYSSVITPKMLVNFLGKKNTILYSECMVQLFFFVVFVVAEGYLLTAMAYDRYVAICSPLLYNAIMSSWVCSLLVLAAFFLGFLSALTHTSAMMKLSFCKSHIINHYFCDVLPLLNLSCSNTHLNELLLFIIAGFNTLVPTLAVAVSYAFILYSILHIRSSEGRSKAFGTCSSHLMAVVIFFGSITFMYFKPPSSNSLDQEKVSSVFYTTVIPMLNPLIYSLRNKDVKKALRKVLVGK

SEQ ID NO: 3272 - protein, 314 aa, unidentified
MGVKNHSTVTEFLLSGLTEQAELQLPLFCLFLGIYTVTVVGNLSMISIIRLNRQLHTPMYYFLSSLSFLDFCYSSVITPKMLSGFLCRDRSISYSGCMIQLFFFCVCVISECYMLAAMACDRYVAICSPLLYRVIMSPRVCSLLVAAVFSVGFTDAVIHGGCILRLSFCGSNIIKHYFCDIVPLIKLSCSSTYIDELLIFVIGGFNMVATSLTIIISYAFILTSILRIHSKKGRCKAFSTCSSHLTAVLMFYGSLMSMYLKPASSSSLTQEKVSSVFYTTVILMLNPLIYSLRNNEVRNALMKLLRRKISLSPG

SEQ ID NO: 3273 - protein, 311 aa, unidentified
MGRRNNTNVPDFILTGLSDSEEVQMALFILFLLIYLITMLGNVGMILIIRLDLQLHTPMYFFLTHLSFIDLSYSTVITPKTLANLLTSNYISFMGCFAQMFFFVFLGAAECFLLSSMAYDRYVAICSPLRYPVIMSKRLCCALVTGPYVISFINSFVNVVWMSRLHFCDSNVVRHFFCDTSPILALSCMDTYDIEIMIHILAGSTLMVSLITISASYVSILSTILKINSTSGKQKALSTCASHLLGVTIFYGTMIFTYLKPRKSYSLGRDQVASVFYTIVIPMLNPLIYSLRNKEVKNALIRVMQRRQDSR

SEQ ID NO: 3274 - protein, 312 aa, unidentified
MMGRRNNTNVADFILMGLTLSEEIQMALFMLFLLIYLITMLGNVGMILIIRLDLQLHTPMYFFLTHLSFIDLSYSTVVTPKTLANLLTSNYISFTGCFAQMFFFAFLGTAECYLLSSMAHDRYAAICSPLHYTVIMSKRLCLALITGPYVIGFIDSFVNVVSMSRLHFYDSNVIHHFFCDTSPILALSCTDTYNTEILIFIIVGSTLMVSLFTISASYVFILFTILKINSTSGKQKAFSTCVSHLLGVTIFYSTLIFTYLKPRKSYSLGRDQVASVFYTIVIPVLNPLIYSLRNKEVKNAVIRVMQRRQDSR

SEQ ID NO: 3275 - protein, 312 aa, unidentified
MMGRRNDTNVADFILTGLSDSEEVQMALFMLFLLIYLITMLGNVGMLLIIRLDLQLHTPMYFFLTHLSFIDLSYSTVVTPKTLANLLTSNYISFTGCFAQMFCFVFLGTAECYLLSSMAYDRYAAICSPLHYTVIMPKRLCLALITGPYVIGFMDSFVNVVSMSRLHFCDSNIIHHFFCDTSPILALSCTDTDNTEMLIFIIAGSTLMVSLITISASYVSILSTILKINSTSGKQKAFSTCVSHLLGVTIFYGTMIFTYLKPRKSYSLGRDQVAPVFYTIVIPMLNPLIYSLRNREVKNALIRVMQRRQDSR

SEQ ID NO: 3276 - protein, 310 aa, unidentified
MAGNNFTEVTVFILSGFANHPELQVSLFLMFLFIYLFTVLGNLGLITLIRMDSQLHTPMYFFLSNLAFIDIFYSSTVTPKALVNFQSNRRSISFVGCFVQMYFFVGLVCCECFLLGSMAYNRYIAICNPLLYSVVMSQKVSNWLGVMPYVIGFTSSLISVWVISSLAFCDSSINHFFCDTTALLALSCVDTFGTEMVSFVLAGFTLLSSLLIITVTYIIIISAILRIQSAAGRQKAFSTCASHLMAVTIFYGSLIFTYLQPDNTSSLTQAQVASVFYTIVIPMLNPLIYSLRNKDVKNALLRVIHRKLFP

SEQ ID NO: 3277 - protein, 316 aa, unidentified
MAPENFTRVTEFILTGVSSCPELQIPLFLVFLVLYGLTMAGNLGIITLTSVDSRLQTPMYFFLQHLALINLGNSTVIAPKMLINFLVKKKTTSFYECATQLGGFLFFIVSEVIMLALMAYDRYVAICNPLLYMVVVSRRLCLLLVSLTYLYGFSTAIVVSSYVFSVSYCSSNIINHFYCDNVPLLALSCSDTYLPETVVFISAATNVVGSLIIVLVSYFNIVLSILKICSSEGRKKAFSTCASHMMAVTIFYGTLLFMYVQPRSNHSLDTDDKMASVFYTLVIPMLNPLIYSLRNKDVKTALQRFMTNLCYSFKTM

SEQ ID NO: 3278 - protein, 315 aa, unidentified
MAPENFTRVTEFILTGVSSCPELQIPLFLVFLVLYVLTMAGNLGIITLTSVDSRLQNPMYFFLRHLAIINLGNSTVIAPKMLMNFLVKKKTTSFYECATQLGGFLFFIVSEVMMLAVMAYDRYVAICNPLLYMVVVSRRLCLLLVSLTYLYGFSTAIVVSPCIFSVSYCSSNIINHFYCDIAPLLALSCSDTYIPETIVFISAATNLVFSMITVLVSYFNIVLSILRIRSPEGRKKAFSTCASHMIAVTVFYGTMLFMYLQPQTNHSLDTDKMASVFYTLVIPMLNPLIYSLRNNDVNVALKKFMENPCYSFKSM

SEQ ID NO: 3279 - protein, 319 aa, unidentified
MNHVVKHNHTAVTKVTEFILMGITDNPGLQAPLFGLFLIIYLVTVIGNLGMVILTYLDSKLHTPMYFFLRHLSITDLGYSTVIAPKMLVNFIVHKNTISYNWYATQLAFFEIFIISELFILSAMAYDRYVAICKPLLYVIIMAEKVLWVLVIVPYLYSTFVSLFLTIKLFKLSFCGSNIISYFYCDCIPLMSILCSDTNELELIILIFSGCNLLFSLSIVLISYMFILVAILRMNSRKGRYKAFSTCSSHLTVVIMFYGTLLFIYLQPKSSHTLAIDKMASVFYTLLIPMLNPLIYSLRNKEVKDALKRTLTNRFKIPI

SEQ ID NO: 3280 - protein, 307 aa, unidentified
MGQHNLTVLTEFILMELTRRPELQIPLFGVFLVIYLITVVGNLTMIILTKLDSHLHTPMYFSIRHLAFVDLGNSTVICPKVLANFVVDRNTISYYACAAQLAFFLMFIISEFFILSAMAYDRYVAICNPLLYYVIMSQRLCHVLVGIQYLYSTFQALMFTIKIFTLTFCGSNVISHFYCDDVPLLPMLCSNAQEIELLSILFSVFNLISSFLIVLVSYMLILLAICQMHSAEGRKKAFSTCGSHLTVVVVFYGSLLFMYMQPNSTHFFDTDKMASVFYTLVIPMLNPLIYSLRNEEVKNAFYKLFEN

SEQ ID NO: 3281 - protein, 359 aa, unidentified
MALGNHSTITEFLLLGLSADPNIRALLFVLFLGIYLLTIMENLMLLLMIRADSCLHKPMYFFLSHLSFVDLCFSSVIVPKMLENLLSQRKTISVEGCLAQVFFVFVTAGTEACLLSGMAYDRHAAICRPLLYGQIMGKQLYMHLVWGSWGLGFLDALINVLLAVNMVFCEAKIIHHYSYEMPSLLPLSCSDISRSLIALLCSTLLHGLGNFLLVFLSYTRIISTILSISSTSGRSKAFSTCSAHLTAVTLYYGSGLLRHLMPNSGSPIELIFSVQYTVVTPMLNSLIYSLKNKEVKGERSLRDSSHLPQLHKGQARWKRPAFTEGRREPGHPELSIPVTPQPQGACACSALRAAPTALP

SEQ ID NO: 3282 - protein, 309 aa, unidentified
MAHINCTQATEFILVGLTDHQELKMPLFVLFLSIYLFTVVGNLGLILLIRADTSLNTPMYFFLSNLAFVDFCYSSVITPKMLGNFLYKQNVISFDACATQLGCFLTFMISESLLLASMAYDRYVAICNPLLYMVVMTPGICIQLVAVPYSYSFLMALFHTILTFRLSYCHSNIVNHFYCDDMPLLRLTCSDTRFKQLWIFACAGIMFISSLLIVFVSYMFIISAILRMHSAEGRQKAFSTCGSHMLAVTIFYGTLIFMYLQPSSSHALDTDKMASVFYTVIIPMLNPLIYSLQNKEVKEALKKIIINKN

SEQ ID NO: 3283 - protein, 310 aa, unidentified
MMDNHSSATEFHLLGFPGSQGLHHILFAIFFFFYLVTLMGNTVIIVIVCVDKRLQSPMYFFLSHLSTLEILVTTIIVPMMLWGLLFLGCRQYLSLHVSLNFSCGTMEFALLGVMAVDRYVAVCNPLRYNIIMNSSTCIWVVIVSWVFGFLSEIWPIYATFQFTFRKSNSLDHFYCDRGQLLKLSCDNTLLTEFILFLMAVFILIGSLIPTIVSYTYIISTILKIPSASGRRKAFSTFASHFTCVVIGYGSCLFLYVKPKQTQGVEYNKIVSLLVSVLTPFLNPFIFTLRNDKVKEALRDGMKRCCQLLKD

SEQ ID NO: 3284 - protein, 314 aa, unidentified
MLMNYSSATEFYLLGFPGSEELHHILFAIFFFFYLVTLMGNTVIIMIVCVDKRLQSPMYFFLGHLSALEILVTTIIVPVMLWGLLLPGMQTIYLSACVVQLFLYLAVGTTEFALLGAMAVDRYVAVCNPLRYNIIMNRHTCNFVVLVSWVFGFLFQIWPVYVMFQLTYCKSNVVNNFFCDRGQLLKLSCNNTLFTEFILFLMAVFVLFGSLIPTIVSNAYIISTILKIPSSSGRRKSFSTCASHFTCVVIGYGSCLFLYVKPKQTQAADYNWVVSLMVSVVTPFLNPFIFTLRNDKVIEALRDGVKRCCQLFRN

SEQ ID NO: 3285 - protein, 305 aa, unidentified
MQRSNHTVTEFILLGFTTDPGMQLGLFVVFLGVYSLTVVGNSTLIVLICNDSCLHTPMYFFTGNLSFLDLWYSSVYTPKILVTCISEDKSISFAGCLCQFFFSAGLAYSECYLLAAVAYDRYVAISKPLLYAQAMSIKLCALLVAVSYCGGFINSSIITKKTFSFNFCRENIIDDFFCDLLPLVELACGEKGGYKIMMYFLLASNVICPAVLILASYLFIITSVLRISSSKGYLKAFSTCSSHLTSVTLYYGSILYIYALPRSSYSFDMDKIVSTFYTVVFPMLNLMIYSLRNKDVKEALKKLLP

SEQ ID NO: 3286 - protein, 327 aa, unidentified
MIFPSHDSQAFTSVDMEVGNCTILTEFILLGFSADSQWQPILFGVFLMLYLITLSGNMTLVILIRTDSHLHTPMYFFIGNLSFLDFWYTSVYTPKILASCVSEDKRISLAGCGAQLFFSCVVAYTECYLLAAMAYDRHAAICNPLLYSGTMSTALCTGLVAGSYIGGFLNAIAHTANTFRLHFCGKNIIDHFFCDAPPLVKMSCTNTRVYEKVLLGVVGFTVLSSILAILISYVNILLAILRIHSASGRHKAFSTCASHLISVMLFYGSLLFMYSRPSSTYSLERDKVAALFYTVINPLLNPLIYSLRNKDIKEAFRKATQTIQPQT

SEQ ID NO: 3287 - protein, 314 aa, unidentified
MAKNNLTRVTEFILMGFMDHPKLEIPLFLVFLSFYLVTLLGNVGMIMLIQVDVKLYTPMYFFLSHLSLLDACYTSVITPQILATLATGKTVISYGHCAAQFFLFTICAGTECFLLAVMAYDRYAAIRNPLLYTVAMNPRLCWSLVVGAYVCGVSGAILRTTCTFTLSFCKDNQINFFFCDLPPLLKLACSDTANIEIVIIFFGNFVILANASVILISYLLIIKTILKVKSSGGRAKTFSTCASHITAVALFFGALIFMYLQSGSGKSLEEDKVVSVFYTVVIPMLNPLIYSLRNKDVKDAFRKVARRLQVSLSM

SEQ ID NO: 3288 - protein, 335 aa, unidentified
MLGSKPRVHLYILPCASQQVSTMGDRGTSNHSEMTDFILAGFRVRPELHILLFLLFLFVYAMILLGNVGMMTIIMTDPRLNTPMYFFLGNLSFIDLFYSSVIEPKAMINFWSENKSISFAGCVAQLFLFALLIVTEGFLLAAMAYDRFIAICNPLLYSVQMSTRLCTQLVAGSYFCGCISSVIQTSMTFTLSFCASRAVDHFYCDSRPLQRLSCSDLFIHRMISFSLSCIIILPTIIVIIVSYMYIVSTVLKIHSTEGHKKAFSTCSSHLGVVSVLYGAVFFMYLTPDRFPELSKVASLCYSLVTPMLNPLIYSLRNKDVQEALKKFLEKKNIIL

SEQ ID NO: 3289 - protein, 310 aa, unidentified
MAEMNLTLVTEFLLIAFTEYPEWALPLFLLFLFMYLITVLGNLEMIILILMDHQLHAPMYFLLSHLAFMDVCYSSITVPQMLAVLLEHGAALSYTRCAAQFFLFTFFGSIDCYLLALMAYDRYLAVCQPLLYVTILTQQARLSLVAGAYVAGLISALVRTVSAFTLSFCGTSEIDFIFCDLPPLLKLTCGESYTQEVLIIMFAIFVIPASMVVILVSYLFIIVAIMGIPAGSQAKTFSTCTSHLTAVSLFFGTLIFMYLRGNSDQSSEKNRVVSVLYTEVIPMLNPLIYSLRNKEVKEALRKILNRAKLS

SEQ ID NO: 3290 - protein, 314 aa, unidentified
MAERNYTVVTEFFLTAFTEHLQWRVPLFLIFLSFYLATMLGNTGMILLIRGDRRLHTPMYFFLSHLSLVDICYSSAIIPQMLAVLWEHGTTISQARCAAQFFLFTFFASIDCYLLAIMAYDRYTAVCQPLLYVTIITEKARWGLVTGAYVAGFFSAFVRTVTAFTLSFCGNNEINFIFCDLPPLLKLSCGDSYTQEVVIIVFALFVMPACILVILVSYLFIIVAILQIHSAGGRAKTFSTCASHLTAVALFFGTLIFMYLRDNTGQSSEGDRVVSVLYTVVTPMLNPLIYSLRNKEVKEATRKALSKSKPARRP

SEQ ID NO: 3291 - protein, 254 aa, unidentified
MSAELNVPIDPSAPACPEPGHKGMDYRDWVRRSYLELVTSNHHSVQALSWRKLYLSRAKLKASSRTSALLSGFAMVAMVEVQLETQYQYPRPLLIAFSACTTVLVAVHLFALLISTCILPNVEAVSNIHNLNSISESPHERMHPYIELAWGFSTVLGILLFLAEVVLLCWIKFLPVDARRQPGPPPGPGSHTGWQAALVSTIIMVPVGLIFVVFTIHFYRSLVRHKTERHNREIEELHKLKVQLDGHERSLQVL

SEQ ID NO: 3292 - protein, 295 aa, unidentified [sequence omitted]

SEQ ID NO: 3293 - protein, 711 aa, unidentified
MATSSMSKGCFVFKPNSKKRKISLPIEDYFNKGKNEPEDSKLRFETYQLIWQQMKSENERLQEELNKNLFDNLIEFLQKSHSGFQKNSRDLGGQIKLREIPTAALVLGVNVTDHDLTFGSLTEALQNNVTPYVVSLQAKDCPDMKHFLQKLISQLMDCCVDIKSKEEESVHVTQRKTHYSMDSLSSWYMTVTQKTDPKMLSKKRTTSSQWQSPPVVVILKDMESFATKVLQDFIIISSQHLHEFPLILIFGIATSPIIIHRLLPHAVSSLLCIELFQSLSCKEHLTTVLDKLLLTTQFPFKINEKVLQVLTNIFLYHDFSVQNFIKGLQLSLLEHFYSQPLSVLCCNLPEAKRRINFLSNNQCENIRRLPSFRRYVEKQASEKQVALLTNERYLKEETQLLLENLHVYHMNYFLVLRCLHKFTSSLPKYPLGRQIRELYCTCLEKNIWDSEEYASVLQLLRMLAKDELMTILEKCFKVFKSYCENHLGSTAKRIEEFLAQFQSLDETKEEEDASGSQPKGLQKTDLYHLQKSLLEMKELRRSKKQTKFEVLRENVVNFIDCLVREYLLPPETQPLHEVVYFSAAHALREHLNAAPRIALHTALNNPYYYLKNEALKSEEGCIPNIAPDICIAYKLHLECSRLINLVDWSEAFATVVTAAEKMDANSATSEEMNEIIHARFIRAVSELELLGFIKPTKQKTDHVARLTWGGC

SEQ ID NO: 3294 - protein, 153 aa, unidentified
MNVGVAHSEVNPNTRVMNSRGMWLTYALGVGLLHIVLLSIPFFSVPVAWTLTNIIHNLGMYVFLHAVKGTPFETPDQGKARLLTHWEQLDYGVQFTSSRKFFTISPIILYFLASFYTKYDPTHFILNTASLLSVLIPKMPQLHGVRIFGINKY

SEQ ID NO: 3295 - protein, 153 aa, unidentified
MNVGVAHSEVNPNTRVMNSRGIWLAYIILVGLLHMVLLSIPFFSIPVVWTLTNVIHNLATYVFLHTVKGTPFETPDQGKARLLTHWEQMDYGLQFTSSRKFLSISPIVLYLLASFYTKYDAAHFLINTASLLSVLLPKLPQFHGVRVFGINKY

SEQ ID NO: 3296 - protein, 153 aa, unidentified
MNVGTAHSEVNPNTRVMNSRGIWLSYVLAIGLLHIVLLSIPFVSVPVVWTLTNLIHNMGMYIFLHTVKGTPFETPDQGKARLLTHWEQMDYGVQFTASRKFLTITPIVLYFLTSFYTKYDQIHFVLNTVSLMSVLIPKLPQLHGVRIFGINKY

SEQ ID NO: 3297 - protein, 879 aa, unidentified
MKEEAFLRRRFSLCPPSSTPQKVDPRKLTRNLLLSGDNELYPLSPGKDMEPNGPSLPRDEGPPTPSSATKVPPAEYRLCNGSDKECVSPTARVTKKETLKAQKENYRQEKKRATRQLLSALTDPSVVIMADSLKIRGTLKSWTKLWCVLKPGVLLIYKTPKVGQWVGTVLLHCCELIERPSKKDGFCFKLFHPLDQSVWAVKGPKGESVGSITQPLPSSYLIFRAASESDGRCWLDALELALRCSSLLRLGTCKPGRDGEPGTSPDASPSSLCGLPASATVHPDQDLFPLNGSSLENDAFSDKSERENPEESDTETQDHSRKTESGSDQSETPGAPVRRGTTYVEQVQEELGELGEASQVETVSEENKSLMWTLLKQLRPGMDLSRVVLPTFVLEPRSFLNKLSDYYYHADLLSRAAVEEDAYSRMKLVLRWYLSGFYKKPKGIKKPYNPILGETFRCCWFHPQTDSRTFYIAEQVSHHPPVSAFHVSNRKDGFCISGSITAKSRFYGNSLSALLDGKATLTFLNRAEDYTLTMPYAHCKGILYGTMTLELGGKVTIECAKNNFQAQLEFKLKPFFGGSTSINQISGKITSGEEVLASLSGHWDRDVFIKEEGSGSSALFWTPSGEVRRQRLRQHTVPLEEQTELESERLWQHVTRAISKGDQHRATQEKFALEEAQRQRARERQESLMPWKPQLFHLDPITQEWHYRYEDHSPWDPLKDIAQFEQDGILRTLQQEAVARQTTFLGSPGPRHERSGPDQRLRKASDQPSGHSQATESSGSTPESCPELSDEEQDGDFVPGGESPCPRCRKEARRLQALHEAILSIREAQQELHRHLSAMLSSTARAAQAPTPGLLQSPRSWFLLCVFLACQLFINHILK

SEQ ID NO: 3298 - protein, 889 aa, unidentified
MEGGLADGEPDRTSLLGDSKDVLGPSTVVANSDESQLLTPGKMSQRQGKEAYPTPTKDLHQPSLSPASPHSQGFERGKEDISQNKDESSLSMSKSKSESKLYNGSEKDSSTSSKLTKKESLKVQKKNYREEKKRATKELLSTITDPSVIVMADWLKIRGTLKSWTKLWCVLKPGVLLIYKTQKNGQWVGTVLLNACEIIERPSKKDGFCFKLFHPLEQSIWAVKGPKGEAVGSITQPLPSSYLIIRATSESDGRCWMDALELALKCSSLLKRTMIREGKEHDLSVSSDSTHVTFYGLLRANNLHSGDNFQLNDSEIERQHFKDQDMYSDKSDKENDQEHDESDNEVMGKSEESDTDTSERQDDSYIEPEPVEPLKETTYTEQSHEELGEAGEASQTETVSEENKSLIWTLLKQVRPGMDLSKVVLPTFILEPRSFLDKLSDYYYHADFLSEAALEENPYFRLKKVVKWYLSGFYKKPKGLKKPYNPILGETFRCLWIHPRTNSKTFYIAEQVSHHPPISAFYVSNRKDGFCLSGSILAKSKFYGNSLSAILEGEARLTFLNRGEDYVMTMPYAHCKGILYGTMTLELGGTVNITCQKTGYSAILEFKLKPFLGSSDCVNQISGKLKLGKEVLATLEGHWDSEVFITDKKTDNSEVFWNPTPDIKQWRLIRHTVKFEEQGDFESEKLWQRVTRAINAKDQTEATQEKYVLEEAQRQAARDRKTKNEEWSCKLFELDPLTGEWHYKFADTRPWDPLNDMIQFEKDGVIQTKVKHRTPMVSVPKMKHKPTRQQKKVAKGYSSPEPDIQDSSGSEAQSVKPSTRRKKGIELGDIQSSIESIKQTQEEIKRNIMALRNHLVSSTPATDYFLQQKDYFIIFLLILLQVIINFMFK

SEQ ID NO: 3299 - protein, 282 aa, unidentified
MALVLILQLLTLWPLCHTDITPSVPPASYHPKPWLGAQPATVVTPGVNVTLRCRAPQPAWRFGLFKPGEIAPLLFRDVSSELAEFFLEEVTPAQGGIYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEGEGPEARPASSAPGMQAPGPPPSDPGAQAPSLSSFRPRGLVLQPLLPQTQDSWDPAPPPSDPGV

SEQ ID NO: 3300 - protein, 979 aa, unidentified
MALFAVFQTTFFLTLLSLRTYQSEVLAERLPLTPVSLKVSTNSTRQSLHLQWTVHNLPYHQELKMVFQIQISRIETSNVIWVGNYSTTVKWNQVLHWSWESELPLECATHFVRIKSLVDDAKFPEPNFWSNWSSWEEVSVQDSTGQDILFVFPKDKLVEEGTNVTICYVSRNIQNNVSCYLEGKQIHGEQLDPHVTAFNLNSVPFIRNKGTNIYCEASQGNVSEGMKGIVLFVSKVLEEPKDFSCETEDFKTLHCTWDPGTDTALGWSKQPSQSYTLFESFSGEKKLCTHKNWCNWQITQDSQETYNFTLIAENYLRKRSVNILFNLTHRVYLMNPFSVNFENVNATNAIMTWKVHSIRNNFTYLCQIELHGEGKMMQYNVSIKVNGEYFLSELEPATEYMARVRCADASHFWKWSEWSGQNFTTLEAAPSEAPDVWRIVSLEPGNHTVTLFWKPLSKLHANGKILFYNVVVENLDKPSSSELHSIPAPANSTKLILDRCSYQICVIANNSVGASPASVIVISADPENKEVEEERIAGTEGGFSLSWKPQPGDVIGYVVDWCDHTQDVLGDFQWKNVGPNTTSTVISTDAFRPGVRYDFRIYGLSTKRIACLLEKKTGYSQELAPSDNPHVLVDTLTSHSFTLSWKDYSTESQPGFIQGYHVYLKSKARQCHPRFEKAVLSDGSECCKYKIDNPEEKALIVDNLKPESFYEFFITPFTSAGEGPSATFTKVTTPDEHSSMLIHILLPMVFCVLLIMVMCYLKSQWIKETCYPDIPDPYKSSILSLIKFKENPHLIIMNVSDCIPDAIEVVSKPEGTKIQFLGTRKSLTETELTKPNYLYLLPTEKNHSGPGPCICFENLTYNQAASDSGSCGHVPVSPKAPSMLGLMTSPENVLKALEKNYMNSLGEIPAGETSLNYVSQLASPMFGDKDSLPTNPVEAPHCSEYKMQMAVSLRLALPPPTENSSLSSITLLDPGEHYC

SEQ ID NO: 3301 - protein, 37 aa, unidentified
MITDVQLAIFANMLGVSLFLLVVLYHYVAVNNPKKQE

SEQ ID NO: 3302 - protein, 149 aa, unidentified
METLYRVPFLVLECPNLKLKKPPWLHMPSAMTVYALVVVSYFLITGGIIYDVIVEPPSVGSMTDEHGHQRPVAFLAYRVNGQYIMEGLASSFLFTMGGLGFIILDRSNAPNIPKLNRFLLLFIGFVCVLLSFFMARVFMRMKLPGYLMG

SEQ ID NO: 3303 - protein, 334 aa, unidentified
MEPGPTAAQRRCSLPPWLPLGLLLWSGLALGALPFGSSPHRVFHDLLSEQQLLEVEDLSLSLLQGGGLGPLSLPPDLPDLDPECRELLLDFANSSAELTGCLVRSARPVRLCQTCYPLFQQVVSKMDNISRAAGNTSESQSCARSLLMADRMQIVVILSEFFNTTWQEANCANCLTNNSEELSNSTVYFLNLFNHTLTCFEHNLQGNAHSLLQTKNYSEVCKNCREAYKTLSSLYSEMQKMNELENKAEPGTHLCIDVEDAMNITRKLWSRTFNCSVPCSDTVPVIAVSVFILFLPVVFYLSSFLHSEQKKRKLILPKRLKSSTSFANIQENSN

SEQ ID NO: 3304 - protein, 1997 aa, unidentified
MALLIHLKTVSELRGRGDRIAKVTFRGQSFYSRVLENCEDVADFDETFRWPVASSIDRNEMLEIQVFNYSKVFSNKLIGTFRMVLQKVVEESHVEVTDTLIDDNNAIIKTSLCVEVRYQATDGTVGSWDDGDFLGDESLQEEEKDSQETDGLLPGSRPSSRPPGEKSFRRAGRSVFSAMKLGKNRSHKEEPQRPDEPAVLEMEDLDHLAIRLGDGLDPDSVSLASVTALTTNVSNKRSKPDIKMEPSAGRPMDYQVSITVIEARQLVGLNMDPVVCVEVGDDKKYTSMKESTNCPYYNEYFVFDFHVSPDVMFDKIIKISVIHSKNLLRSGTLVGSFKMDVGTVYSQPEHQFHHKWAILSDPDDISSGLKGYVKCDVAVVGKGDNIKTPHKANETDEDDIEGNLLLPEGVPPERQWARFYVKIYRAEGLPRMNTSLMANVKKAFIGENKDLVDPYVQVFFAGQKGKTSVQKSSYEPLWNEQVVFTDLFPPLCKRMKVQIRDSDKVNDVAIGTHFIDLRKISNDGDKGFLPTLGPAWVNMYGSTRNYTLLDEHQDLNEGLGEGVSFRARLLLGLAVEIVDTSNPELTSSTEVQVEQATPISESCAGKMEEFFLFGAFLEASMIDRRNGDKPITFEVTIGNYGNEVDGLSRPQRPRPRKEPGDEEEVDLIQNASDDEAGDAGDLASVSSTPPMRPQVTDRNYFHLPYLERKPCIYIKSWWPDQRRRLYNANIMDHIADKLEEGLNDIQEMIKTEKSYPERRLRGVLEELSCGCCRFLSLADKDQGHSSRTRLDRERLKSCMRELENMGQQARMLRAQVKRHTVRDKLRLCQNFLQKLRFLADEPQHSIPDIFIWMMSNNKRVAYARVPSKDLLFSIVEEETGKDCAKVKTLFLKLPGKRGFGSAGWTVQAKVELYLWLGLSKQRKEFLCGLPCGFQEVKAAQGLGLHAFPPVSLVYTKKQAFQLRAHMYQARSLFAADSSGLSDPFARVFFINQSQCTEVLNETLCPTWDQMLVFDNLELYGEAHELRDDPPIIVIEIYDQDSMGKADFMGRTFAKPLVKMADEAYCPPRFPPQLEYYQIYRGNATAGDLLAAFELLQIGPAGKADLPPINGPVDVDRGPIMPVPMGIRPVLSKYRVEVLFWGLRDLKRVNLAQVDRPRVDIECAGKGVQSSLIHNYKKNPNFNTLVKWFEVDLPENELLHPPLNIRVVDCRAFGRYTLVGSHAVSSLRRFIYRPPDRSAPSWNTTVRLLRRCRVLCNGGSSSHSTGEVVVTMEPEVPIKKLETMVKLDATSEAVVKVDVAEEEKEKKKKKKGTAEEPEEEEPDESMLDWWSKYFASIDTMKEQLRQQEPSGIDLEEKEEVDNTEGLKGSMKGKEKARAAKEEKKKKTQSSGSGQGSEAPEKKKPKIDELKVYPKELESEFDNFEDWLHTFNLLRGKTGDDEDGSTEEERIVGRFKGSLCVYKVPLPEDVSREAGYDSTYGMFQGIPSNDPINVLVRVYVVRATDLHPADINGKADPYIAIRLGKTDIRDKENYISKQLNPVFGKSFDIEASFPMESMLTVAVYDWDLVGTDDLIGETKIDLENRFYSKHRATCGIAQTYSTHGYNIWRDPMKPSQILTRLCKDGKVDGPHFGPPGRVKVANRVFTGPSEIEDENGQRKPTDEHVALLALRHWEDIPRAGCRLVPEHVETRPLLNPDKPGIEQGRLELWVDMFPMDMPAPGTPLDISPRKPKKYELRVIIWNTDEVVLEDDDFFTGEKSSDIFVRGWLKGQQEDKQDTDVHYHSLTGEGNFNWRYLFPFDYLAAEEKIVISKKESMFSWDETEYKIPARLTLQIWDADHFSADDFLGAIELDLNRFPRGAKTAKQCTMEMATGEVDVPLVSIFKQKRVKGWWPLLARNENDEFELTGKVEAELHLLTAEEAEKNPVGLARNEPDPLEKPNRPDTSFIWFLNPLKSARYFLWHTYRWLLLKLLLLLLLLLLLALFLYSVPGYLVKKILGA

SEQ ID NO: 3305 - protein, 612 aa, unidentified
MLEGLGSPASPRAAASASVAGSSGPAACSPPSSSAPRSPESPAPRRGGVRASVPQKLAEMLSSQYGLIVFVAGLLLLLAWAVHAAGVSKSDLLCFLTALMLLQLLWMLWYVGRSSAHRRLFRLKDTHAGAGWLRGSITLFAVITVILGCLKIGYFIGFSECLSATEGVFPVTHSVHTLLQVYFLWGHAKDIIQSFKTLERFGVIHSVFTNLLLWANGVLNESKHQLNEHKERLITLGFGNITTVLDDHTPQCNCTPPTLCTAISHGIYYLYPFNIEYQILASTMLYVLWKNIGRKVDSHQHQKMQFKSDGVMVGAVLGLTVLAATIAVVVVYLIHIGRSKTKSESALIMFYLYAITLLMLMGAAGLAGIRIYRIDEKSLDESKNPARKLDSDLLVGTASGSWLISWGSILAILCAEGHPRYTWYNLPYSILAIVEKYIQNLFIFESIHREPEKLSEDIQTLRVVTVCNGNTMPLASSCPKSGGVARDVAPQGKDMPPAANGNVCMRESHDKEEEKQEESSWGGSPSPVRLPRFLQGNAKRKVLRNIAAFLFLCNISLWIPPAFGCRPEYDNGLEEIVFGFEPWIIVVNLAMPFSIFYRMHAAASLFEVYCKI

SEQ ID NO: 3306 - protein, 562 aa, unidentified
MSEELAQGPKESPPAPRAGPREVWKKGGRLLSVLLAVNVLLLACTLISGGAFNKVAVYDTDVFALLTAMMLLATLWILFYLLRTVRCPCAVPYRDAHAGPIWLRGGLVLFGICTLIMDVFKTGYYSSFFECQSAIKILHPLIQAVFVIIQTYFLWVSAKDCVHVHLDLTWCGLMFTLTTNLAIWMAAVVDESVHQSHSYSSSHSNASHARLISDQHADNPVGGDSCLCSTAVCQIFQQGYFYLYPFNIEYSLFASTMLYVMWKNVGRFLASTPGHSHTPTPVSLFRETFFAGPVLGLLLFVVGLAVFIIYEVQVSGDGSRTRQALVIYYSFNIVCLGLTTLVSLSGSIIYRFDRRAMDHHKNPTRTLDVALLMGAALGQYAISYYSIVAVVAGTPQDLLAGLNLTHALLMIAQHTFQNMFIIESLHRGPPGAEPHSTHPKEPCQDLTFTNLDALHTLSACPPNPGLVSPSPSDQREAVAIVSTPRSQWRRQCLKDISLFLLLCNVILWIMPAFGARPHFSNTVEVDFYGYSLWAVIVNICLPFGIFYRMHAVSSLLEVYVLS

SEQ ID NO: 3307 - protein, 596 aa, unidentified
MGRGARAAAAQSRWGRASRASVSPGRTIRSAPAVGEAQETEAAPEKENRVDVGAEERAAATRPRQKSWLVRHFSLLLRRDRQAQKAGQLFSGLLALNVVFLGGAFICSMIFNKVAVTLGDVWILLATLKVLSLLWLLYYVASTTRRPHAVLYQDPHAGPLWVRGSLVLFGSCTFCLNIFRVGYDVSHIRCKSQLDLVFSVIEMVFIGVQTWVLWKHCKDCVRVQTNFTRCGLMLTLATNLLLWVLAVTNDSMHREIEAELGILMEKSTGNETNTCLCLNATACEAFRRGFLMLYPFSTEYCLICCAVLFVMWKNVGRHVAPHMGAHPATAPFHLHGAIFGPLLGLLVLLAGVCVFVLFQIEASGPAIACQYFTLYYAFYVAVLPTMSLACLAGTAIHGLEERELDTVKNPTRSLDVVLLMGAALGQMGIAYFSIVAIVAKRPHELLNRLILAYSLLLILQHIAQNLFIIEGLHRRPLWETVPEGLAGKQEAEPPRRGSLLELGQGLQRASLAYIHSYSHLNWKRRALKEISLFLILCNITLWMMPAFGIHPEFENGLEKDFYGYQIWFAIVNFGLPLGVFYRMHSVGGLVEVYLGA

SEQ ID NO: 3308 - protein, 435 aa, unidentified
MAMGLMCGRRELLRLLQSGRRVHSVAGPSQWLGKPLTTRLLFPVAPCCCRPHYLFLAASGPRSLSTSAISFAEVQVQAPPVVAATPSPTAVPEVASGETADVVQTAAEQSFAELGLGSYTPVGLIQNLLEFMHVDLGLPWWGAIAACTVFARCLIFPLIVTGQREAARIHNHLPEIQKFSSRIREAKLAGDHIEYYKASSEMALYQKKHGIKLYKPLILPVTQAPIFISFFIALREMANLPVPSLQTGGLWWFQDLTVSDPIYILPLAVTATMWAVLELGAETGVQSSDLQWMRNVIRMMPLITLPITMHFPTAVFMYWLSSNLFSLVQVSCLRIPAVRTVLKIPQRVVHDLDKLPPREGFLESFKKGWKNAEMTRQLREREQRMRNQLELAARGPLRQTFTHNPLLQPGKDNPPNIPSSSSKPKSKYPWHDTLG

SEQ ID NO: 3309 - protein, 423 aa, unidentified
MLCHRGGQLIVPIIPLCPEHSCRGRRLQNLLSGPWPKQPMELHNLSSPSPSLSSSVLPPSFSPSPSSAPSAFTTVGGSSGGPCHPTSSSLVSAFLAPILALEFVLGLVGNSLALFIFCIHTRPWTSNTVFLVSLVAADFLLISNLPLRVDYYLLHETWRFGAAACKVNLFMLSTNRTASVVFLTAIALNRYLKVVQPHHVLSRASVGAAARVAGGLWVGILLLNGHLLLSTFSGPSCLSYRVGTKPSASLRWHQALYLLEFFLPLALILFAIVSIGLTIRNRGLGGQAGPQRAMRVLAMVVAVYTICFLPSIIFGMASMVAFWLSACRSLDLCTQLFHGSLAFTYLNSVLDPVLYCFSSPNFLHQSRALLGLTRGRQGPVSDESSYQPSRQWRYREASRKAEAIGKLKVQGEVSLEKEGSSQG

SEQ ID NO: 3310 - protein, 337 aa, unidentified
MNEPLDYLANASDFPDYAAAFGNCTDENIPLKMHYLPVIYGIIFLVGFPGNAVVISTYIFKMRPWKSSTIIMLNLACTDLLYLTSLPFLIHYYASGENWIFGDFMCKFIRFSFHFNLYSSILFLTCFSIFRYCVIIHPMSCFSIHKTRCAVVACAVVWIISLVAVIPMTFLITSTNRTNRSACLDLTSSDELNTIKWYNLILTATTFCLPLVIVTLCYTTIIHTLTHGLQTDSCLKQKARRLTILLLLAFYVCFLPFHILRVIRIESRLLSISCSIENQIHEAYIVSRPLAALNTFGNLLLYVVVSDNFQQAVCSTVRCKVSGNLEQAKKISYSNNP

SEQ ID NO: 3311 - protein, 389 aa, unidentified
MEGALAANWSAEAANASAAPPGAEGNRTAGPPRRNEALARVEVAVLCLILLLALSGNACVLLALRTTRQKHSRLFFFMKHLSIADLVVAVFQVLPQLLWDITFRFYGPDLLCRLVKYLQVVGMFASTYLLLLMSLDRCLAICQPLRSLRRRTDRLAVLATWLGCLVASAPQVHIFSLREVADGVFDCWAVFIQPWGPKAYITWITLAVYIVPVIVLAACYGLISFKIWQNLRLKTAAAAAAEAPEGAAAGDGGRVALARVSSVKLISKAKIRTVKMTFIIVLAFIVCWTPFFFVQMWSVWDANAPKEASAFIIVMLLASLNSCCNPWIYMLFTGHLFHELVQRFLCCSASYLKGRRLGETSASKKSNSSSFVLSHRSSSQRSCSQPSTA

SEQ ID NO: 3312 - protein, 399 aa, unidentified
MARRFQEELAAFLFEYDTPRMVLVRNKKVGVIFRLIQLVVLVYVIGWVFLYEKGYQTSSGLISSVSVKLKGLAVTQLPGLGPQVWDVADYVFPAQGDNSFVVMTNFIVTPKQTQGYCAEHPEGGICKEDSGCTPGKAKRKAQGIRTGKCVAFNDTVKTCEIFGWCPVEVDDDIPRPALLREAENFTLFIKNSISFPRFKVNRRNLVEEVNAAHMKTCLFHKTLHPLCPVFQLGYVVQESGQNFSTLAEKGGVVGITIDWHCDLDWHVRHCRPIYEFHGLYEEKNLSPGFNFRFARHFVENGTNYRHLFKVFGIRFDILVDGKAGKFDIIPTMTTIGSGIGIFGVATVLCDLLLLHILPKRHYYKQKKFKYAEDMGPGAAERDLAATSSTLGLQENMRTS

SEQ ID NO: 3313 - protein, 471 aa, unidentified
MAAAQPKYPAGATARRLARGCWSALWDYETPKVIVVRNRRLGVLYRAVQLLILLYFVWYVFIVQKSYQESETGPESSIITKVKGITTSEHKVWDVEEYVKPPEGGSVFSIITRVEATHSQTQGTCPESIRVHNATCLSDADCVAGELDMLGNGLRTGRCVPYYQGPSKTCEVFGWCPVEDGASVSQFLGTMAPNFTILIKNSIHYPKFHFSKGNIADRTDGYLKRCTFHEASDLYCPIFKLGFIVEKAGESFTELAHKGGVIGVIINWDCDLDLPASECNPKYSFRRLDPKHVPASSGYNFRFAKYYKINGTTTRTLIKAYGIRIDVIVHGQAGKFSLIPTIINLATALTSVGVGSFLCDWILLTFMNKNKVYSHKKFDKVCTPSHPSGSWPVTLARVLGQAPPEPGHRSEDQHPSPPSGQEGQQGAECGPAFPPLRPCPISAPSEQMVDTPASEPAQASTPTDPKGLAQL

SEQ ID NO: 3314 - protein, 397 aa, unidentified
MNCISDFFTYETTKSVVVKSWTIGIINRVVQLLIISYFVGWVFLHEKAYQVRDTAIESSVVTKVKGSGLYANRVMDVSDYVTPPQGTSVFVIITKMIVTENQMQGFCPESEEKYRCVSDSQCGPERLPGGGILTGRCVNYSSVLRTCEIQGWCPTEVDTVETPIMMEAENFTIFIKNSIRFPLFNFEKGNLLPNLTARDMKTCRFHPDKDPFCPILRVGDVVKFAGQDFAKLARTGGVLGIKIGWVCDLDKAWDQCIPKYSFTRLDSVSEKSSVSPGYNFRFAKYYKMENGSEYRTLLKAFGIRFDVLVYGNAGKFNIIPTIISSVAAFTSVGVGTVLCDIILLNFLKGADQYKAKKFEEVNETTLKIAALTNPVYPSDQTTAEKQSTDSGAFSIGH

SEQ ID NO: 3315 - protein, 388 aa, unidentified
MAGCCAALAAFLFEYDTPRIVLIRSRKVGLMNRAVQLLILAYVIGWVFVWEKGYQETDSVVSSVTTKVKGVAVTNTSKLGFRIWDVADYVIPAQEENSLFVMTNVILTMNQTQGLCPEIPDATTVCKSDASCTAGSAGTHSNGVSTGRCVAFNGSVKTCEVAAWCPVEDDTHVPQPAFLKAAENFTLLVKNNIWYPKFNFSKRNILPNITTTYLKSCIYDAKTDPFCPIFRLGKIVENAGHSFQDMAVEGGIMGIQVNWDCNLDRAASLCLPRYSFRRLDTRDVEHNVSPGYNFRFAKYYRDLAGNEQRTLIKAYGIRFDIIVFGKAGKFDIIPTMINIGSGLALLGMATVLCDIIVLYCMKKRLYYREKKYKYVEDYEQGLASELDQ

SEQ ID NO: 3316 - protein, 422 aa, unidentified
MGQAGCKGLCLSLFDYKTEKYVIAKNKKVGLLYRLLQASILAYLVVWVFLIKKGYQDVDTSLQSAVITKVKGVAFTNTSDLGQRIWDVADYVIPAQGENVFFVVTNLIVTPNQRQNVCAENEGIPDGACSKDSDCHAGEAVTAGNGVKTGRCLRRENLARGTCEIFAWCPLETSSRPEEPFLKEAEDFTIFIKNHIRFPKFNFSKSNVMDVKDRSFLKSCHFGPKNHYCPIFRLGSVIRWAGSDFQDIALEGGVIGINIEWNCDLDKAASECHPHYSFSRLDNKLSKSVSSGYNFRFARYYRDAAGVEFRTLMKAYGIRFDVMVNGKGAFFCDLVLIYLIKKREFYRDKKYEEVRGLEDSSQEAEDEASGLGLSEQLTSGPGLLGMPEQQELQEPPEAKRGSSSQKGNGSVCPQLLEPHRST

SEQ ID NO: 3317 - protein, 441 aa, unidentified
MCPQLAGAGSMGSPGATTGWGLLDYKTEKYVMTRNWRVGALQRLLQFGIVVYVVGWALLAKKGYQERDLEPQFSIITKLKGVSVTQIKELGNRLWDVADFVKPPQGENVFFLVTNFLVTPAQVQGRCPEHPSVPLANCWVDEDCPEGEGGTHSHGVKTGQCVVFNGTHRTCEIWSWCPVESGVVPSRPLLAQAQNFTLFIKNTVTFSKFNFSKSNALETWDPTYFKHCRYEPQFSPYCPVFRIGDLVAKAGGTFEDLALLGGSVGIRVHWDCDLDTGDSGCWPHYSFQLQEKSYNFRTATHWWEQPGVEARTLLKLYGIRFDILVTGQAGKFGLIPTAVTLGTGAAWLGVVTFFCDLLLLYVDREAHFYWRTKYEEAKAPKATANSVWRELALASQARLAECLRRSSAPAPTATAAGSQTQTPGWPCPSSDTHLPTHSGSL

SEQ ID NO: 3318 - protein, 595 aa, unidentified
MPACCSCSDVFQYETNKVTRIQSMNYGTIKWFFHVIIFSYVCFALVSDKLYQRKEPVISSVHTKVKGIAEVKEEIVENGVKKLVHSVFDTADYTFPLQGNSFFVMTNFLKTEGQEQRLCPEYPTRRTLCSSDRGCKKGWMDPQSKGIQTGRCVVYEGNQKTCEVSAWCPIEAVEEAPRPALLNSAENFTVLIKNNIDFPGHNYTTRNILPGLNITCTFHKTQNPQCPIFRLGDIFRETGDNFSDVAIQGGIMGIEIYWDCNLDRWFHHCRPKYSFRRLDDKTTNVSLYPGYNFRYAKYYKENNVEKRTLIKVFGIRFDILVFGTGGKFDIIQLVVYIGSTLSYFGLAAVFIDFLIDTYSSNCCRSHIYPWCKCCQPCVVNEYYYRKKCESIVEPKPTLKYVSFVDESHIRMVNQQLLGRSLQDVKGQEVPRPAMDFTDLSRLPLALHDTPPIPGQPEEIQLLRKEATPRSRDSPVWCQCGSCLPSQLPESHRCLEELCCRKKPGACITTSELFRKLVLSRHVLQFLLLYQEPLLALDVDSTNSRLRHCAYRCYATWRFGSQDMADFAILPSCCRWRIRKEFPKSEGQYSGFKSPY

SEQ ID NO: 3319 - protein, 373 aa, unidentified
MTEVLWPAVPNGTDAAFLAGPGSSWGNSTVASTAAVSSSFKCALTKTGFQFYYLPAVYILVFIIGFLGNSVAIWMFVFHMKPWSGISVYMFNLALADFLYVLTLPALIFYYFNKTDWIFGDAMCKLQRFIFHVNLYGSILFLTCISAHRYSGVVYPLKSLGRLKKKNAICISVLVWLIVVVAISPILFYSGTGVRKNKTITCYDTTSDEYLRSYFIYSMCTTVAMFCVPLVLILGCYGLIVRALIYKDLDNSPLRRKSIYLVIIVLTVFAVSYIPFHVMKTMNLRARLDFQTPAMCAFNDRVYATYQVTRGLASLNSCVDPILYFLAGDTFRRRLSRATRKASRRSEANLQSKSEDMTLNILPEFKQNGDTSL

SEQ ID NO: 3320 - protein, 339 aa, unidentified
MANLDKYTETFKMGSNSTSTAEIYCNVTNVKFQYSLYATTYILIFIPGLLANSAALWVLCRFISKKNKAIIFMINLSVADLAHVLSLPLRIYYYISHHWPFQRALCLLCFYLKYLNMYASICFLTCISLQRCFFLLKPFRARDWKRRYDVGISAAIWIVVGTACLPFPILRSTDLNNNKSCFADLGYKQMNAVALVGMITVAELAGFVIPVIIIAWCTWKTTISLRQPPMAFQGISERQKALRMVFMCAAVFFICFTPYHINFIFYTMVKETIISSCPVVRIALYFHPFCLCLASLCCLLDPILYYFMASEFRDQLSRHGSSVTRSRLMSKESGSSMIG

SEQ ID NO: 3321 - protein, 374 aa, unidentified
MAANVSGAKSCPANFLAAADDKLSGFQGDFLWPILVVEFLVAVASNGLALYRFSIRKQRPWHPAVVFSVQLAVSDLLCALTLPPLAAYLYPPKHWRYGEAACRLERFLFTCNLLGSVIFITCISLNRYLGIVHPFFARSHLRPKHAWAVSAAGWVLAALLAMPTLSFSHLKRPQQGAGNCSVARPEACIKCLGTADHGLAAYRAYSLVLAGLGCGLPLLLTLAAYGALGRAVLRSPGMTVAEKLRVAALVASGVALYASSYVPYHIMRVLNVDARRRWSTRCPSFADIAQATAALELGPYVGYQVMRGLMPLAFCVHPLLYMAAVPSLGCCCRHCPGYRDSWNPEDAKSTGQALPLNATAAPKPSEPQSRELSQ

SEQ ID NO: 3322 - protein, 342 aa, unidentified
MQAVDNLTSAPGNTSLCTRDYKITQVLFPLLYTVLFFVGLITNGLAMRIFFQIRSKSNFIIFLKNTVISDLLMILTFPFKILSDAKLGTGPLRTFVCQVTSVIFYFTMYISISFLGLITIDRYQKTTRPFKTSNPKNLLGAKILSVVIWAFMFLLSLPNMILTNRQPRDKNVKKCSFLKSEFGLVWHEIVNYICQVIFWINFLIVIVCYTLITKELYRSYVRTRGVGKVPRKKVNVKVFIIIAVFFICFVPFHFARIPYTLSQTRDVFDCTAENTLFYVKESTLWLTSLNACLDPFIYFFLCKSFRNSLISMLKCPNSATSLSQDNRKKEQDGGDPNEETPM

SEQ ID NO: 3323 - protein, 354 aa, unidentified
MTAAIRRQRELSILPKVTLEAMNTTVMQGFNRSERCPRDTRIVQLVFPALYTVVFLTGILLNTLALWVFVHIPSSSTFIIYLKNTLVADLIMTLMLPFKILSDSHLAPWQLRAFVCRFSSVIFYETMYVGIVLLGLIAFDRFLKIIRPLRNIFLKKPVFAKTVSIFIWFFLFFISLPNTILSNKEATPSSVKKCASLKGPLGLKWHQMVNNICQFIFWTVFILMLVFYVVIAKKVYDSYRKSKSKDRKNNKKLEGKVFVVVAVFFVCFAPFHFARVPYTHSQTNNKTDCRLQNQLFIAKETTLFLAATNICMDPLIYIFLCKKFTEKLPCMQGRKTTASSQENHSSQTDNITLG

SEQ ID NO: 3324 - protein, 338 aa, unidentified
MINSTSTQPPDESCSQNLLITQQIIPVLYCMVFIAGILLNGVSGWIFFYVPSSKSFIIYLKNIVIADFVMSLTFPFKILGDSGLGPWQLNVFVCRVSAVLFYVNMYVSIVFFGLISFDRYYKIVKPLWTSFIQSVSYSKLLSVIVWMLMLLLAVPNIILTNQSVREVTQIKCIELKSELGRKWHKASNYIFVAIFWIVFLLLIVFYTAITKKIFKSHLKSSRNSTSVKKKSSRNIFSIVFVFFVCFVPYHIARIPYTKSQTEAHYSCQSKEILRYMKEFTLLLSAANVCLDPIIYFFLCQPFREILCKKLHIPLKAQNDLDISRIKRGNTTLESTDTL

SEQ ID NO: 3325 - protein, 377 aa, unidentified
MAADLGPWNDTINGTWDGDELGYRCRFNEDFKYVLLPVSYGVVCVPGLCLNAVALYIFLCRLKTWNASTTYMFHLAVSDALYAASLPLLVYYYARGDHWPFSTVLCKLVRFLFYTNLYCSILFLTCISVHRCLGVLRPLRSLRWGRARYARRVAGAVWVLVLACQAPVLYFVTTSARGGRVTCHDTSAPELFSRFVAYSSVMLGLLFAVPFAVILVCYVLMARRLLKPAYGTSGGLPRAKRKSVRTIAVVLAVFALCFLPFHVTRTLYYSFRSLDLSCHTLNAINMAYKVTRPLASANSCLDPVLYFLAGQRLVRFARDAKPPTGPSPATPARRRLGLRRSDRTDMQRIEDVLGSSEDSRRTESTPAGSENTKDIRL

SEQ ID NO: 3326 - protein, 365 aa, unidentified
MASTESSLLRSLGLSPGPGSSEVELDCWFDEDFKFILLPVSYAVVFVLGLGLNAPTLWLFIFRLRPWDATATYMFHLALSDTLYVLSLPTLIYYYAAHNHWPFGTEICKFVRFLFYWNLYCSVLFLTCISVHRYLGICHPLRALRWGRPRLAGLLCLAVWLVVAGCLVPNLFFVTTSNKGTTVLCHDTTRPEEFDHYVHFSSAVMGLLFGVPCLVTLVCYGLMARRLYQPLPGSAQSSSRLRSLRTIAVVLTVFAVCFVPFHITRTIYYLARLLEADCRVLNIVNVVYKVTRPLASANSCLDPVLYLLTGDKYRRQLRQLCGGGKPQPRTAASSLALVSLPEDSSCRWAATPQDSSCSTPRADRL

SEQ ID NO: 3327 - protein, 328 aa, unidentified
MEWDNGTGQALGLPPTTCVYRENFKQLLLPPVYSAVLAAGLPLNICVITQICTSRRALTRTAVYTLNLALADLLYACSLPLLIYNYAQGDHWPFGDFACRLVRFLFYANLHGSILFLTCISFQRYLGICHPLAPWHKRGGRRAAWLVCVAVWLAVTTQCLPTAIFAATGIQRNRTVCYDLSPPALATHYMPYGMALTVIGFLLPFAALLACYCLLACRLCRQDGPAEPVAQERRGKAARMAVVVAAAFAISFLPFHITKTAYLAVRSTPGVPCTVLEAFAAAYKGTRPFASANSVLDPILFYFTQKKFRRRPHELLQKLTAKWQRQGR

SEQ ID NO: 3328 - protein, 359 aa, unidentified
MQVPNSTGPDNATLQMLRNPAIAVALPVVYSLVAAVSIPGNLFSLWVLCRRMGPRSPSVIFMINLSVTDLMLASVLPFQIYYHCNRHHWVFGVLLCNVVTVAFYANMYSSILTMTCISVERFLGVLYPLSSKRWRRRRYAVAACAGTWLLLLTALSPLARTDLTYPVHALGIITCFDVLKWTMLPSVAMWAVFLFTIFILLFLIPFVITVACYTATILKLLRTEEAHGREQRRRAVGLAAVVLLAFVTCFAPNNFVLLAHIVSRLFYGKSYYHVYKLTLCLSCLNNCLDPFVYYFASREFQLRLREYLGCRRVPRDTLDTRRESLFSARTTSVRSEAGAHPEGMEGATRPGLQRQESVF

SEQ ID NO: 3329 - protein, 502 aa, unidentified [sequence omitted]

SEQ ID NO: 3330 - protein, 392 aa, unidentified
MAAPLRIQSDWAQALRKDEGEAWLSCHPPGKPSLYGSLTCQGIGLDGIPEVTASEGFTVNEINKKSIHISCPKENASSKFLAPYTTFSRIHTKSITCLDISSRGGLGVSSSTDGTMKIWQASNGELRRVLEGHVFDVNCCRFFPSGLVVLSGGMDAQLKIWSAEDASCVVTFKGHKGGILDTAIVDRGRNVVSASRDGTARLWDCGRSACLGVLADCGSSINGVAVGAADNSINLGSPEQMPSEREVGTEAKMLLLAREDKKLQCLGLQSRQLVFLFIGSDAFNCCTFLSGFLLLAGTQDGNIYQLDVRSPRAPVQVIHRSGAPVLSLLSVRDGFIASQGDGSCFIVQQDLDYVTELTGADCDPVYKVATWEKQIYTCCRDGLVRRYQLSDL

SEQ ID NO: 3331 - protein, 296 aa, unidentified
MVAEKETLSLNKCPDKMPKRTKLLAQQPLPVHQPHSLVSEGFTVKAMMKNSVVRGPPAAGAFKERPTKPTAFRKFYERGDFPIALEHDSKGNKIAWKVEIEKLDYHHYLPLFFDGLCEMTFPYEFFARQGIHDMLEHGGNKILPVLPQLIIPIKNALNLRNRQVICVTLKVLQHLVVSAEMVGKALVPYYRQILPVLNIFKNMNGSYSLPRLECSGAIMARCNLDHLGSSDPPTSASQVAEIIVNSGDGIDYSQQKRENIGDLIQETLEAFERYGGENAFINIKYVVPTYESCLLN

SEQ ID NO: 3332 - protein, 856 aa, unidentified
MGTTASTAQQTVSAGTPFEGLQGSGTMDSRHSVSIHSFQSTSLHNSKAKSIIPNKVAPVVITYNCKEEFQIHDELLKAHYTLGRLSDNTPEHYLVQGRYFLVRDVTEKMDVLGTVGSCGAPNFRQVQGGLTVFGMGQPSLSGFRRVLQKLQKDGHRECVIFCVREEPVLFLRADEDFVSYTPRDKQNLHENLQGLGPGVRVESLELAIRKEIHDFAQLSENTYHVYHNTEDLWGEPHAVAIHGEDDLHVTEEVYKRPLFLQPTYRYHRLPLPEQGSPLEAQLDAFVSVLRETPSLLQLRDAHGPPPALVFSCQMGVGRTNLGMVLGTLILLHRSGTTSQPEAAPTQAKPLPMEQFQVIQSFLRMVPQGRRMVEEVDRAITACAELHDLKEVVLENQKKLEGIRPESPAQGSGSRHSVWQRALWSLERYFYLILFNYYLHEQYPLAFALSFSRWLCAHPELYRLPVTLSSAGPVAPRDLIARGSLREDDLVSPDALSTVREMDVANFRRVPRMPIYGTAQPSAKALGSILAYLTDAKRRLRKVVWVSLREEAVLECDGHTYSLRWPGPPVAPDQLETLEAQLKAHLSEPPPGKEGPLTYRFQTCLTMQEVFSQHRRACPGLTYHRIPMPDFCAPREEDFDQLLEALRAALSKDPGTGFVFSCLSGQGRTTTAMVVAVLAFWHIQGFPEVGEEELVSVPDAKFTKGEFQVVMKVVQLLPDGHRVKKEVDAALDTVSETMTPMHYHLREIIICTYRQAKAAKEAQEMRRLQLRSLQYLERYVCLILFNAYLHLEKADSWQRPFSTWMQEVASKAGIYEILNELGFPELESGEDQPFSRLRYRWQEQSCSLEPSAPEDLL

SEQ ID NO: 3333 - protein, 973 aa, unidentified [sequence omitted]

SEQ ID NO: 3334 - protein, 426 aa, unidentified
MAIAQLATEYVFSDFLLKEPTEPKFKGLRLELAVDKMVTCIAVGLPLLLISLAFAQEISIGTQISCFSPSSFSWRQAAFVDSYCWAAVQQKNSLQSESGNLPLWLHKFFPYILLLFAILLYLPPLFWRFAAAPHICSDLKFIMEELDKVYNRAIKAAKSARDLDMRDGACSVPGVTENLGQSLWEVSESHFKYPIVEQYLKTKKNSNNLIIKYISCRLLTLIIILLACIYLGYYFSLSSLSDEFVCSIKSGILRNDSTVPDQFQCKLIAVGIFQLLSVINLVVYVLLAPVVVYTLFVPFRQKTDVLKVYEILPTFDVLHFKSEGYNDLSLYNLFLEENISEVKSYKCLKVLENIKSSGQGIDPMLLLTNLGMIKMDVVDGKTPMSAEMREEQGNQTAELQGMNIDSETKANNGEKNARQRLLDSSC

SEQ ID NO: 3335 - protein, 677 aa, unidentified
MHHLLEQSADMATALLAGEKLRELILPGAQDDKAGALAALLLQLKLELPFDRVVTIGTVLVPILLVTLVFTKNFAEEPIYCYTPHNFTRDQALYARGYCWTELRDALPGVDASLWPSLFEHKFLPYALLAFAAIMYVPALGWEFLASTRLTSELNFLLQEIDNCYHRAAEGRAPKIEKQIQSKGPGITEREKREIIENAEKEKSPEQNLFEKYLERRGRSNFLAKLYLARHVLILLLSAVPISYLCTYYATQKQNEFTCALGASPDGAAGAGPAVRVSCKLPSVQLQRIIAGVDIVLLCVMNLIILVNLIHLFIFRKSNFIFDKLHKVGIKTRRQWRRSQFCDINILAMFCNENRDHIKSLNRLDFITNESDLMYDNVVRQLLAALAQSNHDATPTVRDSGVQTVDPSANPAEPDGAAEPPVVKRPRKKMKWIPTSNPLPQPFKEPLAIMRVENSKAEKPKPARRKTATDTLIAPLLDRSAHHYKGGGGDPGPGPAPAPAPPPAPDKKHARHFSLDVHPYILGTKKAKAEAVPAALPASRSQEGGFLSQAEDCGLGLAPAPIKDAPLPEKEIPYPTEPARAGLPSGGPFHVRSPPAAPAVAPLTPASLGKAEPLTILSRNATHPLLHINTLYEAREEEDGGPRLPQDVGDLIAIPAPQQILIATFDEPRTVVSTVEF

SEQ ID NO: 3336 - protein, 392 aa, unidentified
MSLAHTAAEYMLSDALLPDRRGPRLKGLRLELPLDRIVKFVAVGSPLLLMSLAFAQEFSSGSPISCFSPSNFSIRQAAYVDSSCWDSLLHHKQDGPGQDKMKSLWPHKALPYSLLALALLMYLPVLLWQYAAVPALSSDLLFIISELDKSYNRSIRLVQHMLKIRQKSSDPYVFWNELEKARKERYFEFPLLERYLACKQRSHSLVATYLLRNSLLLIFTSATYLYLGHFHLDVFFQEEFSCSIKTGLLSDETHVPNLITCRLTSLSIFQIVSLSSVAIYTILVPVIIYNLTRLCRWDKRLLSVYEMLPAFDLLSRKMLGCPINDLNVILLFLRANISELISFSWLSVLCVLKDTTTQKHNIDTVVDFMTLLAGLEPSKPKHLTNSACDEHP

SEQ ID NO: 3337 - protein, 772 aa, unidentified
MQIWETSQGVGRGGSGFASYFCLNSPALDTAAAAGAAGRGSGGLGPALPAASPPPPGPTAPAALPPALLTALGPAAEGARRLHKSPSLSSSSSSSSSNAESGTESPGCSSSSSSSASLGRPGGGRGGAFFNFADGAPSAPGTANGHPGPRGPAPAGSPSQHQFHPGRRKRENKASTYGLNYLLSGSRAAALSGGGGPGAQAPRPGTPWKSRAYSPGIQGLHEEIIDFYNFMSPCPEEAAMRREVVKRIETVVKDLWPTADVQIFGSFSTGLYLPTSDIDLVVFGKWERPPLQLLEQALRKHNVAEPCSIKVLDKATVPIIKLTDQETEVKVDISFNMETGVRAAEFIKNYMKKYSLLPYLILVLKQFLLQRDLNEVFTGGISSYSLILMAISFLQLHPRIDARRADENLGMLLVEFFELYGRNFNYLKTGIRIKEGGAYIAKEEIMKAMTSGYRPSMLCIEDPLLPGNDVGRSSYGAMQVKQVFDYAYIVLSHAVSPLARSYPNRDAESTLGRIIKVTQEVIDYRRWIKEKWGSKAHPSPGMDSRIKIKERIATCNGEQTQNREPESPYGQRLTLSLSSPQLLSSGSSASSVSSLSGSDVDSDTPPCTTPSVYQFSLQAPAPLMAGLPTALPMPSGKPQPTTSRTLIMTTNNQTRFTIPPPTLGVAPVPCRQAGVEGTASLKAVHHMSSPAIPSASPNPLSSPHLYHKQHNGMKLSMKGSHGHTQGGGYSSVGSGGVRPPVGNRGHHQYNRTGWRRKKHTHTRDSLPVSLSR

SEQ ID NO: 3338 - protein, 745 aa, unidentified
MPFPVTTQGSQQTQPPQKHYGITSPISLAAPKETDCVLTQKLIETLKPFGVFEEEEELQRRILILGKLNNLVKEWIREISESKNLPQSVIENVGGKIFTFGSYRLGVHTKGADIDALCVAPRHVDRSDFFTSFYDKLKLQEEVKDLRAVEEAFVPVIKLCFDGIEIDILFARLALQTIPEDLDLRDDSLLKNLDIRCIRSLNGCRVTDEILHLVPNIDNFRLTLRAIKLWAKRHNIYSNILGFLGGVSWAMLVARTCQLYPNAIASTLVHKFFLVFSKWEWPNPVLLKQPEECNLNLPVWDPRVNPSDRYHLMPIITPAYPQQNSTYNVSVSTRMVMVEEFKQGLAITDEILLSKAEWSKLFEAPNFFQKYKHYIVLLASAPTEKQRLEWVGLVESKIRILVGSLEKNEFITLAHVNPQSFPAPKENPDKEEFRTMWVIGLVFKKTENSENLSVDLTYDIQSFTDTVYRQAINSKMFEVDMKIAAMHVKRKQLHQLLPNHVLQKKKKHSTEGVKLTALNDSSLDLSMDSDNSMSVPSPTSATKTSPLNSSGSSQGRNSPAPAVTAASVTNIQATEVSVPQVNSSESSGGTSSESIPQTATQPAISPPPKPTVSRVVSSTRLVNPPPRSSGNAATSGNAATKIPTPIVGVKRTSSPHKEESPKKTKTEEDETSEDANCLALSGHDKTEAKEQLDTETSTTQSETIQTAASLLASQKTSSTDLSDIPALPANPIPVIKNSIKLRLNR

SEQ ID NO: 3339 - protein, 736 aa, unidentified
MKEMSANTVLDSQRQQKHYGITSPISLASPKEIDHIYTQKLIDAMKPFGVFEDEEELNHRLVVLGKLNNLVKEWISDVSESKNLPPSVVATVGGKIFTFGSYRLGVHTKGADIDALCVAPRHVERSDFFQSFFEKLKHQDGIRNLRAVEDAFVPVIKFEFDGIEIDLVFARLAIQTISDNLDLRDDSRLRSLDIRCIRSLNGCRVTDEILHLVPNKETFRLTLRAVKLWAKRRGIYSNMLGFLGGVSWAMLVARTCQLYPNAAASTLVHKFFLVFSKWEWPNPVLLKQPEESNLNLPVWDPRVNPSDRYHLMPIITPAYPQQNSTYNVSTSTRTVMVEEFKQGLAVTDEILQGKSDWSKLLEPPNFFQKYRHYIVLTASASTEENHLEWVGLVESKIRVLVGNLERNEFITLAHVNPQSFPGNKEHHKDNNYVSMWFLGIIFRRVENAESVNIDLTYDIQSFTDTVYRQANNINMLKEGMKIEATHVKKKQLHHYLPAEILQKKKKQSLSDVNRSSGGLQSKRLSLDSSCLDSSRDTDNGTPFNSPASKSDSPSVGETERNSAEPAAVIVEKPLSVPPAQGLSIPVIGAKVDSTVKTVSPPTVCTIPTVVGRNVIPRITTPHNPAQGQPHLNGMSNITKTVTPKRSHSPSIDGTPKRLKDVEKFIRLESTFKDPRTAEERKRKSVDAIGGESMPIPTIDTSRKKRLPSKELPDSSSPVPANNIRVIKNSIRLTLNR

SEQ ID NO: 3340 - protein, 1791 aa, unidentified
MMCLKILRISLAILAGWALCSANSELGWTRKKSLVEREHLNQVLLEGERCWLGAKVRRPRASPQHHLFGVYPSRAGNYLRPYPVGEQEIHHTGRSKPDTEGNAVSLVPPDLTENPAGLRGAVEEPAAPWVGDSPIGQSELLGDDDAYLGNQRSKESLGEAGIQKGSAMAATTTTAIFTTLNEPKPETQRRGWAKSRQRRQVWKRRAEDGQGDSGISSHFQPWPKHSLKHRVKKSPPEESNQNGGEGSYREAETFNSQVGLPILYFSGRRERLLLRPEVLAEIPREAFTVEAWVKPEGGQNNPAIIAGVFDNCSHTVSDKGWALGIRSGKDKGKRDARFFFSLCTDRVKKATILISHSRYQPGTWTHVAATYDGRHMALYVDGTQVASSLDQSGPLNSPFMASCRSLLLGGDSSEDGHYFRGHLGTLVFWSTALPQSHFQHSSQHSSGEEEATDLVLTASFEPVNTEWVPFRDEKYPRLEVLQGFEPEPEILSPLQPPLCGQTVCDNVELISQYNGYWPLRGEKVIRYQVVNICDDEGLNPIVSEEQIRLQHEALNEAFSRYNISWQLSVHQVHNSTLRHRVVLVNCEPSKIGNDHCDPECEHPLTGYDGGDCRLQGRCYSWNRRDGLCHVECNNMLNDFDDGDCCDPQVADVRKTCFDPDSPKRAYMSVKELKEALQLNSTHFLNIYFASSVREDLAGAATWPWDKDAVTHLGGIVLSPAYYGMPGHTDTMIHEVGHVLGLYHVFKGVSERESCNDPCKETVPSMETGDLCADTAPTPKSELCREPEPTSDTCGFTRFPGAPFTNYMSYTDDNCTDNFTPNQVARMHCYLDLVYQQWTESRKPTPIPIPPMVIGQTNKSLTIHWLPPISGVVYDRASGSLCGACTEDGTFRQYVHTASSRRVCDSSGYWTPEEAVGPPDVDQPCEPSLQAWSPEVHLYHMNMTVPCPTEGCSLELLFQHPVQADTLTLWVTSFFMESSQVLFDTEILLENKESVHLGPLDTFCDIPLTIKLHVDGKVSGVKVYTFDERIEIDAALLTSQPHSPLCSGCRPVRYQVLRDPPFASGLPVVVTHSHRKFTDVEVTPGQMYQYQVLAEAGGELGEASPPLNHIHGAPYCGDGKVSERLGEECDDGDLVSGDGCSKVCELEEGFNCVGEPSLCYMYEGDGICEPFERKTSIVDCGIYTPKGYLDQWATRAYSSHEDKKKCPVSLVTGEPHSLICTSYHPDLPNHRPLTGWFPCVASENETQDDRSEQPEGSLKKEDEVWLKVCFNRPGEARAIFIFLTTDGLVPGEHQQPTVTLYLTDVRGSNHSLGTYGLSCQHNPLIINVTHHQNVLFHHTTSVLLNFSSPRVGISAVALRTSSRIGLSAPSNCISEDEGQNHQGQSCIHRPCGKQDSCPSLLLDHADVVNCTSIGPGLMKCAITCQRGFALQASSGQYIRPMQKEILLTCSSGHWDQNVSCLPVDCGVPDPSLVNYANFSCSEGTKFLKRCSISCVPPAKLQGLSPWLTCLEDGLWSLPEVYCKLECDAPPIILNANLLLPHCLQDNHDVGTICKYECKPGYYVAESAEGKVRNKLLKIQCLEGGIWEQGSCIPVVCEPPPPVFEGMYECTNGFSLDSQCVLNCNQEREKLPILCTKEGLWTQEFKLCENLQGECPPPPSELNSVEYKCEQGYGIGAVCSPLCVIPPSDPVMLPENITADTLEHWMEPVKVQSIVCTGRRQWHPDPVLVHCIQSCEPFQADGWCDTINNRAYCHYDGGDCCSSTLSSKKVIPFAADCDLDECTCRDPKAEENQ

SEQ ID NO: 3341 - protein, 311 aa, unidentified
MHQKLLKSAHYIELGSYQYWPVLVPRGIRLYTYEQIPGSLKDNPYITDGYRAYLPSRLCIKSLFILSNETVNIWSHLLGFFLFFTLGIYDMTSVLPSASASREDFVICSICLFCFQVCMLCSVGYHLFSCHRSEKTCRRWMALDYAGISIGILGCYVSGVFYAFYCNNYWRQVYLITVLAMILAVFFAQIHPNYLTQQWQRLRSIIFCSVSGYGVIPTLHWVWLNGGIGAPIVQDFAPRVIVMYMIALLAFLFYISKVPERYFPGQLNYLGSSHQIWHILAVVMLYWWHQSTVYVMQYRHSKPCPDYVSHL

SEQ ID NO: 3342 - protein, 273 aa, unidentified
MAFLAGPRLLDWASSPPHLQFNKFVLTGYRPASSGSGCLRSLFYLHNELGNIYTHGLALLGFLVLVPMTMPWGQLGKDGWLGGTHCVACLAPPAGSVLYHLFMCHQGGSAVYARLLALDMCGVCLVNTLGALPIIHCTLACRPWLRPAALVGYTVLSGVAGWRALTAPSTSARLRAFGWQAAARLLVFGARGVGLGSGAPGSLPCYLRMDALALLGGLVNVARLPERWGPGRFDYWGNSHQIMHLLSVGSILQLHAGVVPDLLWAAHHACPRD

SEQ ID NO: 3343 - protein, 330 aa, unidentified
MLSLKLPRLFSIDQIPQVFHEQGILFGYRHPQSSATACILSLFQMTNETLNIWTHLLPFWFFAWRFVTALYMTDIKNDSYSWPMLVYMCTSCVYPLVSSCAHTFSSMSKNARHICYFLDYGAVNLFSLGSAIAYSAYTFPDALMCTTFHDYYVALAVLNTILSTGLSCYSRFLEIQKPRLCKVIRVLAFAYPYTWDSLPIFYRLFLFPGESAQNEATSYHQKHMIMTLLASFLYSAHLPERLAPGRFDYIGHSHQLFHVCVILATHMQMEAILLDKTLRKEWLLATSKPFSFSQIAGAILLCIIFSLSNIIYFSAALYRIPKPELHKKET

SEQ ID NO: 3344 - protein, 346 aa, unidentified
MAMAQKLSHLLPSLRQVIQEPQLSLQPEPVFTVDRAEVPPLFWKPYIYAGYRPLHQTWRFYFRTLFQQHNEAVNVWTHLLAALVLLLRLALFVETVDFWGDPHALPLFIIVLASFTYLSFSALAHLLQAKSEFWHYSFFFLDYVGVAVYQFGSALAHFYYAIEPAWHAQVQAVFLPMAAFLAWLSCIGSCYNKYIQKPGLLGRTCQEVPSVLAYALDISPVVHRIFVSSDPTTDDPALLYHKCQVVFFLLAAAFFSTFMPERWFPGSCHVFGQGHQLFHIFLVLCTLAQLEAVALDYEARRPIYEPLHTHWPHNFSGLFLLTVGSSILTAFLLSQLVQRKLDQKTK

SEQ ID NO: 3345 - protein, 354 aa, unidentified
MTTAILERLSTLSVSGQQLRRLPKILEDGLPKMPCTVPETDVPQLFREPYIRTGYRPTGHEWRYYFFSLFQKHNEVVNVWTHLLAALAVLLRFWAFAEAEALPWASTHSLPLLLFILSSITYLTCSLLAHLLQSKSELSHYTFYFVDYVGVSVYQYGSALAHFFYSSDQAWYDRFWLFFLPAAAFCGWLSCAGCCYAKYRYRRPYPVMRKICQVVPAGLAFILDISPVAHRVALCHLAGCQEQAAWYHTLQILFFLVSAYFFSCPVPEKYFPGSCDIVGHGHQIFHAFLSICTLSQLEAILLDYQGRQEIFLQRHGPLSVHMACLSFFFLAACSAATAALLRHKVKARLTKKDS

SEQ ID NO: 3346 - protein, 377 aa, unidentified
MPRRLQPRGAGTKGPPAPAPAASGAARNSHSAASRDPPASAKPLLRWDEVPDDFVECFILSGYRRLPCTAQECLASVLKPTNETLNFWTHFIPLLLFLSKFCRLFFLSGGDVPFHHPWLLPLWCYASGVLLTFAMSCTAHVFSCLSLRLRAAFFYLDYASISYYGFGSTVAYYYYLLPGLSLLDARVMTPYLQQRLGWHVDCTRLIAAYRALVLPVAFVLAVACTVACCKSRTDWCTYPFALRTFVFVMPLSMACPIMLESWLFDLRGENPTLFVHFYRRYFWLVVAAFFNVSKIPERIQPGLFDIIGHSHQLFHIFTFLSIYDQVYYVEEGLRQFLQAPPAAPTFSGTVGYMLLLVVCLGLVIRKFLNSSEFCSKK

SEQ ID NO: 3347 - protein, 379 aa, unidentified
MAWRGWAQRGWGCGQAWGASVGGRSCEELTAVLTPPQLLGRRFNFFIQQKCGFRKAPRKVEPRRSDPGTSGEAYKRSALIPPVEETVFYPSPYPIRSLIKPLFFTVGFTGCAFGSAAIWQYESLKSRVQSYFDGIKADWLDSIRPQKEGDFRKEINKWWNNLSDGQRTVTGIIAANVLVFCLWRVPSLQRTMIRYFTSNPASKVLCSPMLLSTFSHFSLFHMAANMYVLWSFSSSIVNILGQEQFMAVYLSAGVISNFVSYVGKVATGRYGPSLGASGAIMTVLAAVCTKIPEGRLAIIFLPMFTFTAGNALKAIIAMDTAGMILGWKFFDHAAHLGGALFGIWYVTYGHELIWKNREPLVKIWHEIRTNGPKKGGGSK

SEQ ID NO: 3348 - protein, 310 aa, unidentified
MVYKTLFALCILTAGWRVQSLPTSAPLSVSLPTNIVPPTTIWTSSPQNTDADTASPSNGTHNNSVLPVTASAPTSLLPKNISIESREEEITSPGSNWEGTNTDPSPSGFSSTSGGVHLTTTLEEHSSGTPEAGVAATLSQSAAEPPTLISPQAPASSPSSLSTSPPEVFSASVTTNHSSTVTSTQPTGAPTAPESPTEESSSDHTPTSHATAEPVPQEKTPPTTVSGKVMCELIDMETTTTFPRVIMQEVEHALSSGSIAAITVTVIAVVLLVFGVAAYLKIRHSSYGRLLDDHDYGSWGNYNNPLYDDS

SEQ ID NO: 3349 - protein, 322 aa, unidentified
MQPSGWAAAREAAGRDMLAADLRCSLFASALQSYKRDSVLRPFPASYARGDCKDFEALLADASKLPNLKELLQSSGDNHKRAWDLVSWILSSKVLTIHSAGKAEFEKIQKLTGAPHTPVPAPDFLFEIEYFDPANAKFYETKGERDLIYAFHGSRLENFHSIIHNGLHCHLNKTSLFGEGTYLTSDLSLALIYSPHGHGWQHSLLGPILSCVAVCEVIDHPDVKCQTKKKDSKEIDRRRARIKHSEGGDIPPKYFVVTNNQLLRVKYLLVYSQKPPKRASSQLSWFSSHWFTVMISLYLLLLLIVSVINSSAFQHFWNRAKR

SEQ ID NO: 3350 - protein, 372 aa, unidentified
MATSPQKSPSVPKSPTPKSPPSRKKDDSFLGKLGGTLARRKKAKEVSELQEEGMNAINLPLSPIPFELDPEDTMLEENEVRTMVDPNSRSDPKLQELMKVLIDWINDVLVGERIIVKDLAEDLYDGQVLQKLFEKLESEKLNVAEVTQSEIAQKQKLQTVLEKINETLKLPPRSIKWNVDSVHAKSLVAILHLLVALSQYFRAPIRLPDHVSIQVVVVQKREGILQSRQIQEEITGNTEALSGRHERDAFDTLFDHAPDKLNVVKKTLITFVNKHLNKLNLEVTELETQFADGVYLVLLMGLLEGYFVPLHSFFLTPDSFEQKVLNVSFAFELMQDGGLEKPKPRPEDIVNCDLKSTLRVLYNLFTKYRNVE

SEQ ID NO: 3351 - protein, 364 aa, unidentified
MSSAPRSPTPRPRRMKKDESFLGKLGGTLARKRRAREVSDLQEEGKNAINSPMSPALVDVHPEDTQLEENEERTMIDPTSKEDPKFKELVKVLLDWINDVLVEERIIVKQLEEDLYDGQVLQKLLEKLAGCKLNVAEVTQSEIGQKQKLQTVLEAVHDLLRPRGWALRWSVDSIHGKNLVAILHLLVSLAMHFRAPIRLPEHVTVQVVVVRKREGLLHSSHISEELTTTTEMMMGRFERDAFDTLFDHAPDKLSVVKKSLITFVNKHLNKLNLEVTELETQFADGVYLVLLMGLLEDYFVPLHHFYLTPESFDQKVHNVSFAFELMLDGGLKKPKARPEDVVNLDLKSTLRVLYNLFTKYKNVE

SEQ ID NO: 3352 - protein, 331 aa, unidentified
MEPEFLYDLLQLPKGVEPPAEEELSKGGKKKYLPPTSRKDPKFEELQKVLMEWINATLLPEHIVVRSLEEDMFDGLILHHLFQRLAALKLEAEDIALTATSQKHKLTVVLEAVNRSLQLEEWQAKWSVESIFNKDLLSTLHLLVALAKRFQPDLSLPTNVQVEVITIESTKSGLKSEKLVEQLTEYSTDKDEPPKDVFDELFKLAPEKVNAVKEAIVNFVNQKLDRLGLSVQNLDTQFADGVILLLLIGQLEGFFLHLKEFYLTPNSPAEMLHNVTLALELLKDEGLLSCPVSPEDIVNKDAKSTLRVLYGLFCKHTQKAHRDRTPHGAPN

SEQ ID NO: 3353 - protein, 422 aa, unidentified [sequence omitted]

SEQ ID NO: 3354 - protein, 731 aa, unidentified
MASCPDSDNSWVLAGSESLPVETLGPASRMDPESERALQAPHSPSKTDGKELAGTMDGEGTLFQTESPQSGSILTEETEVKGTLEGDVCGVEPPGPGDTVVQGDLQETTVVTGLGPDTQDLEGQSPPQSLPSTPKAAWIREEGRCSSSDDDTDVDMEGLRRRRGREAGPPQPMVPLAVENQAGGEGAGGELGISLNMCLLGALVLLGLGVLLFSGGLSESETGPMEEVERQVLPDPEVLEAVGDRQDGLREQLQAPVPPDSVPSLQNMGLLLDKLAKENQDIRLLQAQLQAQKEELQSLMHQPKGLEEENAQLRGALQQGEAFQRALESELQQLRARLQGLEADCVRGPDGVCLSGGRGPQGDKAIREQGPREQEPELSFLKQKEQLEAEAQALRQELERQRRLLGSVQQDLERSLQDASRGDPAHAGLAELGHRLAQKLQGLENWGQDPGVSANASKAWHQKSHFQNSREWSGKEKWWDGQRDRKAEHWKHKKEESGRERKKNWGGQEDREPAGRWKEGRPRVEESGSKKEGKRQGPKEPPRKSGSFHSSGEKQKQPRWREGTKDSHDPLPSWAELLRPKYRAPQGCSGVDECARQEGLTFFGTELAPVRQQELASLLRTYLARLPWAGQLTKELPLSPAFFGEDGIFRHDRLRFRDFVDALEDSLEEVAVQQTGDDDEVDDFEDFIFSHFFGDKALKKRSGKKDKHSQSPRAAGPREGHSHSHHHHHRG

SEQ ID NO: 3355 - protein, 1060 aa, unidentified
MDSGAGGRRCPEAALLILGPPRMEHLRHSPGPGGQRLLLPSMLLALLLLLAPSPGHATRVVYKVPEEQPPNTLIGSLAADYGFPDVGHLYKLEVGAPYLRVDGKTGDIFTTETSIDREGLRECQNQLPGDPCILEFEVSITDLVQNGSPRLLEGQIEVQDINDNTPNFASPVITLAIPENTNIGSLFPIPLASDRDAGPNGVASYELQAGPEAQELFGLQVAEDQEEKQPQLIVMGNLDRERWDSYDLTIKVQDGGSPPRASSALLRVTVLDTNDNAPKFERPSYEAELSENSPIGHSVIQVKANDSDQGANAEIEYTFHQAPEVVRRLLRLDRNTGLITVQGPVDREDLSTLRFSVLAKDRGTNPKSARAQVVVTVKDMNDNAPTIEIRGIGLVTHQDGMANISEDVAEETAVALVQVSDRDEGENAAVTCVVAGDVPFQLRQASETGSDSKKKYFLQTTTPLDYEKVKDYTIEIVAVDSGNPPLSSTNSLKVQVVDVNDNAPVFTQSVTEVAFPENNKPGEVIAEITASDADSGSNAELVYSLEPEPAAKGLFTISPETGEIQVKTSLDREQRESYELKVVAADRGSPSLQGTATVLVNVLDCNDNDPKFMLSGYNFSVMENMPALSPVGMVTVIDGDKGENAQVQLSVEQDNGDFVIQNGTGTILSSLSFDREQQSTYTFQLKAVDGGVPPRSAYVGVTINVLDENDNAPYITAPSNTSHKLLTPQTRLGETVSQVAAEDFDSGVNAELIYSIAGGNPYGLFQIGSHSGAITLEKEIERRHHGLHRLVVKVSDRGKPPRYGTALVHLYVNETLANRTLLETLLGHSLDTPLDIDIAGDPEYERSKQRGNILFGVVAGVVAVALLIALAVLVRYCRQREAKSGYQAGKKETKDLYAPKPSGKASKGNKSKGKKSKSPKPVKPVEDEDEAGLQKSLKFNLMSDAPGDSPRIHLPLNYPPGSPDLGRHYRSNSPLPSIQLQPQSPSASKKHQVVQDLPPANTFVGTGDTTSTGSEQYSDYSYRTNPPKYPSKQVGQPFQLSTPQPLPHPYHGAIWTEVWE

SEQ ID NO: 3356 - protein, 1040 aa, unidentified
MIVLLLFALLWMVEGVFSQLHYTVQEEQEHGTFVGNIAEDLGLDITKLSARGFQTVPNSRTPYLDLNLETGVLYVNEKIDREQICKQSPSCVLHLEVFLENPLELFQVEIEVLDINDNPPSFPEPDLTVEISESATPGTRFPLESAFDPDVGTNSLRDYEITPNSYFSLDVQTQGDGNRFAELVLEKPLDREQQAVHRYVLTAVDGGGGGGVGEGGGGGGGAGLPPQQQRTGTALLTIRVLDSNDNVPAFDQPVYTVSLPENSPPGTLVIQLNATDPDEGQNGEVVYSFSSHISPRARELFGLSPRTGRLEVSGELDYEESPVYQVYVQAKDLGPNAVPAHCKVLVRVLDANDNAPEISFSTVKEAVSEGAAPGTVVALFSVTDRDSEENGQVQCELLGDVPFRLKSSFKNYYTIVTEAPLDREAGDSYTLTVVARDRGEPALSTSKSIQVQVSDVNDNAPRFSQPVYDVYVTENNVPGAYIYAVSATDRDEGANAQLAYSILECQIQGMSVFTYVSINSENGYLYALRSFDYEQLKDFSFQVEARDAGSPQALAGNATVNILIVDQNDNAPAIVAPLPGRNGTPAREVLPRSAEPGYLLTRVAAVDADDGENARLTYSIVRGNEMNLFRMDWRTGELRTARRVPAKRDPQRPYELVIEVRDHGQPPLSSTATLVVQLVDGAVEPQGGGGSGGGGSGEHQRPSRSGGGETSLDLTLILIIALGSVSFIFLLAMIVLAVRCQKEKKLNIYTCLASDCCLCCCCCGGGGSTCCGRQARARKKKLSKSDIMLVQSSNVPSNPAQVPIEESGGFGSHHHNQNYCYQVCLTPESAKTDLMFLKPCSPSRSTDTEHNPCGAIVTGYTDQQPDIISNGSILSNETKHQRAELSYLVDRPRRVNSSAFQEADIVSSKDSGHGDSEQGDSDHDATNRAQSAGMDLFSNCTEECKALGHSDRCWMPSFVPSDGRQAADYRSNLHVPGMDSVPDTEVFETPEAQPGAERSFSTFGKEKALHSTLERKELDGLLTNTRAPYKPPYLTRKRIC

SEQ ID NO: 3357 - protein, 1347 aa, unidentified
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRPPMKEVVRSCTPMKESTTMEIWIHPQPQRKSEGKVAGKSQRRVTFHLPEGSQESSSDGGLGDHDAGSLTSTSHGLPLGYPQEEYFDRATPSNRTEGDGNSDPESTFIPGLKKAAEITVQPTVEEASDNCTQECLIYGHSDACWMPASLDHSSSSQAQASALCHSPPLSQASTQHHSPRVTQTIALCHSPPVTQTIALCHSPPPIQVSALHHSPPLVQATALHHSPPSAQASALCYSPPLAQAAAISHSSPLPQVIALHRSQAQSSVSLQQGWVQGADGLCSVDQGVQGSATSQFYTMSERLHPSDDSIKVIPLTTFTPRQQARPSRGDSPIMEEHPL

SEQ ID NO: 3358 - protein, 1340 aa, unidentified
MFRVGFLIISSSSSLSPLLLVSVVRVNTTNCHKCLLSGTYIFAVLLVCVVFHSGAQEKNYTIREEIPENVLIGNLLKDLNLSLIPNKSLTTTMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLENAAYLDYESTKEYAIKLLAADAGKPPLNQSAMLFIKVKDENDNAPVFTQSFVTVSIPENNSPGIQLMKVSATDADSGPNAEINYLLGPDAPPEFSLDRRTGMLTVVKKLDREKEDKYLFTILAKDNGVPPLTSNVTVFVSIIDQNDNSPVFTHNEYKFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPYNYSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSIEAPVTPNTEIADVSSPTSDYVKILVAAVAGTITVVVVIFITAVVRCRQAPHLKAAQKNMQNSEWATPNPENRQMIMMKKKKKKKKHSPKNLLLNVVTIEETKADDVDSDGNRVTLDLPIDLEEQTMGKYNWVTTPTTFKPDSPDLARHYKSASPQPAFQIQPETPLNLKHHIIQELPLDNTFVACDSISNCSSSSSDPYSVSDCGYPVTTFEVPVSVHTRPSQRRVTFHLPEGSQESSSDGGLGDHDAGSLTSTSHGLPLGYPQEEYFDRATPSNRTEGDGNSDPESTFIPGLKKEITVQPTVEEASDNCTQECLIYGHSDACWMPASLDHSSSSQAQASALCHSPPLSQASTQHHSPPVTQTIVLCHSPPVTQTIALCHSPPPIQVSALHHSPPLVQGTALHHSPPSAQASALCYSPPLAQAAAISHSSSLPQVIALHRSQAQSSVSLQQGWVQGANGLCSVDQGVQGSATSQFYTMSERLHPSDDSIKVIPLTTFAPRQQARPSRGDSPIMETHPL

SEQ ID NO: 3359 - protein, 1184 aa, unidentified
MMQLLQLLLGLLGPGGYLFLLGDCQEVTTLTVKYQVSEEVPSGTVIGKLSQELGREERRRQAGAAFQVLQLPQALPIQVDSEEGLLSTGRRLDREQLCRQWDPCLVSFDVLATGDLALIHVEIQVLDINDHQPRFPKGEQELEISESASLRTRIPLDRALDPDTGPNTLHTYTLSPSEHFALDVIVGPDETKHAELIVVKELDREIHSFFDLVLTAYDNGNPPKSGTSLVKVNVLDSNDNSPAFAESSLALEIQEDAAPGTLLIKLTATDPDQGPNGEVEFFLSKHMPPEVLDTFSIDAKTGQVILRRPLDYEKNPAYEVDVQARDLGPNPIPAHCKVLIKVLDVNDNIPSIHVTWASQPSLVSEALPKDSFIALVMADDLDSGHNGLVHCWLSQELGHFRLKRTNGNTYMLLTNATLDREQWPKYTLTLLAQDQGLQPLSAKKQLSIQISDINDNAPVFEKSRYEVSTRENNLPSLHLITIKAHDADLGINGKVSYRIQDSPVAHLVAIDSNTGEVTAQRSLNYEEMAGFEFQVIAEDSGQPMLASSVSVWVSLLDANDNAPEVVQPVLSDGKASLSVLVNASTGHLLVPIETPNGLGPAGTDTPPLATHSSRPFLLTTIVARDADSGANGEPLYSIRSGNEAHLFILNPHTGQLFVNVTNASSLIGSEWELEIVVEDQGSPPLQTRALLRVMFVTSVDHLRDSARKPGALSMSMLTVICLAVLLGIFGLILALFMSICRTEKKDNRAYNCREAESTYRQQPKRPQKHIQKADIHLVPVLRGQAGEPCEVGQSHKDVDKEAMMEAGWDPCLQAPFHLTPTLYRTLRNQGNQGAPAESREVLQDTVNLLFNHPRQRNASRENLNLPEPQPATGQPRSRPLKVAGSPTGRLAGDQGSEEAPQRPPASSATLRRQRHLNGKVSPEKESGPRQILRSLVRLSVAAFAERNPVEELTVDSPPVQQISQLLSLLHQGQFQPKPNHRGNKYLAKPGGSRSAIPDTDGPSARAGGQTDPEQEEGPLDPEEDLSVKQLLEEELSSLLDPSTGLALDRLSAPDPAWMARLSLPLTTNYRDNVISPDAAATEEPRTFQTFGKAEAPELSPTGTRLASTFVSEMSSLLEMLLEQRSSMPVEAASEALRRLSVCGRTLSLDLATSAASGMKVQGDPGGKTGTEGKSRGSSSSSRCL

SEQ ID NO: 3360 - protein, 1955 aa, unidentified
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSILFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 3361 - protein, 1159 aa, unidentified
MYLSICCCFLLWAPALTLKNLNYSVPEEQGAGTVIGNIGRDARLQPGLPPAERGGGGRSKSGSYRVLENSAPHLLDVDADSGLLYTKQRIDRESLCRHNAKCQLSLEVFANDKEICMIKVEIQDINDNAPSFSSDQIEMDISENAAPGTRFPLTSAHDPDAGENGLRTYLLTRDDHGLFGLDVKSRGDGTKFPELVIQKALDREQQNHHTLVLTALDGGEPPRSATVQINVKVIDSNDNSPVFEAPSYLVELPENAPLGTVVIDLNATDADEGPNGEVLYSFSSYVPDRVRELFSIDPKTGLIRVKGNLDYEENGMLEIDVQARDLGPNPIPAHCKVTVKLIDRNDNAPSIGFVSVRQGALSEAAPPGTVIALVRVTDRDSGKNGQLQCRVLGGGGTGGGGGLGGPGGSVPFKLEENYDNFYTVVTDRPLDRETQDEYNVTIVARDGGSPPLNSTKSFAIKILDENDNPPRFTKGLYVLQVHENNIPGEYLGSVLAQDPDLGQNGTVSYSILPSHIGDVSIYTYVSVNPTNGAIYALRSFNFEQTKAFEFKVLAKDSGAPAHLESNATVRVTVLDVNDNAPVIVLPTLQNDTAELQVPRNAGLGYLVSTVRALDSDFGESGRLTYEIVDGNDDHLFEIDPSSGEIRTLHPFWEDVTPVVELVVKVTDHGKPTLSAVAKLIIRSVSGSLPEGVPRVNGEQHHWDMSLPLIVTLSTISIILLAAMITIAVKCKRENKEIRTYNCRIAEYSHPQLGGGKGKKKKINKNDIMLVQSEVEERNAMNVMNVVSSPSLATSPMYFDYQTRLPLSSPRSEVMYLKPASNNLTVPQGHAGCHTSFTGQGTNASETPATRMSIIQTDNFPAEPNYMGSRQQFVQSSSTFKDPERASLRDSGHGDSDQADSDQDTNKGSCCDMSVREALKMKTTSTKSQPLEQEPEECVNCTDECRVLGHSDRCWMPQFPAANQAENADYRTNLFVPTVEANVETETYETVNPTGKKTFCTFGKDKREHTILIANVKPYLKAKRALSPLLQEVPSASSSPTKACIEPCTSTKGSLDGCEAKPGALAEASSQYLPTDSQYLSPSKQPRDPPFMASDQMARVFADVHSRASRDSSEMGAVLEQLDHPNRDLGRESVDAEEVVREIDKLLQDCRGNDPVAVRK

SEQ ID NO: 3362 - protein, 1135 aa, unidentified
MHQMNAKMHFRFVFALLIVSFNHDVLGKNLKYRIYEEQRVGSVIARLSEDVADVLLKLPNPSTVRFRAMQRGNSPLLVVNEDNGEISIGATIDREQLCQKNLNCSIEFDVITLPTEHLQLFHIEVEVLDINDNSPQFSRSLIPIEISESAAVGTRIPLDSAFDPDVGENSLHTYSLSANDFFNIEVRTRTDGAKYAELIVVRELDRELKSSYELQLTASDMGVPQRSGSSILKISISDSNDNSPAFEQQSYIIQLLENSPVGTLLLDLNATDPDEGANGKIVYSFSSHVSPKIMETFKIDSERGHLTLFKQVDYEITKSYEIDVQAQDLGPNSIPAHCKIIIKVVDVNDNKPEININLMSPGKEEISYIFEGDPIDTFVALVRVQDKDSGLNGEIVCKLHGHGHFKLQKTYENNYLILTNATLDREKRSEYSLTVIAEDRGTPSLSTVKHFTVQINDINDNPPHFQRSRYEFVISENNSPGAYITTVTATDPDLGENGQVTYTILESFILGSSITTYVTIDPSNGAIYALRIFDHEEVSQITFVVEARDGGSPKQLVSNTTVVLTIIDENDNVPVVIGPALRNNTAEITIPKGAESGFHVTRIRAIDRDSGVNAELSCAIVAGNEENIFIIDPRSCDIHTNVSMDSVPYTEWELSVIIQDKGNPQLHTKVLLKCMIFEYAESVTSTAMTSVSQASLDVSMIIIISLGAICAVLLVIMVLFATRCNREKKDTRSYNCRVAESTYQHHPKRPSRQIHKGDITLVPTINGTLPIRSHHRSSPSSSPTLERGQMGSRQSHNSHQSLNSLVTISSNHVPENFSLELTHATPAVEQVSQLLSMLHQGQYQPRPSFRGNKYSRSYRYALQDMDKFSLKDSGRGDSEAGDSDYDLGRDSPIDRLLGEGFSDLFLTDGRIPAAMRLCTEECRVLGHSDQCWMPPLPSPSSDYRSNMFIPGEEFPTQPQQQHPHQSLEDDAQPADSGEKKKSFSTFGKDSPNDEDTGDTSTSSLLSEMSSVFQRLLPPSLDTYSECSEVDRSNSLERRKGPLPAKTVGYPQGVAAWAASTHFQNPTTNCGPPLGTHSSVQPSSKWLPAMEEIPENYEEDDFDNVLNHLNDGKHELMDASELVAEINKLLQDVRQS

SEQ ID NO: 3363 - protein, 1148 aa, unidentified
MESLLLPVLLLLAILWTQAAALINLKYSVEEEQRAGTVIANVAKDAREAGFALDPRQASAFRVVSNSAPHLVDINPSSGLLVTKQKIDRDLLCRQSPKCIISLEVMSSSMEICVIKVEIKDLNDNAPSFPAAQIELEISEAASPGTRIPLDSAYDPDSGSFGVQTYELTPNELFGLEIKTRGDGSRFAELVVEKSLDRETQSHYSFRITALDGGDPPRLGTVGLSIKVTDSNDNNPVFSESTYAVSVPENSPPNTPVIRLNASDPDEGTNGQVVYSFYGYVNDRTRELFQIDPHSGLVTVTGALDYEEGHVYELDVQAKDLGPNSIPAHCKVTVSVLDTNDNPPVINLLSVNSELVEVSESAPPGYVIALVRVSDRDSGLNGRVQCRLLGNVPFRLQEYESFSTILVDGRLDREQHDQYNLTIQARDGGVPMLQSAKSFTVLITDENDNHPHFSKPYYQVIVQENNTPGAYLLSVSARDPDLGLNGSVSYQIVPSQVRDMPVFTYVSINPNSGDIYALRSFNHEQTKAFEFKVLAKDGGLPSLQSNATVRVIILDVNDNTPVITAPPLINGTAEVYIPRNSGIGYLVTVVKAEDYDEGENGRVTYDMTEGDRGFFEIDQVNGEVRTTRTFGESSKSSYELIVVAHDHGKTSLSASALVLIYLSPALDAQESMGSVNLSLIFIIALGSIAGILFVTMIFVAIKCKRDNKEIRTYNCSNCLTITCLLGCFIKGQNSKCLHCISVSPISEEQDKKTEEKVSLRGKRIAEYSYGHQKKSSKKKKISKNDIRLVPRDVEETDKMNVVSCSSLTSSLNYFDYHQQTLPLGCRRSESTFLNVENQNTRNTSANHIYHHSFNSQGPQQPDLIINGVPLPETENYSFDSNYVNSRAHLIKSSSTFKDLEGNSLKDSGHEESDQTDSEHDVQRSLYCDTAVNDVLNTSVTSMGSQMPDHDQNEGFHCREECRILGHSDRCWMPRNPMPIRSKSPEHVRNIIALSIEATAADVEAYDDCGPTKRTFATFGKDVSDHPAEERPTLKGKRTVDVTICSPKVNSVIREAGNGCEAISPVTSPLHLKSSLPTKPSVSYTIALAPPARDLEQYVNNVNNGPTRPSEAEPRGADSEKVMHEVSPILKEGRNKESPGVKRLKDIVL

SEQ ID NO: 3364 - protein, 1069 aa, unidentified
MLRMRTAGWARGWCLGCCLLLPLSLSLAAAKQLLRYRLAEEGPADVRIGNVASDLGIVTGSGEVTFSLESGSEYLKIDNLTGELSTSERRIDREKLPQCQMIFDENECFLDFEVSVIGPSQSWVDLFEGQVIVLDINDNTPTFPSPVLTLTVEENRPVGTLYLLPTATDRDFGRNGIERYELLQEPGGGGSGGESRRAGAADSAPYPGGGGNGASGGGSGGSKRRLDASEGGGGTNPGGRSSVFELQVADTPDGEKQPQLIVKGALDREQRDSYELTLRVRDGGDPPRSSQAILRVLITDVNDNSPRFEKSVYEADLAENSAPGTPILQLRAADLDVGVNGQIEYVFGAATESVRRLLRLDETSGWLSVLHRIDREEVNQLRFTVMARDRGQPPKTDKATVVLNIKDENDNVPSIEIRKIGRIPLKDGVANVAEDVLVDTPIALVQVSDRDQGENGVVTCTVVGDVPFQLKPASDTEGDQNKKKYFLHTSTPLDYEATREFNVVIVAVDSGSPSLSSNNSLIVKVGDTNDNPPMFGQSVVEVYFPENNIPGERVATVLATDADSGKNAEIAYSLDSSVMGIFAIDPDSGDILVNTVLDREQTDRYEFKVNAKDKGIPVLQGSTTVIVQVADKNDNDPKFMQDVFTFYVKENLQPNSPVGMVTVMDADKGRNAEMSLYIEENNNIFSIENDTGTIYSTMSFDREHQTTYTFRVKAVDGGDPPRSATATVSLFVMDENDNAPTVTLPKNISYTLLPPSSNVRTVVATVLATDSDDGINADLNYSIVGGNPFKLFEIDPTSGVVSLVGKLTQKHYGLHRLVVQVNDSGQPSQSTTTLVHVFVNESVSNATAIDSQIARSLHIPLTQDIAGDPSYEISKQRLSIVIGVVAGIMTVILIILIVVMARYCRSKNKNGYEAGKKDHEDFFTPQQHDKSKKPKKDKKNKKSKQPLYSSIVTVEASKPNGQRYDSVNEKLSDSPSMGRYRSVNGGPGSPDLARHYKSSSPLPTVQLHPQSPTAGKKHQAVQDLPPANTFVGAGDNISIGSDHCSEYSCQTNNKYSKQMRLHPYITVFG

SEQ ID NO: 3365 - protein, 1070 aa, unidentified
MSPVRRWGSPCLFPLQLFSLCWVLSVAQSKTVRYSTFEEDAPGTVIGTLAEDLHMKVSGDTSFRLMKQFNSSLLRVREGDGQLTVGDAGLDRERLCGQAPQCVLAFDVVSFSQEQFRLVHVEVEVRDVNDHAPRFPRAQIPVEVSEGAAVGTRIPLEVPVDEDVGANGLQTVRLAEPHSPFRVELQTRADGAQCADLVLLQELDRESQAAYSLELVAQDGGRPPRSATAALSVRVLDANDHSPAFPQGAVAEVELAEDAPVGSLLLDLDAADPDEGPNGDVVFAFGARTPPEARRLFRLDPRSGRLTLAGPVDYERQDTYELDVRAQDRGPGPRAATCKVIVRIRDVNDNAPDIAITPLAAPGAPATSPFAAAAAAAALGGADASSPAGAGTPEAGATSLVPEGAARESLVALVSTSDRDSGANGQVRCALYGHEHFRLQPAYAGSYLVVTAASLDRERIAEYNLTLVAEDRGAPPLRTVRPYTVRVGDENDNAPLFTRPVYEVSVRENNPPGAYLATVAARDRDLGRNGQVTYRLLEAEVGRAGGAVSTYVSVDPATGAIYALRSFDYETLRQLDVRIQASDGGSPQLSSSALVQVRVLDQNDHAPVLVHPAPANGSLEVAVPGRTAKDTVVARVQARDADEGANGELAFELQQQEPREAFAIGRRTGEILLTGDLSQEPPGRVFRALLVISDGGRPPLTTTATVSFVVTAGGGRGPAAPASAGSPERSRPPGSRLGVSGSVLQWDTPLIVIIVLAGSCTLLLAAIIAIATTCNRRKKEVRKGGALREERPGAAGGGASAPGSPEEAARGAGPRPNMFDVLTFPGTGKAPFGSPAADAPPPAVAAAEVPGSEGGSATGESACHFEGQQRLRGAHAEPYGASPGFGKEPAPPVAVWKGHSFNTISGREAEKFSGKDSGKGDSDFNDSDSDISGDALKKDLINHMQSGLWACTAECKILGHSDRCWSPSCSGPNAHPSPHPPAQMSTFCKSTSLPRDPLRRDNYYQAQLPKTVGLQSVYEKVLHRDYDRTVTLLSPPRPGRLPDLQEIGVPLYQSPPGRYLSPKKGANENV

SEQ ID NO: 3366 - protein, 1237 aa, unidentified
MDLRDFYLLAALIACLRLDSAIAQELIYTIREELPENVPIGNIPKDLNISHINAATGTSASLVYRLVSKAGDAPLVKVSSSTGEIFTTSNRIDREKLCAGASYAEENECFFELEVVILPNDFFRLIKIKIIVKDTNDNAPMFPSPVINISIPENTLINSRFPIPSATDPDTGFNGVQHYELLNGQSVFGLDIVETPEGEKWPQLIVQQNLDREQKDTYVMKIKVEDGGTPQKSSTAILQVTVSDVNDNRPVFKEGQVEVHIPENAPVGTSVIQLHATDADIGSNAEIRYIFGAQVAPATKRLFALNNTTGLITVQRSLDREETAIHKVTVLASDGSSTPARATVTINVTDVNDNPPNIDLRYIISPINGTVYLSEKDPVNTKIALITVSDKDTDVNGKVICFIEREVPFHLKAVYDNQYLLETSSLLDYEGTKEFSFKIVASDSGKPSLNQTALVRVKLEDENDNPPIFNQPVIELSVSENNRRGLYLTTISATDEDSGKNADIVYQLGPNASFFDLDRKTGVLTASRVFDREEQERFIFTVTARDNGTPPLQSQAAVIVTVLDENDNSPKFTHNHFQFFVSENLPKYSTVGVITVTDADAGENKAVTLSILNDNDNFVLDPYSGVIKSNVSFDREQQSSYTFDVKATDGGQPPRSSTAKVTINVMDVNDNSPVVISPPSNTSFKLVPLSAIPGSVVAEVFAVDVDTGMNAELKYTIVSGNNKGLFRIDPVTGNITLEEKPAPTDVGLHRLVVNISDLGYPKSLHTLVLVFLYVNDTAGNASYIYDLIRRTMETPLDRNIGDSSQPYQNEDYLTIMIAIIAGAMVVIVVIFVTVLVRCRHASRFKAAQRSKQGAEWMSPNQENKQNKKKKRKKRKSPKSSLLNFVTIEESKPDDAVHEPINGTISLPAELEEQSIGRFDWGPAPPTTFKPNSPDLAKHYKSASPQPAFHLKPDTPVSVKKHHVIQELPLDNTFVGGCDTLSKRSSTSSDHFSASECSSQGGFKTKGPLHTRQCNSHSKSDNIPVTPQKCPSSTGFHIQENEESHYESQRRVTFHLPDGSQESCSDSGLGDHEPVGSGTLISHPLPLVQPQDEFYDQASPDKRTEADGNSDPNSDGPLGPRGLAEATEMCTQECLVLGHSDNCWMPPGLGPYQHPKSPLSTFAPQKEWVKKDKLVNGHTLTRAWKEDSNRNQFNDRKQYGSNEGHFNNGSHMTDIPLANLKSYKQAGGATESPKEHQL

SEQ ID NO: 3367 - protein, 950 aa, unidentified
MVFSRRGGLGARDLLLWLLLLAAWEVGSGQLHYSIPEEAKHGTFVGRVAQDLGLELAELVPRLFRVASKTHRDLLEVNLQNGILFVNSRIDREELCQWSAECSIHLELIADRPLQVFHVEVKVKDINDNPPVFRGREQIIFIPESRLLNSRFPIEGAADADIGANALLTYTLSPSDYFSLDVEASDELSKSLWLELRKYLDREETPELHLLLTATDGGKPELQGTVELLITVLDVNDNAPLFDQAVYRVHLLETTANGTLVTTLNASDADEGVNGEVVFSFDSGISRDIQEKFKVDSSSGEIRLIDKLDYEETKSYEIQVKAVDKGSPPMSNHCKVLVKVLDVNDNAPELAVTSLYLPIREDAPLSTVIALITVSDRDSGANGQVTCSLMPHVPFKLVSTFKNYYSLVLDSALDRESLSVYELVVTARDGGSPSLWATARVSVEVADVNDNAPAFAQPEYTVFVKENNPPGCHIFTVSARDADAQENALVSYSLVERRVGERALSNYVSVHAESGKVYALQPLDHEELELLQFQVSARDAGVPPLGSNVTLQVFVLDENDNAPALLAPRVGGTIGAVSELVPRLVGAGHVVAKVRAVDADSGYNAWLSYELQPAAGGARIPFRVGLYTGEISTTRVLDEADLSRYRLLVLVKDHGEPALTATATVLVSLVESGQAPKASSRASVGVAGPEAALVDVNVYLIIAICAVSSLLVLTLLLYTALRCSVPPTEGAYVPGKPTLVCSSALGSWSNSQQRRQRVCSSEGPPKTDLMAFSPGLSPSLNTSERNEQPEANLDLSGNPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 3368 - protein, 948 aa, unidentified
MVSRCSCLGVQCLLLSLLLLAAWEVGSGQLHYSVYEEARHGTFVGRIAQDLGLELAELVQRLFRVASKRHGDLLEVNLQNGILFVNSRIDREELCGRSVECSIHLEVIVDRPLQVFHVDVEVKDINDNPPRFSVTEQKLSIPESRLLDSRFPLEGASDADVGENALLTYKLSPNEYFVLDIINKKDKDKFPVLVLRKLLDREENPQLKLLLTATDGGKPEFTGSVSLLILVLDANDNAPIFDRPVYEVKMYENQVNQTLVIRLNASDSDEGINKEMMYSFSSLVPPTIRRKFWINERTGEIKVNDAIDFEDSNTYEIHVDVTDKGNPPMVGHCTVLVELLDENDNSPEVIVTSLSLPVKEDAQVGTVIALISVSDHDSGANGQVTCSLTPHVPFKLVSTYKNYYSLVLDSALDRERVSAYELVVTARDGGSPPLWATASVSVEVADVNDNAPAFAQSEYTVFVKENNPPGCHIFTVSAWDADAQENALVSYSLVERRLGERSLSSYVSVHAESGKVYALQPLDHEELELLQFQVSARDGGVPPLGSNLTLQVFVLDENDNAPALLASPAGSAGGAVSELVLRSVVAGHVVAKVRAVDADSGYNAWLSYELQSAAVGARIPFRVGLYTGEISTTRALDETDSPRQRLLVLVKDHGEPSLTATATVLVSLVEGSQAPKASSRASVGVAPEVALVDVNVYLIIAICAVSSLLVLTLLLYTALRCSAAPTEGACGPVKPTLVCSSAVGSWSYSQQRRQRVCSGEGLPKADLMAFSPSLPPCPMVDVDGEDQSIGGDHSRKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 3369 - protein, 949 aa, unidentified
MFGFQRRGLGTPRLQLWLLLLEFWEVGSGQLHYSVSEEAKHGTFVGRIAQDLGLELAELVQRLFRVASKTHGDLLEVNLQNGILFVNSRIDREELCGQSAECSIHLEVIVDRPLQVFHVNVEVKDINDNPPVFSLREQKLLIAESKQSDSRFPLEGASDADIEENALLTYRLSKNEYFSLDSPTNGKQIKRLSLILKKSLDREKTPELNLLLTATDGGKPELTGTVRLLVQVLDVNDNDPEFDKSEYKVSLMENAAKETLVLKLNATDRDEGVNGEVTYSLMSIKPNGRHLFTLDQNNGEVRVNGTLDYEENKFYKIEVQATDKGTPPMAGHCTVWVEILDTNDNSPEVAVTSLSLPVREDAQPSTVIALISVSDRDSGVNGQVTCSLTPHVPFKLVSTFKNYYSLVLDSALDRENVWAYELVVTARDGGSPSLWATARVSVEVADVNDNAPAFAQPEYTVFVKENNPPGCHIFTVSARDADAQENALVSYSLVERRLGDRALSSYVSVHAESGKVYALQPLDHEELELLQFQVSARDAGVPPLSSNVTLQVFVLDENDNAPALLATQAGSAGGAVNKLVPRSVGAGHVVAKVRAVDADSGYNAWLSYELQPAAGGSRIPFRVGLYTGEISTTRALDEADSPRHRLLVLVKDHGEPALTATATVLVSLVESGQAPKASSRTLAGAASPEAALVDVNVYLIIAICVVSSLLVLTLLLYTALWWSATPTEGACAPGKPTLVCSRAVGSWSYSQQRRQRVCSEEGPPKTDLMAFSPSLPLGLNKEEEGERQEPGSNHPGQPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 3370 - protein, 941 aa, unidentified
MVIIGPRGPGSQRLLLSLLLLAAWEVGSGQLHYSVYEEAKHGTFVGRIAQDLGLELAELVPRLFRVASKRHGDLLEVNLQNGILFVNSRIDREKLCGRSAECSIHLEVIVDRPLQVFHVDVEVKDINDNPPVFREREQKVPVSESAPLDSHFPLEGASDADIGVNSLLTYALSLNENFELKIKTKKDKSILPELVLRKLLDREQTPKLNLLLMVIDGGKPELTGSVQIQITVLDVNDNGPAFDKPSYKVVLSENVQNDTRVIQLNASDPDEGLNGEISYGIKMILPVSEKCMFSINPDTGEIRIYGELDFEENNAYEIQVNAIDKGIPSMAGHSMVLVEVLDVNDNVPEVMVTSLSLPVQEDAQVGTVIALISVSDRDSGANGQVICSLTPHVPFKLVSTYKNYYSLVLDSALDRESVSAYELVVTARDGGSPSLWATARVSVEVADVNDNAPAFAQPEYTVFVKENNPPGCHIFTVSAWDADAQKNALVSYSLVERRVGEHALSSYVSVHAESGKVYALQPLDHEELELLQFQVSARDAGVPPLGSNVTLQVFVLDENDNAPALLATPAGSAGGAVSELVPRSVGAGHVVAKVRAVDADSGYNAWLSYELQPAAVGAHIPFHVGLYTGEISTTRILDEADAPRHRLLVLVKDHGEPALTSTATVLVSLVENGQAPKTSSRASVGAVDPEAALVDINVYLIIAICAVSSLLVLTLLLYTALRCSAPPTVSRCAPGKPTLVCSSAVGSWSYSQQRRQRVCSAESPPKTDLMAFSPSLQLSREDCLNPPSEPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 3371 - protein, 950 aa, unidentified
MLSSWQGGPRPRQLLLWLLILAAWETGSGQLHYSVPEEAKHGTFVGRIAQDLGLELAELVPRLFRVASKRHGDLLEVNLQNGILFVNSRIDREELCGRSAECSIHLEVIVDRPLQVFHVEVKVRDINDNPPIFPESKKRIIIAESRPPETRFPLDGASDADIGVNSALTYRLDPNDYFTLDAQNSLEQMSSLSLVLRKTLDREEIQEHSLLLTASDGGKPELTGTVQLLITILDVNDNAPEFYQSVYKVTVLENAFNGTLVIKLNATDPDDGTNGDIVYSFRRPVWPAVVYAFTINPNNGEIRTKGKLDFEEKKLYEISVEAVDKGNIPMAGHCTLLVEVLDVNDNAPEVTITSLSLPIREDTQPSAIIALISVSDRDSGSNGQVTCTLTPHVPFKLVSTYKNYYSLVLDSALDRESVSAYELVVTARDGGSPSLWATASVSVGVADVNDNAPAFAQPEYTVFVKENNPPGCHIFTVSAQDADAQENALVSYSLVERRVGERALSSYVSVHAESGKVYALQPLDHEELELLQFQVSARDSGVPPLGSNVTLQVFVLDENDNAPALLTPGAGSAGGTVSELMPRSVGAGHVVAKVRAVDADSGYNAWLSYELQLAAVGARIPFRVGLYTGEISTTRPLDEVDAPHHRLLVLVKDHGEPALTATATVLLSLVESGQAPQASSRASAGAVGPEAALVDVNVYLIIAICAVSSLLVLTLLLYTALRCSAPPTEGACAPGKPTLVCSSAAGSWSYSQQRRPRVCSGEGPHKTDLMAFSPSLPPCLGSAEGTGQREEDSECLKEPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 3372 - protein, 948 aa, unidentified
MASSIRRGRGAWTRLLSLLLLAAWEVGSGQLRYSVPEEAKHGTFVGRIAQDLGLELEELVPRLFRVASKRHGDLLEVNLQNGILFVNSRIDREELCGRSAECSIHVEVIVDRPLQVFHVEVEVKDINDNPPIFPMTVKTIRFPESRLLDSRFPLEGASDADIGVNALLSYKLSSSEFFFLDIQANDELSESLSLVLGKSLDREETAEVNLLLVATDGGKPELTGTVQILIKVLDVNDNEPTFAQSVYKVKLLENTANGTLVVKLNASDADEGPNSEIVYSLGSDVSSTIQTKFTIDPISGEIRTKGKLDYEEAKSYEIQVTATDKGTPSMSGHCKISLKLVDINDNTPEVSITSLSLPISENASLGTVIALITVSDRDSGTNGHVTCSLTPHVPFKLVSTFKNYYSLVLDSALDRESVSAYELVVTARDGGSPSLWATTSVSIEVADVNDNAPAFAQPEYTVFVKENNPPGCHIFTVSAWDADAQENALVSYSLVERRVGERALSSYVSVHAESGKVYALQPLDHEEVELLQFQVSARDAGVPPLGSNVTLQVFVLDENDNAPALLAPRAGTAAGAVSELVPWSVGAGHVVAKVRAVDADSGYNAWLSYELQLGTGSARIPFRVGLYTGEISTTRALDEADSPRHRLLVLVKDHGEPALTATATVLVSLVESGQAPKASSRAWVGAAGSEATLVDVNVYLIIAICAVSSLLVLTVLLYTALRCSVPPTEGARAPGKPTLVCSSAVGSWSYSQQRRQRVCSGEDPPKTDLMAFSPSLSQGPDSAEEKQLSESEYVGKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 3373 - protein, 950 aa, unidentified
MLFSWREDPGAQCLLLSLLLLAASEVGSGQLHYSVSEEAKHGTFVGRIAQDLGLELAELVPRLFRVASKRHGDLLEVNLQNGILFVNSRIDREELCGRSAECSIHLEVIVDRPLQVFHVEVEVKDINDNAPVFPMAVKNLFISESRQPGSRFSLEGASDADIGTNSLLTYSLDSTEYFTLDVKRNDEEIKSLGLVLKKNLNREDTPKHYLLITAIDGGKPELTGTTQLKITVLDVNDNAPAFERTIYKVRLLENAPNGTLVVTVNATDLDEGVNKDIAYSFNTDMSADILSKFHLDPVNGQISVKGNIDFEESKSYEIQVEATDKGNPPMSDHCTVLLEIVDINDNVPELVIQSLSLPVLEDSPLSTVIALISVSDRDSGVNGQVTCSLTPHVPFKLVSTFKNYYSLVLDSPLDRESVSAYELVVTARDGGSPSLWATASVSVEVADVNDNAPAFSQSEYTVFVKENNPPGCHIFTVSARDADAQENALVSYSLVERRVGERALSSYVSVHAESGKVYALQPLDHEELELLQFQVSARDAGVPPLGSNVTLQVFVLDENDNAPALLMPRVGGIGGAVSELVPRSVGAGHVVAKVRAVDADSGYNAWLSYELQPGTGGARIPFRVGLYTGEISTTRALDEVDAPRHRLLVLVKDHGEPSLTATATVLVSLVESGQAPKASSQASAGATGPEAALVDVNVYLIVAICAVSSLLVLTLLLYTALRCSAPPTEGDCGPGKPTLVCSSAVGSWSYSQQRQQRVCSGEGLPKTDLMAFSPSLPPCPISRDREEKQDVDVDLSAKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 3374 - protein, 947 aa, unidentified
MEFSWGSGQESRRLLLLLLLLAAWEAGNGQLHYSVSEEAKHGTFVGRIAQDLGLELAELVPRLFRVASKGRGGLLEVNLQNGILFVNSRIDREELCRRSAECSIHLEVIVDRPLQVFHVDVEVRDINDNPPVFPATQKNLSIAESRPLDSRFPLEGASDADIGENALLTYRLSPNEYFSLEKPPDDELVKGLGLILRKSLDREEAPEIFLVLTATDGGKPELTGTVQLLITVLDANDNAPAFDRTIYKVRLLENVPNGTLVIKLNASDLDEGLNGDIVYSFSNDISPNVKSKFHIDPITGQIIVKGYIDFEESKSYEIIVEGIDKGQLPLSGHCRVIVEVEDNNDNVPDLEFKSLSLPIREDAPLGTVIALISVSDKDMGVNGLVTCSLTSHVPFKLVSTFKNYYSLVLDSALDRESVSAYELVVTARDGGSPSLWATASVSVEVADVNDNAPAFAQPEYTVFVKENNPPGCHIFTVSAWDADAQENALVSYSLVERRVGERALSSYVSVHAESGKVYALQPLDHEELELLQFQVTARDAGVPPLGSNVTLQVFVLDENDNAPALLAPRAGGTGGAVSELVPWSVGVGHVVAKVRAVDADSGYNAWLSYELQPGTGGARIPFRVGLYTGEISTTRALDETDAPRHRLLVLVKDHGEPALTATATVLVSLVESGQAPKASSRALVGAVGPDAALVDVNVYLIIAICAVSSLLVLTLLLYTALRCSALPTEGACAPGKPTLVCSSAVGSWSYSQQRRPRVCSGEGPPKTDLMAFSPSLPDSRDREDQLQTTEESFAKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 3375 - protein, 936 aa, unidentified
MVYSRRGSLGSRLLLLWLLLAYWKAGSGQLHYSIPEEAKHGTFVGRIAQDLGLELAELVPRLFRVASKGRGDLLEVNLQNGILFVNSRIDREELCRRRAECSIHLEVIVDRPLQVFHVEVAVKDINDNPPRFSRQEQRLFILESRMPDSRFPLEGASDLDIGANAQLRYRLNPNEYFDLDVKTNEEETNFLELVLRKSLDREETQEHRLLVIATDGGKPELTGTVQLLINVLDANDNAPEFDKSIYNVRLLENAPSGTLVIKLNASDADEGINKEIVYFFSNLVLDDVKSKFIINSNTGEIKVNGELDYEDYNSYEINIDAMDKSTFPLSGHCKVVVKLLDVNDNTPEMAITTLFLPVKEDAPLSTVIALISVSDRDSGANGQVTCSLMPHVPFKLVSTFKNYYSLVLDSALDRESVSVYELVVTARDGGSPSLWATASVSVEVADVNDNAPAFAQPQYTVFVKENNPPGCHIFTVSARDADAQENALVSYSLVERRVGERPLSSYVSVHAESGKVYALQPLDHEEVELLQFQVSARDAGVPPLGSNVTLQVFVLDENDNAPALLVPRVGGTGGAVSELVPRSVGAGHVVAKVRAVDPDSGYNAWLSYELQPAPGSARIPFRVGLYTGEISTTRSLDETEAPRHRLLVLVKDHGEPPLTATATVLVSLVESGQAPKASSRASAGAVGPEAALVDVNVYLIIAICAVSSLLVLTLLLYTALRCSAQPTEAVCTRGKPTLLCSSAVGSWSYSQQRRQRVCSGEAPPKTDLMAFSPSLPQGPTSTDNPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 3376 - protein, 950 aa, unidentified
MVFTPEDRLGKQCLLLPLLLLAAWKVGSGQLHYSVPEEAKHGTFVGRIAQDLGLELAELVPRLFRMASKDREDLLEVNLQNGILFVNSRIDREELCGRSAECSIHLEVIVDRPLQVFHVDVEVRDINDNPPLFPVEEQRVLIYESRLPDSVFPLEGASDADVGSNSILTYKLSSSEYFGLDVKINSDDNKQIGLLLKKSLDREEAPAHNLFLTATDGGKPELTGTVQLLVTVLDVNDNAPTFEQSEYEVRIFENADNGTTVIRLNASDRDEGANGAISYSFNSLVAAMVIDHFSIDRNTGEIVIRGNLDFEQENLYKILIDATDKGHPPMAGHCTVLVRILDKNDNVPEIALTSLSLPVREDAQFGTVIALISVNDLDSGANGQVNCSLTPHVPFKLVSTFKNYYSLVLDSALDRESVSAYELVVTARDGGSPSLWATASLSVEVADMNDNAPAFAQPEYTVFVKENNPPGCHIFTVSARDADAQENALVSYSLVERRVGERALSSYISVHAESGKVYALQPLDHEELELLQFQVSARDAGVPPLGSNVTLQVFVLDENDNAPALLAPRVGGTGGAVSELVPRSLGAGQVVAKVRAVDADSGYNAWLSYELQPPASSARFPFRVGLYTGEISTTRVLDEADSPRHRLLVLVKDHGEPALTATATVLVSLVESGQAPKASSRASVGAAGPEAALVDVNVYLIIAICAVSSLLVLTLLLYTALRCSAPPTEGACTADKPTLVCSSAVGSWSYSQQRRQRVCSGEGPPKMDLMAFSPSLSPCPIMMGKAENQDLNEDHDAKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 3377 - protein, 937 aa, unidentified
MVCPNGYDPGGRHLLLFIIILAAWEAGRGQLHYSVPEEAKHGNFVGRIAQDLGLELAELVPRLFRAVCKFRGDLLEVNLQNGILFVNSRIDREELCGRSAECSIHLEVIVERPLQVFHVDVEVKDINDNPPVFPATQRNLFIAESRPLDSRFPLEGASDADIGENALLTYRLSPNEYFFLDVPTSNQQVKPLGLVLRKLLDREETPELHLLLTATDGGKPELTGTVQLLITVLDNNDNAPVFDRTLYTVKLPENVSIGTLVIHPNASDLDEGLNGDIIYSFSSDVSPDIKSKFHMDPLSGAITVIGHMDFEESRAHKIPVEAVDKGFPPLAGHCTVLVEVVDVNDNAPQLTLTSLSLPIPEDAQPGTVITLISVFDRDFGVNGQVTCSLTPRVPFKLVSTFKNYYSLVLDSALDRESVSAYELVVTARDGGSPSLWATASVSVEVADVNDNAPAFAQPEYTVFVKENNPPGCHIFTVSAGDADAQKNALVSYSLVELRVGERALSSYVSVHAESGKVYALQPLDHEELELLQFQVSARDAGVPPLGSNVTLQVFVLDENDNAPALLAPRVGGTGGAVRELVPRSVGAGHVVAKVRAVDADSGYNAWLSYELQPVAAGASIPFRVGLYTGEISTTRALDETDAPRHRLLVLVKDHGEPSLTATATVLVSLVESGQAPKASSRASLGIAGPETELVDVNVYLIIAICAVSSLLVLTLLLYTALRCSAPSSEGACSLVKPTLVCSSAVGSWSFSQQRRQRVCSGEGPPKTDLMAFSPSLPQGPSSTDNPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 3378 - protein, 950 aa, unidentified
MDYHWRGELGSWRLLLLLLLLAAWKVGSGQLHYSVPEEAKHGTFVGRIAQDLGLELAELVPRLFRVASKRHRDLLEVSLQNGILFVNSRIDREELCGRSAECSIHLEVIVDRPLQVFHVDVEVKDVNDNPPVFRVKDQKLFVSESRMPDSRFPLEGASDADVGANSVLTYRLSSHDYFMLDVNSKNDENKLVELVLRKSLDREDAPAHHLFLTATDGGKPELTGTVQLLVTVLDVNDNAPTFEQSEYEVRIFENADNGTTVIKLNASDPDEGANGAISYSFNSLVETMVIDHFSIDRNTGEIVIRGNLDFEQENLYKILIDATDKGHPPMAGHCTVLVRILDKNDNVPEIALTSLSLPVREDAQFGTVIALISVNDLDSGANGQVTCSLMPHVPFKLVSTFKNYYSLVLDSALDRERVSAYELVVTARDGGSPSLWATASLSVEVADVNDNAPAFAQPEYTVFVKENNPPGCHIFTVSARDADAQENALVSYSLVERRVGERSLSSYISVHTESGKVYALQPLDHEELELLQFQVSARDAGVPPLGSNVTLQVFVLDENDNAPALLEPRVGGTGGAASKLVPRSVGAGHVVAKVRAVDADSGYNAWLSYELQPAASSPRIPFRVGLYTGEISTTRVLDEADSPRHRLLVLVKDHGEPALTATATVLVSLVESGQAPKASSRQSAGVLGPEAALVDVNVYLIIAICAVSSLLVLTLLLYTALRCSALPTEGGCRAGKPTLVCSSAVGSWSYSQQQPQRVCSGEGPPKTDLMAFSPCLPPDLGSVDVGEEQDLNVDHGLKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 3379 - protein, 950 aa, unidentified
MLYSSRGDPEGQPLLLSLLILAMWVVGSGQLHYSVPEEAEHGTFVGRIAQDLGLELAELVPRLFQLDSKGRGDLLEVNLQNGILFVNSRIDREELCGRSAECSIHLEVIVDRPLQVFHVDVEVKDINDNPPVFPATQKNLFIAESRPLDSRFPLEGASDADIGENALLTYRLSPNEYFFLDVPTSNQQVKPLGLVLRKLLDREETPELHLLLTATDGGKPELTGTVQLLITVLDNNDNAPVFDRTLYTVKLPENVSIGTLVIHPNASDLDEGLNGDIIYSFSSDVSPDIKSKFHMDPLSGAITVIGHMDFEESRAHKIPVEAVDKGFPPLAGHCTLLVEVVDVNDNAPQLTIKTLSVPVKEDAQLGTVIALISVIDLDADANGQVTCSLTPHVPFKLVSTYKNYYSLVLDRALDRESVSAYELVVTARDGGSPSLWATARVSVEVADVNDNAPAFAQSEYTVFVKENNPPGCHIFTVSARDADAQENALVSYSLVERRLGERSLSSYVSVHAESGKVYALQPLDHEELELLQFQVSARDAGVPPLGSNVTLQVFVLDENDNAPALLTPRMRGTDGAVSEMVLRSVGAGVVVGKVRAVDADSGYNAWLSYELQPETASASIPFRVGLYTGEISTTRALDETDAPRQRLLVLVKDHGEPALTATATVLVSLVESGQAPKSSSRASVGATGPEVTLVDVNVYLIIAICAVSSLLVLTLLLYTVLRCSAMPTEGECAPGKPTLVCSSAVGSWSYSQQRRQRVCSGEGKQKTDLMAFSPGLSPCAGSTERTGEPSASSDSTGKPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 3380 - protein, 963 aa, unidentified
MVGCGVAVLCLWVSCGAAAGQLEYSVPEETERGVAVGNLSADLRLPAAAMSSRNFRFLSSHRELYFGVDLPSGNLVVREPADREQLCRAKAACVLTYDLVLEDPLELHKIRIHVLDTNDNSPLFPAGDVQLHIPEFLTPGARFTLPNAQDDDEGSNGILSYSLSPSQHFRLDMGSRVDGSEYPELVLEKALDREQRATHLLVLTARDGGLPARSGDAQVTIIVVDTNDNAPVFERSVYRTKVPETAPNGTVLFRVQALDPDEGSNGEVQYSLSNSTQAELRHRFHVHPKSGEVQVAASLGPPETLLEAYIEARDEGVFGLASTAKLLVEVTDVNDHAPELDFLTLSNPVPEDAAPGTVIALFSVKDEDLDSNGRVICGMSSAGPFQLTASFDNYYSLLIDGPLDREQISEYQVLITASDSGSPPLSTRRTITVSVADVNDNTPNFPQPQQELFVAENNGPGASLGRVFAQDPDLGKNGLVSYELLDVISEGPSASSLLAVESSSGAITAKTSFDFEQLRGFHFQVEGRDGGIPPRSATVTINLFVVDRNDNYPVILFPLPRNGSVPVEIVPRSARTGHLVTKVVAEDADSGSNAWLSYHISRASDSSLFRISANIGELRTARLVLPTDAVKQRVVVVVRDHGDPPLSSSVTLGVLLSNSVPQLLPDFEDVWEPGGQLSAQNLYLVIALACISFLFLGCLLFFVCTKLHQSPGCCAQSCCRSTEDLRYGSKMVSNPCMTSATIDVTTVERLSQTYLYRASLGLGSDNNSLLLRGEYNAADLRNLATGVGLNLPISCIQIRNRKGDHANVNAMPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 3381 - protein, 1007 aa, unidentified
MEQAGTRPAATEHPRLRRPMPWLLLLPLLLLLLLLLPGPAASQLRYSVPEEQAPGALVGNVARALGLELRRLGPGCLRINHLGAPSPRYLELDLTSGALFVNERIDREALCEQRPRCLLSLEVLAHNPVAVSAVEVEILDINDNSPRFPRPNYQLQVSESVAPGARFHIESAQDPDVGANSVQTYELSPSEHFELDLKPLQENSKVLELVLRKGLDREQAALHHLVLTAVDGGIPARSGTAQISVRVLDTNDNSPAFDQSTYRVQLREDSPPGTLVVKLNASDPDEGSNGELRYSLSSYTSDRERQLFSIDASTGEVRVIGGLDYEEASSYQIYVQATDRGPVPMAGHCKVLVDIVDVNDNAPEVVLTDLYSPVPENATPNTIVAVLSVNDQDSGPNRKVSLGLEATLPFRLNGFGNSYTLVVSGPLDRERVAVYNITVTATDGGIPQLTSLRTLKVEISDINDNPPSFLEDSYSIYIQENNLPGVLLCTVQATDPDEKENAEVTYSLLEREIQGLPVTSYVSINSASGSLYAVNSFDYEKFREFFVTVEAQDKGSPPLSSTVTANVYVVDMNDHAPHILYPTSTNSSAAFEMVPRTAPAGYLVTKVIAMDSDSGQNAWLFYHLAQTSDLDLFKVELHTGEIRTTRKMGDESGSTFNLTVVVRDNGEPSLSASVAITVAVVDRVSKILPDTQRHVKSPRTYSEITLYLIIALSTVSFIFLLTIIILSIIKCYRYTAYGTACCGGFCGVRERSPAELYKQANNNIDARIPHGLKVQPHFIEVRGNGSLTKTYCYKACLTAGSGSDTFMFYNTGAQTGPGPSGAQAAVTDSRNLTGQSGQNAGNLIILKNEAVSQNEPRQPNPDWRYSASLRAGMHSSVHLEEAGILRAGPGGPDQQWPTVSSATPEPEAGEVSPPVGAGVNSNSWTFKYGPGNPKQSGPGELPDKFIIPGSPAIISIRQEPTNSQIDKSDFITFGKKEETKKKKKKKKGNKTQEKKEKGNSTTDNSDQ

SEQ ID NO: 3382 - protein, 818 aa, unidentified
MAGTRRKSLQNRQVGSLLIFLCISVGDATTIRYSVAEEMESGSFVANVAKDLGLEVGKLAARGARLVSEGNKMHFRLHRKTGDLFVKEKLDRESLCGKADPCVLHFEVVLVEPLQSFRAEVRVFDINDNAPVFLNKEPLLKIPESTPLGSRFPLQSAQDLDVGLNGLQNYTLSANGYFHLHTRFCSHGPKYAELVLNKPLDREEQPEVNLTITAVDGGSPPKSGTAHIHVVVLDVNDHVPQFSRLVYRAQVSENSPNGSLVATVTAVDLDEGTNKAITYSLAQNPEAILKTFQIDPQNGEVRLRGPLDFEAIETYDIDIQATDGGGLSAHSKVLVEVVDVNDNPPEVMVSSVSSPLPEDSPPQTVVALFTIRDRDIRVGGKVTCFLREDLPFVIKPTFGNSYSLVTDRSLDREEVSGYNITIVAMDTGPPSLSAETMIEVLISDVNDNPPIFREDSYILTVRENNSPAVFIGKVHAEDLDLGENAQITYSLLPPKNGDLSVFAYISINSGNGKLYALRTMDYEAIQDFQFVVKATDGGFLSLSSQVTVRVVVLDDNDNRPMILYPLQNGTLPCNDLVPRSAEAGYLVTKVVAVDGDSGQNSWLSYHLLKATDLGLFSVQRQNGEIHTLRQISERDPMMQKLIILVQDHGQPALSTTVSLNILLVDGFSEPYLQFQDPTKHSRKVNPSTKYLVISLVILSFLFLLSVIVIFIIHVYQKIKYREKFTIQEHFYDDCNFSNNLVQGQGNGSLSRPCPYEMCSATGTGNSEFRFLKRFMPNFPFPHATGEIKMEAGSSLPPNSDRNKSQRLEGHDQVSDDYM

SEQ ID NO: 3383 - protein, 800 aa, unidentified
MAVRELCFPRQRQVLFLFLFWGVSLAGSGFGRYSVTEETEKGSFVVNLAKDLGLAEGELAARGTRVVSDDNKQYLLLDSHTGNLLTNEKLDREKLCGPKEPCMLYFQILMDDPFQIYRAELRVRDINDHAPVFQDKETVLKISENTAEGTAFRLERAQDPDGGLNGIQNYTISPNSFFHINISGGDEGMIYPELVLDKALDREEQGELSLTLTALDGGSPSRSGTSTVRIVVLDVNDNAPQFAQALYETQAPENSPIGFLIVKVWAEDVDSGVNAEVSYSFFDASENIRTTFQINPFSGEIFLRELLDYELVNSYKINIQAMDGGGLSARCRVLVEVLDTNDNPPELIVSSFSNSVAENSPETPLAVFKINDRDSGENGKMVCYIQENLPFLLKPSVENFYILITEGALDREIRAEYNITITVTDLGTPRLKTEHNITVLVSDVNDNAPAFTQTSYTLFVRENNSPALHIGSVSATDRDSGTNAQVTYSLLPPQDPHLPLASLVSINADNGHLFALRSLDYEALQAFEFRVGATDRGSPALSREALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHLLLVDGFSQPYLPLPEAAPAQAQAEADLLTVYLVVALASVSSLFLLSVLLFVAVRLCRRSRAASVGRCSVPEGPFPGHLVDVRGAETLSQSYQYEVCLTGGPGTSEFKFLKPVISDIQAQGPGRKGEENSTFRNSFGFNIQ

SEQ ID NO: 3384 - protein, 797 aa, unidentified
MENQGTRTQQIRQVLLLFVLLGMSQAGSETWSFSVAEEMQSGSFVGNLAKDLGLKVRELSSRGARVVSNDKKQRLQLDINTGDLLLSETLDREELCGSIEPCVLHLQVLMQNPTQFLQIELQVRDINDHSPIFSEKQMLLEIPENSPVGAVFLLESAKDLDVGINAVKSYTISPNSHFHIKMRVIPDNRKYPELVLDKALDYEELPELSFILSALDGGSPPRSGTALVRVVVVDINDNSPEFEQAFYEVKIRENSILGSLILIVSAWDLDSGTNGEICYTFSHASEDIRKTFEINQKSGEITLRAPLDFETIESYSIIIQATDGGGLFGKSTVIIHVIDVNDNAPEITVSSITSPIPENTPETVVMVFSIQDIDSGDNGRIVCSIPEDLPFVLKSSVENYYTLETERPLDRESTAEYNITITVTDLGIPRLKTEHNTTVLVSDVNDNAPTFTQTSYTLFVRENNSPALHIGSVSATDRDSGTNAQVNYSLLPPQDLHLPLASLVSINTDNGHLFALRSLDYEALQAFDFRVGATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLQVLLVDGFSQPYLPLPEAAPAQAQADSLTVYLVVALASVSSLFLFSVLLFVAVRLCRRSRAASVGSCSVPKGPFPGHLVDVSGTGTLSQSYQYEVCLTGGSETNEFKFLKPVIPNIQAKGLGKNSEENSTFRNSFGFNF

SEQ ID NO: 3385 - protein, 795 aa, unidentified
MENGGAGTLQIRQVLLFFVLLGMSQAGSETGNFLVMEELQSGSFVGNLAKTLGLEVSELSSRGARVVSNDNKECLQLDTNTGDLLLREMLDREELCGSNEPCVLYFQVLMKNPTQFLQIELQVRDINDHSPVFLEKEMLLEIPENSPVGAVFLLESAKDLDVGINAVKSYTINPNSHFHVKIRVNPDNRKYPELVLDKALDYEERPELSFILTALDGGSPPRSGTALVRVVVVDINDNSPEFEQAFYEVKILENSILGSLVVTVSAWDLDSGTNSELSYTFSHASEDIRKTFEINQKSGDITLTAPLDFEAIESYSIIIQATDGGGLFGKSTVRIQVMDVNDNAPEITVSSITSPIPENTPETVVMVFRIRDRDSGDNGKMVCSIPEDIPFVLKSSVNNYYTLETERPLDRESRAEYNITITVTDLGTPRLKTEHNITVLVSDVNDNAPAFTQTSYALFVRENNSPALHIGSISATDRDSGTNAQVNYSLLPSQDPHLPLASLVSINADNGHLFALRSLDYEALQGFQFRVGATDHGSPALSSEALVRVLVLDANDNSPFVLYPLQNGSAPCTELVPWAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAAPVGRCSVPEGPFPGHLVDVSGTGTLSQSYHYEVCVTGGSRSNKFKFLKPIIPNFLPQSTGSEVEENPPFQNNLGF

SEQ ID NO: 3386 - protein, 798 aa, unidentified
MEASGKLICRQRQVLFSFLLLGLSLAGAAEPRSYSVVEETEGSSFVTNLAKDLGLEQREFSRRGVRVVSRGNKLHLQLNQETADLLLNEKLDREDLCGHTEPCVLRFQVLLESPFEFFQAELQVIDINDHSPVFLDKQMLVKVSESSPPGTTFPLKNAEDLDVGQNNIENYIISPNSYFRVLTRKRSDGRKYPELVLDKALDREEEAELRLTLTALDGGSPPRSGTAQVYIEVLDVNDNAPEFEQPFYRVQISEDSPVGFLVVKVSATDVDTGVNGEISYSLFQASEEIGKTFKINPLTGEIELKKQLDFEKLQSYEVNIEARDAGTFSGKCTVLIQVIDVNDHAPEVTMSAFTSPIPENAPETVVALFSVSDLDSGENGKISCSIQEDLPFLLKSAENFYTLLTERPLDRESRAEYNITITVTDLGTPMLITQLNMTVLIADVNDNAPAFTQTSYTLFVRENNSPALHIRSVSATDRDSGTNAQVTYSLLPPQDPHLPLTSLVSINADNGHLFALRSLDYEALQGFQFRVGASDHGSPALSSEALVRVVVLDANDNSPFVLYPLQNGSAPCTELVPRAAEPGYLVTKVVAVDGDSGQNAWLSYQLLKATELGLFGVWAHNGEVRTARLLSERDAAKHRLVVLVKDNGEPPRSATATLHVLLVDGFSQPYLPLPEAAPTQAQADLLTVYLVVALASVSSLFLFSVLLFVAVRLCRRSRAASVGRCLVPEGPLPGHLVDMSGTRTLSQSYQYEVCLAGGSGTNEFKFLKPIIPNFPPQCPGKEIQGNSTFPNNFGFNIQ

SEQ ID NO: 3387 - protein, 798 aa, unidentified
MEIRGALDLRKRQVLIFLVLLGLSRAGTESAHYSVAEETEIGSFVANLARDLGLGVEELSSREARVVSDDNKKYLHLDLLTGNLLLNEKLDRDELCGSTEPCVLHFQVVLENPLQFFRFELCVKDINDHSPTFLDKEILIKISEGTTVGATFLMESAQDLDVGSNSLQNYTISPNSHFYIKIPDSSDRKIYPELVLDRALDYEQEAELRLTLTAVDGGSPPKSGTTLVLIKVLDINDNAPEFPQSLYEVQVPEDRPLGSWIATISAKDLDAGNYGKISYTFFHASEDIRKTFEINPISGEVNLRSPLDFEVIQSYTINIQATDGGGLSGKCTLLVKVMDINDNPPEVTISSITKRIPENASETLVALFSILDQDSGDNGRMICSIQDNLPFFLKPTFKNFFTLVSEKALDRESQAEYNITITVTDLGTPRLKTEYNITVLLSDVNDNAPTFTQTSYTLFVRENNSPALHIGSVSATDRDSGTNAQVNYSLLPPQDRHLPLASLVSINADNGHLFALRSLDYEALQEFEFRVGATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAASVGRCSVPEGPFPGHLVDVSGTGTLSQSYQYEVCLTGGSGTNEFKFLKPIIPNFQVHDTGRNMGEIENFRNSFGLNIQ

SEQ ID NO: 3388 - protein, 787 aa, unidentified
MEPAGERFPEQRQVLILLLLLEVTLAGWEPRRYSVMEETERGSFVANLANDLGLGVGELAERGARVVSEDNEQGLQLDLQTGQLILNEKLDREKLCGPTEPCIMHFQVLLKKPLEVFRAELLVTDINDHSPEFPEREMTLKIPETSSLGTVFPLKKARDLDVGSNNVQNYNISPNSHFHVSTRTRGDGRKYPELVLDTELDREEQAELRLTLTAVDGGSPPRSGTVQILILVLDANDNAPEFVQALYEVQVPENSPVGSLVVKVSARDLDTGTNGEISYSLYYSSQEIDKPFELSSLSGEIRLIKKLDFETMSSYDLDIEASDGGGLSGKCSVSVKVLDVNDNFPELSISSLTSPIPENSPETEVALFRIRDRDSGENGKMICSIQDDVPFKLKPSVENFYRLVTEGALDRETRAEYNITITITDLGTPRLKTEQSITVLVSDVNDNAPAFTQTSYTLFVRENNSPALHIGSVSATDRDSGTNAQVTYSLLPPRDPHLPLTSLVSINTDNGHLFALQSLDYEALQAFEFRVGATDRGFPALSSEALVRVLVLDANDNSPFVLYPLQNGSAPCTELVPRAAEPGYLVTKVVAVDGDSGQNAWLSYQLLKATEPGLFGVWAHNGEVRTARLLSERDVAKHRLVVLVKDNGEPPRSATATLQVLLVDGFSQPYLPLPEAAPAQAQADSLTVYLVVALASVSSLFLFSVFLFVAVRLCRRSRAASVGRCSVPEGPFPGHLVDVSGTGTLSQSYQYEVCLTGGSESNDFKFLKPIFPNIVSQDSRRKSEFLE

SEQ ID NO: 3389 - protein, 798 aa, unidentified
MEAGEGKERVPKQRQVLIFFVLLGIAQASCQPRHYSVAEETESGSFVANLLKDLGLEIGELAVRGARVVSKGKKMHLQFDRQTGDLLLNEKLDREELCGPTEPCVLPFQVLLENPLQFFQAELRIRDVNDHSPVFLDKEILLKIPESITPGTTFLIERAQDLDVGTNSLQNYTISPNFHFHLNLQDSLDGIILPQLVLNRALDREEQPEIRLTLTALDGGSPPRSGTALVRIEVVDINDNVPEFAKLLYEVQIPEDSPVGSQVAIVSARDLDIGTNGEISYAFSQASEDIRKTFRLSAKSGELLLRQKLDFESIQTYTVNIQATDGGGLSGTCVVFVQVMDLNDNPPELTMSTLINQIPENLQDTLIAVFSVSDPDSGDNGRMVCSIQDDLPFFLKPSVENFYTLVISTALDRETRSEYNITITVTDFGTPRLKTEHNITVLVSDVNDNAPAFTQTSYTLFVRENNSPALHIGSVSATDRDSGTNAQVTYSLLPPQDPHLPLASLVSINADNGHLFALQSLDYEALQAFEFRVGAADRGSPALSSEALVRVLVLDANDNSPFVLYPLQNGSAPCTELVPRAAEPGYLVTKVVAVDGDSGQNAWLSYQLLKATEPGLFGVWAHNGEVRTARLLRERDAAKQRLVVLVKDNGEPPRSATATLHVLLVDGFSQPYLLLPEAAPAQAQADLLTVYLVVALASVSSLFLFSVLLFVAVRLCRRSRAASVGRCSVPEGPFPGQMVDVSGTGTLSQSYQYEVCLTGGSGTNEFKFLKPIIPNFVAQGAERVSEANPSFRKSFEFT

SEQ ID NO: 3390 - protein, 796 aa, unidentified
MEAGGERFLRQRQVLLLFVFLGGSLAGSESRRYSVAEEKEKGFLIANLAKDLGLRVEELAARGAQVVSKGNKQHFQLSHQTGDLLLNEKLDREELCGPTEPCILHFQILLQNPLQFVTNELRIIDVNDHSPVFFENEMHLKILESTLPGTVIPLGNAEDLDVGRNSLQNYTITPNSHFHVLTRSRRDGRKYPELVLDKALDPEEQPELSLTLTALDGGSPPRSGTAQINIQVLDINDNAPEFAQPLYEVAVLENTPVNSVIVTVSASDLDTGSFGTISYAFFHASEEIRKTFQLNPITGDMQLVKYLNFEAINSYEVDIEAKDGGGLSGKSTVIVQVVDVNDNPPELTLSSVNSPIPENSGETVLAVFSVSDLDSGDNGRVMCSIENNLPFFLKPSVENFYTLVSEGALDRETRSEYNITITITDLGTPRLKTKYNITVLVSDVNDNAPAFTQISYTLFVRENNSPALHIGSVSATDRDSGTNAQVTYSLLPPQDPHLPLSSLVSINADNGHLFALRSLDYEALQAFEFRVGATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADLLTVYLVVALASVSSLFLFSVLLFVAVRLCRRSRAASVGRCSVPEGPFPGQMVDVSGTGTLSQSYQYEVCLTGGSGTNEFKFLKPIIPNFVAQGAERVSEANPSFRKSFEFS

SEQ ID NO: 3391 - protein, 795 aa, unidentified
MKKLGRIHPNRQVLAFILMVFLSQVRLEPIRYSVLEETESGSFVAHLAKDLGLGIGELASRSARVLSDDDKQRLQLDRQTGDLLLREKLDREELCGPIEPCVLHFQVFLEMPVQFFQGELLIQDINDHSPIFPEREVLLKILENSQPGTLFPLLIAEDLDVGSNGLQKYTISPNSHFHILTRNHSEGKKYPDLVQDKPLDREEQPEFSLTLVALDGGSPPRSGTVMVRILIMDINDNAPEFVHTPYGVQVLENSPLDSPIVRVLARDIDAGNFGSVSYGLFQASDEIKQTFSINEVTGEILLKKKLDFEKIKSYHVEIEATDGGGLSGKGTVVIEVVDVNDNPPELIISSLTSSIPENAPETVVSIFRIRDRDSGENGKMICSIPDNLPFILKPTLKNFYTLVTERPLDRETSAEYNITIAVTDLGTPRLKTQQNITVQVSDVNDNAPAFTQTSYTLFVRENNSPALHIGSVSATDRDSGTNAQVTYSLLPPQDPHLPLASLVSINADNGHLFALRSLDYEALQAFEFRVGASDRGSPALSSEALVRVLVLDTNDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAASVGRCSVPEGPFPGHLVDVSGTGTLSQSYQYEVCLTGDSGTGEFKFLKPIFPNLLVQDTGREVKENPKFRNSLVFS

SEQ ID NO: 3392 - protein, 795 aa, unidentified
METALAKTPQKRQVMFLAILLLLWEAGSEAVRYSIPEETESGYSVANLAKDLGLGVGELATRGARMHYKGNKELLQLDIKTGNLLLYEKLDREVMCGATEPCILHFQLLLENPVQFFQTDLQLTDINDHAPEFPEKEMLLKIPESTQPGTVFPLKIAQDFDIGSNTVQNYTISPNSHFHVATHNRGDGRKYPELVLDKALDREERPELSLTLTALDGGAPPRSGTTTIRIVVLDNNDNAPEFLQSFYEVQVPENSPLNSLVVVVSARDLDAGAYGSVAYALFQGDEVTQPFVIDEKTAEIRLKRALDFEATPYYNVEIVATDGGGLSGKCTVAIEVVDVNDNAPELTMSTLSSPTPENAPETVVAVFSVSDPDSGDNGRMICSIQNDLPFLLKPTLKNFYTLVTQRTLDRESQAEYNITITVTDMGTPRLKTEHNITVLVSDVNDNAPAFTQTSYTLFVRENNSPALHIGSVSATDRDSGTNAQVTYSLLPPQNPHLRLASLVSINADNGHLFALRSLDYEALQAFEFRVGATDRGSPALSSEALVRVLVLDANDNSPFVLYPLQNGSAPCTELVPRAAEPGYLVTKVVAVDGDSGQNAWLSYQLLKATEPGLFSMWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAASVGRCSVPEGPFPGHLVDVSGTGTLSQSYHYEVCLTGDSGAGEFKFLKPIIPNLLPQGAGEEIGKTAAFRNSFGLN

SEQ ID NO: 3393 - protein, 794 aa, unidentified
MMQTKVQNKKRQVAFFILLMLWGEVGSESIQYSVLEETESGTFVANLTKDLGLRVGELASRGARVVFKGNRQHLQFDPQTHDLLLNEKLDREELCGSTEPCVLPFQVLLENPLQFFQASLRVRDINDHAPEFPAREMLLKISEITMPGKIFPLKMAHDLDTGSNGLQRYTISSNPHFHVLTRNRSEGRKFPELVLDKPLDREEQPQLRLTLIALDGGSPPRSGTSEIQIQVLDINDNVPEFAQELYEAQVPENNPLGSLVITVSARDLDAGSFGKVSYALFQVDDVNQPFEINAITGEIRLRKALDFEEIQSYDVDVEATDGGGLSGKCSLVVRVLDVNDNAPELTMSFFISLIPENLPEITVAVFSVSDADSGHNQQVICSIENNLPFLLRPSVENFYTLVTEGALDRESRAEYNITITVTDLGTPRLKTQQSITVQVSDVNDNVPAFTQTSYTLFVRENNSPALHIGSVSATDRDSGINAQVTYSLLPPQDPHLPLSSLVSINADNGHLFALRSLDYEALQSFEFRVGATDRGSPALSSEALVRLLVLDANDNSPFVLYPLQNGSAPCTELVPRAAEPGYLVTKVVAVDGDSGQNAWLSYQLLKATELGLFGVWAHNGEVRTARLLSERDAAKHRLVVLVKDNGEPPRSATATLHVLLVDGFSQPYLPLPEAAPAQAQADSLTVYLVVALASVSSLFLFSVLLFVAVRLCRRSRAASVGRYSVPEGPFPGHLVDVSGTGTLSQSYQYKVCLTGGSETNEFKFLKPIMPNFPPQGTEREMEETPTSRNSFPFS

SEQ ID NO: 3394 - protein, 793 aa, unidentified
MEARVERAVQKRQVLFLCVFLGMSWAGAEPLRYFVAEETERGTFLTNLAKDLGLGVGELRARGTRIVSDQNMQILLLSSLTGDLLLNEKLDREELCGPREPCVLPFQLLLEKPFQIFRAELWVRDINDHAPVFLDREISLKILESTTPGAAFLLESAQDSDVGTNSLSNYTISPNAYFHINVHDSGEGNIYPELVLNQVLDREEIPEFSLTLTALDGGSPPRSGTALVRILVLDVNDNAPDFVRSLYKVQVPENSPVGSMVVSVSARDLDTGSNGEIAYAFSYATERILKTFQINPTSGSLHLKAQLDYEAIQTYTLTIQAKDGGGLSGKCTVVVDVTDINDNRPELLLSSLTSPIAENSPETVVAVFRIRDRDSGNNGKTVCSIQDDVPFILKPSVENFYTLVTEKPLDRERNTEYNITITVTDLGTPRLKTEHNITVLVSDVNDNAPAFTQTSYTLFVRENNSPALPIGSVSATDRDSGTNAQVIYSLLPSQDPHLPLASLVSINADNGHLFALRSLDYEALQAFEFRVGATDRGSPALSSEALVRVLVLDANDNSPFVLYPLQNSSAPCTEPLPRAAEPGYLVTKVVAVDGDSGQNAWLSYQLLKATEPGLFGVWAHNGEVRTARLLSERDAAKQRLVVLVKDNGEPPRSATATLHVLLVDGFSQPYLRLPEAAPDQANSLTVYLVVALASVSSLFLLSVLLFVAVRLCRRSRAAPVGRCSVPEGPFPRHLVDLSGTGTLSQSYQYEVCLTGGSGTNEFKFLKPIIPNLLPQSTGREVEENRPFQNNLGF

SEQ ID NO: 3395 - protein, 801 aa, unidentified
MEASGKLICRQRQVLFSFLLLGLSLAGAAEPRSYSVVEETEGSSFVTNLAKDLGLEQREFSRRGVRVVSRGNKLHLQLNQETADLLLNEKLDREDLCGHTEPCVLRFQVLLESPFEFFQAELQVIDINDHSPVFLDKQMLVKVSESSPPGTAFPLKNAEDLDIGQNNIENYIISPNSYFRVLTRKRSDGRKYPELVLDKALDREEEAELRLTLTALDGGSPPRSGTAQVYIEVVDVNDNAPEFEQPFYRVQISEDSPISFLVVKVSATDVDTGVNGEISYSLFQASDEISKTFKVDFLTGEIRLKKQLDFEKFQSYEVNIEARDAGGFSGKCTVLIQVIDVNDHAPEVTMSAFTSPIPENAPETVVALFSVSDLDSGENGKISCSIQEDLPFLLKSSVGNFYTLLTETPLDRESRAEYNVTITVTDLGTPRLTTHLNMTVLVSDVNDNAPAFTQTSYTLFVRENNSPALHIGSVSATDRDSGTNAQVTYSLLPPQDPHLPLASLVSINTDNGHLFALRSLDYEALQAFEFRVGASDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKQRLVVLVKDNGEPPCSATATLHLLLVDGFSQPYLPLPEAAPAQGQADSLTVYLVVALASVSSLFLFSVLLFVAVLLCRRSRAASVGRCSVPEGPFPGHLVDVRGTGSLSQNYQYEVCLAGGSGTNEFQFLKPVLPNIQGHSFGPEMEQNSNFRNGFGFSLQLK

SEQ ID NO: 3396 - protein, 931 aa, unidentified
MKIQKKLTGCSRLMLLCLSLELLLEAGAGNIHYSVPEETDKGSFVGNIAKDLGLQPQELADGGVRIVSRGRMPLFALNPRSGSLITARRIDREELCAQSMPCLVSFNILVEDKMKLFPVEVEIIDINDNTPQFQLEELEFKMNEITTPGTRVSLPFGQDLDVGMNSLQSYQLSSNPHFSLDVQQGADGPQHPEMVLQSPLDREEEAVHHLILTASDGGEPVRSGTLRIYIQVVDANDNPPAFTQAQYHINVPENVPLGTQLLMVNATDPDEGANGEVTYSFHNVDHRVAQIFRLDSYTGEISNKEPLDFEEYKMYSMEVQAQDGAGLMAKVKVLIKVLDVNDNAPEVTITSVTTAVPENFPPGTIIALISVHDQDSGDNGYTTCFIPGNLPFKLEKLVDNYYRLVTERTLDRELISGYNITITAIDQGTPALSTETHISLLVTDINDNSPVFHQDSYSAYIPENNPRGASIFSVRAHDLDSNENAQITYSLIEDTIQGAPLSAYLSINSDTGVLYALRSFDYEQFRDMQLKVMARDSGDPPLSSNVSLSLFLLDQNDNAPEILYPALPTDGSTGVELAPLSAEPGYLVTKVVAVDRDSGQNAWLSYRLLKASEPGLFSVGLHTGEVRTARALLDRDALKQSLVVAVQDHGQPPLSATVTLTVAVADRISDILADLGSLEPSAKPNDSDLTLYLVVAAAAVSCVFLAFVIVLLAHRLRRWHKSRLLQASGGGLASMPGSHFVGVDGVRAFLQTYSHEVSLTADSRKSHLIFPQPNYADTLISQESCEKKGFLSAPQSLLEDKKEPFSQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 3397 - protein, 936 aa, unidentified
MAAQRNRSKESKDCSGLVLLCLFFGIPWEAGARQISYSIPEELEKGSFVGNISKDLGLAPRELAERGVRIVSRGRTQLFSLNPRSGSLITAGRIDREELCAQSARCVVSFNILVEDRVKLFGIEIEVTDINDNAPKFQAENLDVKINENVAAGMRFPLPEAIDPDVGVNSLQSYQLSPNKHFSLRVQSRANGVKYPELVLEHSLDREEEAIHHLVLTASDGGDPLRSGTVLVSVTVFDANDNAPVFTLPEYRVSVPENLPVGTQLLTVTATDRDEGANGEVTYSFRKLPDTQLLKFQLNKYTGEIKISENLDYEETGFYEIEIQAEDGGAYLATAKVLITVEDVNDNSPELTITSLFSPVTEDSPLGTVVALLNVHDLDSEQNGQVTCSILAYLPFKLEKSIDSYYRLVIHRALDREQVSSYNITVTATDGGSPPLSTEAHFMLQVADINDNPPTFSQVSYFTYIPENNARGASIFSVTALDPDSKENAQIIYSLAEDTIQGVPLSSYISINSDTGVLYALRSFDYEQFHELQMQVTASDSGDPPLSSNVSLSLFVLDQNDNAPEILYPALPTDGSTGVELAPRSAEPGYLVTKVVAVDRDSGQNAWLSYRLLKASEPGLFAVGEHTGEVRTARALLDRDALKQSLVVAVQDHGQPPLSATVTLTVAVADSIPQVLADLGSFESPANSETSDLTLYLVVAVAAVSCVFLAFVIVLLAHRLRRWHKSRLLQASGGGLTGVSGSHFVGVDGVRAFLQTYSHEVSLTADSRKSHLIFPQPNYADTLISQESCEKNDPLSLLDDSKFPIEDTPLVPQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 3398 - protein, 935 aa, unidentified
MANRLQRGDRSRLLLLLCIFLGTLRGFRARQIRYSVPEETEKGSFVGNISKDLGLEPRELAKRGVRIVSRGKTQLFAVNPRSGSLITAGRIDREELCETVSSCFLNMELLVEDTLKIYGVEVEIIDINDNAPSFQEDEVEIKVSEHAIPGARFALPNARDPDVGVNSLQSYQLSPNNYFSLQLRGRTDGAKNPELVLEGSLDREKEAAHLLLLTALDGGDPIRKGAVPIRVVVLDVNDHIPMFTQSVYRVSVPENISSGTRVLMVNATDPDEGINGEVMYSFRNMESKASEIFQLDSQTGEVQVRGSLDFEKYRFYEMEIQGQDGGGLFTTTTMLITVVDVNDNAPEITITSSINSILENSPPGTVIALLNVQDQDSGENGQVSCFIPNHLPFKLEKTYGNYYKLITSRVLDRELVQSYNITLTATDQGSPPLSAETHVWLNVADDNDNPPVFPHSSYSAYIPENNPRGASIFSVTALDPDSKQNALVTYSLTDDTVQGVPLSSYVSINSNTGVLYALQSFDYEQFRDLELRVIARDSGDPPLSSNVSLSLFVLDQNDNAPEILYPALPTDGSTGVELAPRSAEPGYLVTKVVAVDKDSGQNAWLSYRLLKASEPGLFAVGEHTGEVRTARALLDRDALKQSLVVAVQDHGQPPLSATVTLTVAVADSIPEVLADLGSLESLANSETSDLSLYLVVAVAAVSCIFLVFVIVLLALRLWRWHKSRLLQASEGGLAGMPTSHFVGVDGVQAFLQTYSHEVSLIADSQKSHLIFPQPNYGDTLISQESCEKSEPLLIAEDSAIILGKCDPTSNQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 3399 - protein, 932 aa, unidentified
MIPARLHRDYKGLVLLGILLGTLWETGCTQIRYSVPEELEKGSRVGDISRDLGLEPRELAERGVRIIPRGRTQLFALNPRSGSLVTAGRIDREELCMGAIKCQLNLDILMEDKVKIYGVEVEVRDINDNAPYFRESELEIKISENAATEMRFPLPHAWDPDIGKNSLQSYELSPNTHFSLIVQNGADGSKYPELVLKRALDREEKAAHHLVLTASDGGDPVRTGTARIRVMVLDANDNAPAFAQPEYRASVPENLALGTQLLVVNATDPDEGVNAEVRYSFRYVDDKAAQVFKLDCNSGTISTIGELDHEESGFYQMEVQAMDNAGYSARAKVLITVLDVNDNAPEVVLTSLASSVPENSPRGTLIALLNVNDQDSEENGQVICFIQGNLPFKLEKSYGNYYSLVTDIVLDREQVPSYNITVTATDRGTPPLSTETHISLNVADTNDNPPVFPQASYSAYIPENNPRGVSLVSVTAHDPDCEENAQITYSLAENTIQGASLSSYVSINSDTGVLYALSSFDYEQFRDLQVKVMARDNGHPPLSSNVSLSLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADSIPQVLADLGSLESPANSETSDLTLYLVVAVAAVSCVFLAFVILLLALRLRRWHKSRLLQASGGGLTGAPASHFVGVDGVQAFLQTYSHEVSLTTDSRKSHLIFPQPNYADMLVSQESFEKSEPLLLSGDSVFSKDSHGLIEQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 3400 - protein, 932 aa, unidentified
MAALQKLPHCRKLVLLCFLLATLWEARAGQIRYSVREEIDRGSFVGNIAKDLGLEPLALAEQGVRIVSRGRSQLFALNPRSGSLVTANRIDREELCAQSAPCLLNFNILLEDKLTIYSVEVEITDINDNAPRFGVEELELKISETTTPGFRIPLKNAHDADVGENALQKYALNPNDHFSLDVRRGADGNKYPELVLERSLDREEEAVHHLVLVASDGGDPVLSGTSRICVKVLDANDNAPVFTQPEYRISIPENTLVGTRILTVTATDADEGYYAQVVYFLEKSPGETSEVFELKSTSGELTIIKDLDYEDATFHEIDIEAQDGPGLLTRAKVIVTVLDVNDNAPEFYMTSATSSVSEDSLPGTIIGLFNVHDRDSGQNAFTTCSLPEDLPFKLEKSVDNYYRLVTTRALDREQFSFYNITLTAKDGGNPSLSTDAHILLQVADINDNAPAFSRTSYSTYIPENNPRGASVFSVTAHDPDSNDNAHVTYSFAEDTVQGAPLSSYISINSDTGVLYALRSFDYEQLRDLQVWVIARDSGNPPLSSNVSLSLFVLDQNDNAPEILYPAFPTDGSTGVELAPRSAEPGYLVTKVVAVDRDSGQNAWLSYHLLKASEPGLFSVGLHTGEVRTARALLDRDALKQSLVVAIQDHGQPPLSATVTLTVAVADRIPDILADLGSLEPSAIPNDSDLTLYLVVAVAAVSCVFLAFVIVLLAHRLRRWHKSRLLQASGGSLTGMQSSHFVGVDGVRAFLQTYSHEVSLTADSRKSHLIFPQPNYADTLISQESCEKKDFLSAPQSLLEEEREETFSQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 3401 - protein, 932 aa, unidentified
MTNCLSFRNGRGLALLCALLGTLCETGSGQIRYSVSEELDKGSFVGNIANDLGLEPRELAERGVRIVSRGRTQLFSLNPQSGSLVTAERIDREELCAQIPLCLVKINILVEDKLKIFEVEIEIKDINDNAPNFPTEELEIKIGELTVPGTRFPIKTAFDPDVGINSLQNYKLSPNDYFSLAVNSVSEGAKYPELVLERALDREKKEIHQLVLVASDGGDPVHSGNLHIQVIVLDANDNPPMFTQPEYRVSVWENVPVGTRLLTVNATDPDEGFNAQVSYILDKMPGKIAEIFHLNSVSGEVSILKSLDYEDAMFYEIKIEAQDGPGLLSRAKILVTVLDVNDNAPEITITSLTSSVPEEGTVGREIALIDVHDRDSGQNGQVEVFVLGNLPFKLEKSIDQYYRLVTATSLDREQISEYNISLRASDGGSPPLSTETHITLHVIDINDNPPTFPHLSYSAYIPENNPRGASIFSVTAQDPDSNNNARITYALTEDTLQGAPLSSFVSINSNTGVLYALRSFDYEQFRDLKLLVTASDSGNPPLSSNVSLNLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADRIPDILADLGSLEPSAKPNDSDLTLYLVVAVAAVSCVFLAFVIVLLALRLRRWHKSRLLQASGGGLASTPGSHFVGADGVRAFLQTYSHEVSLTADSRKSHLIFPQPNYADTLISQESCEKSEPLLITQDLLEMKGDSNLLQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 3402 - protein, 962 aa, unidentified
MHFILDPEDPGAPQASTEGKPKHRRLRGGVVMAAPPARPDHTRLLQICLLLGVLVEIRAEQILYSVFEEQEEGSVVGNIAKDLGLAPRELAERGVRIVSRGRTQLFALNPRSGTLVTAGRIDREELCDRSPNCVTNLEILLEDTVKILRVEVEIIDVNDNPPSFGTEQREIKVAENENPGARFPLPEAFDPDVGVNSLQGYQLNSNGYFSLDVQSGADGIKYPELVLERALDREEEAVHHLVLTAFDGGDPVRSGTARILIILVDTNDNAPVFTQPEYHVSVRENVPVGTRLLTVKATDPDEGANGDVTYSFRKVRDKISQLFQLNSLSGDITILGGLDYEDSGFYDIDVEAHDGPGLRARSKVLVTVLDENDNAPEVTVTSLTSSVQESSSPGTVIALFNVHDSDSGGNGLVTCSIPDNLPFTLEKTYGNYYRLLTHRTLDREEVSEYNITVTATDQGTPPLSTETHISLQVMDINDNPPTFPHASYSAYIPENNPRGASILSMTAQDPDSGDNARITYSLAEDTFQGAPLSSYVSINSNTGILYALCSFDYEQFRDLQLLMTASDSGDPPLSSNVSLSLFVLDQNDNVPEILYPTFPTDGSTGVELAPRSADSGYLVTKVVAVDRDSGQNAWLSYSLLKSSEPGLFAVGLHTGEVRTARALLDRDALKQRLVVVVQDHGQPPLSATVTLTVAVADSIPDVLADLGSLKPSADPDDSGLTLYLVVAVAAVSCVFLAFVTVLLALKLRRWHKSRLLHAEGSRLAGVPASHFVGVDGVRAFLQTYSHEVSLTADSRKSHLIFSQPSYADTLISRESCEKSEPLLITQDLLETKGDPNLQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 3403 - protein, 931 aa, unidentified
MASPPRGWGCGELLLPFMLLGTLCEPGSGQIRYSMPEELDKGSFVGNIAKDLGLEPQELAERGVRIVSRGRTQLFALNPRSGSLVTAGRIDREELCAQSPLCVVNFNILVENKMKIYGVEVEIIDINDNFPRFRDEELKVKVNENAAAGTRLVLPFARDADVGVNSLRSYQLSSNLHFSLDVVSGTDGQKYPELVLEQPLDREKETVHDLLLTALDGGDPVLSGTTHIRVTVLDANDNAPLFTPSEYSVSVPENIPVGTRLLMLTATDPDEGINGKLTYSFRNEEEKISETFQLDSNLGEISTLQSLDYEESRFYLMEVVAQDGGALVASAKVVVTVQDVNDNAPEVILTSLTSSISEDCLPGTVIALFSVHDGDSGENGEIACSIPRNLPFKLEKSVDNYYHLLTTRDLDREETSDYNITLTVMDHGTPPLSTESHIPLKVADVNDNPPNFPQASYSTSVTENNPRGVSIFSVTAHDPDSGDNARVTYSLAEDTFQGAPLSSYVSINSDTGVLYALRSFDYEQLRDLQLWVTASDSGNPPLSSNVSLSLFVLDQNDNTPEILYPALPTDGSTGVELAPRSAEPGYLVTKVVAVDKDSGQNAWLSYRLLKASEPGLFAVGLHTGEVRTARALLDRDALKQSLVVAVEDHGQPPLSATFTVTVAVADRIPDILADLGSIKTPIDPEDLDLTLYLVVAVAAVSCVFLAFVIVLLVLRLRRWHKSRLLQAEGSRLAGVPASHFVGVDGVRAFLQTYSHEVSLTADSRKSHLIFPQPNYADTLLSEESCEKSEPLLMSDKVDANKEERRVQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 3404 - protein, 932 aa, unidentified
MAPPQRHPQRSEQVLLLTLLGTLWGAAAAQIRYSIPEELEKGSFVGNIVKDLGLEPQELAEHGVRIVSRGRMQLFSLNPRNGSLVTAGRIDREELCAQSPRCLVSFNILVEDKLNLYPVEVEIVDINDNTPRFLKEELEVKILENAAPSSRFPLMEVYDPDVGMNSLQGFKLSGNSHFSVDVQSEAHGPKYPELVLEGTLDREGEAVYRLVLTAMDGGDPVRSSVAQILVTVLDVNDNTPMFTQPVYRVSVPENLPVGTPVLAVTATDQDEGVHGEVTYSFVKITEKISQIFCLNVLTGEISTSANLDYEDSSFYELGVEARDGPGLRDRAKVLITILDVNDNVPEVVVTSGSRTIAESAPPGTVIALFQVFDRDSGLNGLVTCSIPRSLPFELEKSVGNYYRLVTNAALDREEVFLYNITVTATDKGTPPLSTETIISLNVADTNDNPPTFPHSSYSVYVLENNPRGASIFSVNALDPDVDQNAQVSYSLAEDTLQGAPLSSYVSINSDTGILYALRSFDYEQLRDLQLWVTASDSGDPPLSSNVSLSLFVLDQNDNAPEILYPALPTDGSTGVELAPRSAEPGYLVTKVVAVDRDSGQNAWLSYRLLKASEPGLFSVGLHTGEVRTARALLDRDALKQSLVVAVQDHGQPPLSATVTLTVAVADRIPDILADLGSLEPSAKPNDSDLTLYLVVAVAAVSCVFLAFVIVLLALRLQRWHKSRLLQASGGGLASMPGSHFVGVEGVRAFLQTYSHEVSLTADSRKSHLIFPQPNYADTLINQESYEKSEPLLITQDLLETKGEPRQLQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 3405 - protein, 932 aa, unidentified
MAAQPRGGDYRGFFLLSILLGTPWEAWAGRILYSVSEETDKGSFVGDIAKDLGLEPRELAERGVRIISRGRTQLFALNQRSGSLVTAGRIDREEICAQSARCLVNFNILMEDKMNLYPIDVEIIDINDNVPRFLTEEINVKIMENTAPGVRFPLSEAGDPDVGTNSLQSYQLSPNRHFSLAVQSGDDETKYPELVLERVLDREEERVHHLVLTASDGGDPPRSSTAHIQVTVVDVNDHTPVFSLPQYQVTVPENVPVGTRLLTVHAIDLDEGVNGEVTYSFRKITPKLPKMFHLNSLTGEISTLEGLDYEETAFYEMEVQAQDGPGSLTKAKVLITVLDVNDNAPEVTMTSLSSSIPEDTPLGTVIALFYLQDRDSGKNGEVTCTIPENLPFKLEKSIDNYYRLVTTKNLDRETLSLYNITLKATDGGTPPLSRETHIFMQVADTNDNPPTFPHSSYSVYIAENNPRGASIFLVTAQDHDSEDNAQITYSLAEDTIQGAPVSSYVSINSDTGVLYALQSFDYEQLRELQLRVTAHDSGDPPLSSNMSLSLFVLDQNDNPPEILYPALPTDGSTGMELAPRSAEPGYLVTKVVAVDKDSGQNAWLSYLLLKASEPGLFAVGLYTGEVRTARALLDRDALKQSLVVAVQDHGQPPLSATVTLTVAVADSIPEVLADLGSLEPSDGPYNYDLTLYLVVAVATVSCVFLAFVLVLLALRLRRWHKSRLLQASEGGLANVPTSHFVGMDGVQAFLQTYSHEVSLTADSRKSHLIFPQPNYVDMLISQESCEKNDSLLTSVDFQECKENLPSIQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 3406 - protein, 932 aa, unidentified
MAAPQSRPRRGELILLCALLGTLWEIGRGQIRYSVPEETDKGSFVGNISKDLGLDPRKLAKHGVRIVSRGRTQLFALNPRSGSLITAGRIDREELCAQSPRCLININTLVEDKGKLFGVEIEIIDINDNNPKFQVEDLEVKINEIAVPGARYPLPEAVDPDVGVNSLQSYQLSPNHHFSLDVQTGDNGAINPELVLERALDREEEAAHHLVLTASDGGKPPRSSTVRIHVTVLDTNDNAPVFPHPIYRVKVLENMPPGTRLLTVTASDPDEGINGKVAYKFRKINEKQTPLFQLNENTGEISIAKSLDYEECSFYEMEIQAEDVGALLGRTKLLISVEDVNDNRPEVIITSLFSPVLENSLPGTVIAFLSVHDQDSGKNGQVVCYTRDNLPFKLEKSIGNYYRLVTRKYLDRENVSIYNITVMASDLGTPPLSTETQIALHVADINDNPPTFPHASYSAYILENNLRGASIFSLTAHDPDSQENAQVTYSVTEDTLQGAPLSSYISINSDTGVLYALQSFDYEQIRDLQLLVTASDSGDPPLSSNMSLSLFVLDQNDNAPEILYPALPTDGSTGVELAPRSAERGYLVTKVVAVDRDSGQNAWLSYRLLKASEPGLFSVGLHTGEVRTARALLDRDALKQSLVVAVQDHGQPPLSATVTLTVAVADSIPEVLTELGSLKPSVDPNDSSLTLYLVVAVAAISCVFLAFVAVLLGLRLRRWHKSRLLQDSGGRLVGVPASHFVGVEEVQAFLQTYSQEVSLTADSRKSHLIFPQPNYADMLISQEGCEKNDSLLTSVDFHEYKNEADHGQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 3407 - protein, 932 aa, unidentified
MAAPTKCQLRGRLVLLCSLLGMLWEARASQIRYSVPEETEKGYIVGNISKDLALEPRELAERRVRIVSRGRTQLFSLNPRSGTLVTAGRIDREELCAQSPRCLVNFKVLVEDRVKLYGIEIEVTDINDSAPKFQAESLEVKINEIAVPGARYPLPEAIDPDVGVNSLQSYQLSPNHHFSLNVQTGDNGAINPELVLERALDREEATAHHLVLTASDGGEPRRSSTVRIHVTVLDTNDNAPVFAQRIYRVKVLENVPPGTWLLTATASDLDEGINGKVAYKFWKINEKQSLLFQLNENTGEISTAKSLDYEECSFYEMEIQAEDGGGLKGWTKVLISVEDVNDNRPEVTITSLFSPVREDAPQGTVILLFNAHDRDSGKNGQVVCSIQENLSFTLENSEEDYYRLLTAQILDREKASEYNITVTATDRGTPPLSTEIHITLQVTDINDNPPAFSQASYSVYLPENNARGTSIFSVIAYDPDSNENSRVIYSLAEDTIQGSPLSTYVSINSDTGVLYALCSFDYEQFRDLQMQVTASDSGSPPLSSNVSLRLFVLDQNDNAPEILYPALPTDGSTGVELAPRSAEPGYLVTKVVAVDRDSGQNAWLSYRLFKASEPGLFSVGLHTGEVRTARALLDRDALKQSLVVAVQDHGQPPLSATVTLTVAIADSIPDILADLGSLQIPADLEASDLTLYLVVAVAVVSCVFLTFVITLLALRLRHWHSSHLLRATSDGLAGVPTSHFVGVDGVRAFLQTYSQEFSLTADSRKSHLIFPQPNYADTLISQQSCEKNEPLCVSVDSKFPIEDTPLVPQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 3408 - protein, 927 aa, unidentified
MQRAREAEMMKSQVLFPFLLSLFCGAISQQIRYTIPEELANGSRVGKLAKDLGLSVRELPTRKLRVSAEDYFNVSLESGDLLVNGRIDREKICGRKLECALEFETVAENPMNVFHVVVVIQDINDNAPRFVAKGIDLEICESALPGVKFSLDSAQDADVEGNSLKLYTINPNQYFSLSTKESPDGSKYPVLLLEKPLDREHQSSHRLILTAMDGGDPPLSGTTHIWIRVTDANDNAPVFSQEVYRVSLQENVPWGTSVLRVMATDQDEGINAEITYAFLNSPISTSLFNLNPNTGDITTNGTLDFEETSRYVLSVEAKDGGVHTAHCNVQIEIVDENDNAPEVTFMSFSNQIPEDSDLGTVIALIKVRDKDSGQNGMVTCYTQEEVPFKLESTSKNYYKLVIAGALNREQTADYNVTIIATDKGKPALSSRTSITLHISDINDNAPVFHQASYVVHVSENNPPGASIAQVSASDPDLGPNGRVSYSILASDLEPRELLSYVSVSPQSGVVFAQRAFDHEQLRAFELTLQARDQGSPALSANVSLRVLVGDLNDNAPRVLYPALGPDGSALFDMVPRAAEPGYLVTKVVAVDADSGHNAWLSYHVLQASEPGLFSLGLRTGEVRTARALGDRDAARQRLLVAVRDGGQPPLSATATLHLIFADSLQEVLPDLSDRPEPSDPQTELQFYLVVALALISVLFLLAVILAIALRLRRSSSLDTEGCFQTGLCSKSGPGVPPNHSEGTLPYSYNLCIASHSAKTEFNSLNLTPEMAPPQDLLCDDPSMVVCASNEDHKIAYDPSLSSHQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 3409 - protein, 931 aa, unidentified
MKASSGRCGLVRWLQVLLPFLLSLFPGALPVQIRYSIPEELAKNSVVGNLAKDLGLSVRDLPARKLRVSAEKEYFTVNPESGDLLVSDRIDREQICGKQPLCVLDFDTVAENPLNIFYIAVIVQDINDNTPLFKQTKINLKIGESTKPGTTFPLDPALDSDVGPNSLQRYHLNDNEYFDLAEKQTPDGRKYPELILKHSLDREEHSLHQLVLTAVDGGDPPQSGTTQIRIKVTDANDNPPVFSQDVYRVTLREDVPPGFFVLQVTATDRDEGINAEITYSFHNVDEQVKHFFNLNEKTGEITTKDDLDFEIASSYTLSIEAKDPGDLAAHCSIQVEILDDNDCAPEVIVTSVSTPLPEDSPPGTVIALIKTRDRDSGENGEVYCQVLGNAKFILKSSSKNYYKLVTDGALDREEIPEYNLTITATDGGKPPLSSSIIVTLHISDVNDNAPVFQQTSYMVHVAENNPPGASIAQISASDPDLGPSGQVSYSIVASDLKPREILSYVSVSAQSGVVFAQRAFDHEQLRAFELTLQARDQGSPALSANVSLRVLVGDLNDNAPRVLYPALGPDGSALFDMVPRAAEPGYLVTKVVAVDADSGHNAWLSYHVLQASEPGLFSLGLRTGEVRTARALGDRDAARQRLLVAVRDGGQPPLSATATLHLIFADSLQEVLPDLSDRREPSDPQAKLQFYLVVALALISVLFFLAVILAISLRLRLSSRSDAWDCFQPGLSSKPGPGVLPNYSEGTLPYSYNLCVASQSAKTEFNFLNITPELVPAQDLVCDNASWEQNTNHGAAGVPFASDTILKQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 3410 - protein, 929 aa, unidentified
MGNSSGWRGPAGQRRMLFLFLLSLLDQALSEPIRYAIPEELDRGSLVGNLAKDLGFGVGDLPTRNLRVIAEKKFFTVSPENGNLLVSDRIDREEICGKKSTCVLEFEMVAEKPLNFFHVTVLIQDINDNPPTFSQNITELEISELALTGATFALESAQDPDVGVNSLQQYYLSPDPHFSLIQKENLDGSRYPELVLKAPLDREEQPHHHLVLTAVDGGEPSRSCTTQIRVIVADANDNPPVFTQDMYRVNVAENLPAGSSVLKVMAIDMDEGINAEIIYAFINIGKEVRQLFKLDSKTGELTTIGELDFEERDSYTIGVEAKDGGHHTAYCKVQIDISDENDNAPEITLASESQHIQEDAELGTAVALIKTHDLDSGFNGEILCQLKGNFPFKIVQDTKNTYRLVTDGALDREQIPEYNVTITATDKGNPPLSSSKTITLHILDVNDNVPVFHQASYTVHVAENNPPGASIAHVRASDPDLGPNGLVSYYIVASDLEPRELSSYVSVSARSGVVFAQRAFDHEQLRAFELTLQARDQGSPTLSANVSLRVLVDDRNDNAPLVLYPALGPEGSALFDMVPRSAEPGYLVTKVVAVDADSGYNAWLSYHIVQASEPGLFSLGLRTGEVRTARTLGDREAARQRLLVTVRDGGQQPLSATVMLHLIFADSLQEIQPDLSDRPTPSDPQAELQFHLVVALALISVLFLLAVILAISLRLRCSSRPATEGYFQPGVCFKTVPGVLPTYSERTLPYSYNPCAASHSSNTEFKFLNIKAENAAPQDLLCDEASWFESNDNPEMPSNSGNLQKQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 3411 - protein, 923 aa, unidentified
MGSGAGELGRAERLPVLFLFLLSLFCPALCEQIRYRIPEEMPKGSVVGNLATDLGFSVQELPTRKLRVSSEKPYFTVSAESGELLVSSRLDREEICGKKPACALEFEAVAENPLNFYHVNVEIEDINDHTPKFTQNSFELQISESAQPGTRFILGSAHDADIGSNTLQNYQLSPSDHFSLINKEKSDGSKYPEMVLKTPLDREKQKSYHLTLTALDFGAPPLSSTAQIHVLVTDANDNAPVFSQDVYRVSLSENVYPGTTVLQVTATDQDEGVNAEITFSFSEASQITQFDLNSNTGEITVLNTLDFEEVKEYSIVLEARDGGGMIAQCTVEVEVIDENDNAPEVIFQSLPNLIMEDAELGTHIALLKVRDKDSRHNGEVTCKLEGDVPFKILTSSRNTYKLVTDAVLDREQNPEYNITVTATDRGKPPLSSSSSITLHIGDVNDNAPVFSQSSYIVHVAENNPPGASISQVRASDPDLGPNGQVSYCIMASDLEQRELSSYVSISAESGVVFAQRAFDHEQLRAFELTLQARDQGSPALSANVSLRVLVDDRNDNAPRVLYPALGPDGSALFDMVPHAAEPGYLVTKVVAVDADSGHNAWLSYHVLQASEPGLFSLGLRTGEVRTARALGDRDAVRQRLLVAVRDGGQPPLSATATLHLVFADSLQEVLPDITDRPDPSDLQAELQFYLVVALALISVLFLVAMILAIALRLRRSSSPASWSCFQPGLCVKSESVVPPNYSEGTLPYSYNLCVAHTGKTEFNFLKCSEQLSSGQDILCGDSSGALFPLCNSSELTSHQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 3412 - protein, 930 aa, unidentified
MGGSCAQRRRAGPRQVLFPLLLPLFYPTLSEPIRYSIPEELAKGSVVGNLAKDLGLSVLDVSARKLRVSAEKLHFSVDAESGDLLVKNRIDREQICKERRRCELQLEAVVENPLNIFHVIVVIEDVNDHAPQFDKKEIHLEIFESASAGTRLSLDPATDPDININSIKDYKINSNPYFSLMVRVNSDGGKYPELSLEKLLDREEQRSHSLILTALDGGDPPRSATAHIEISVKDTNDNPPVFSRDEYRISLSENLPPGSPVLQVTATDQDEGVNAEINYYFRSTAQSTKHMFSLDEKTGMIKNNQSFDFEDVERYTMEVEAKDGGGLSTQCKVIIEILDENDNSPEIIITSLSDQILENSPPGMVVALFKTRDLDFGGNGEVRCNIETDIPFKIYSSSNNYYKLVTDGALDREQTPEYNVTIVATDRGKPPLSSSRSITLYVADINDNAPVFDQTSYVVHVAENNPPGASIAQVSASDPDLGLNGHISYSIVASDLEPLAVSSYVSVSAQSGVVFAQRAFDHEQLRAFALTLQARDHGSPTLSANVSLRVLVGDRNDNAPRVLYPALGPDGSAFFDMVPRSAEPGYLVTKVVAVDADSGHNAWLSYHVLQASEPGLFSLGLRTGEVRTARALGDRDAARQRLLVAVRDGGQPPLSATATLHLVFADNLQEILPDLSDRPVLSDPQAELQFYLVVALALISVLFLLAVILAIALRLRRSLSPATWDCFHPGLCVKSGPVVPPNYSEGTLPYSYNLCIAHTGTKEFNFLKCSVPLHSNEDMVCSVSPGALIPPHGGEDLTSHPETLTSQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 3413 - protein, 929 aa, unidentified
MGGSCAQRRRAGPRQVLFPLLLPLFYPTLCEPIRYSIPEELAKGSVVGNLAKDLGLSVLDVSARELRVSAEKLHFSVDAQSGDLLVKDRIDREQICKERRRCELQLEAVVENPLNIFHVIVVIEDVNDHAPQFRKDEINLEISESVSLGMGTILESAEDPDISMNSLSKYQLSPNEYFSLVEKDNPDGGKYPELVLQKTLDRETQSAHHLVLTALDGGDPPRSGTAQIRILVIDANDNPPVFSQDVYRVSLREDVPPGTSILRVKATDQDEGINSEITYSFFGVADKAQHVFSLDYTTGNILTQQPLDFEEVERYTINIEAKDRGSLSTRCKVIVEVVDENDNSPEIIITSLSDQIMEDSPPGVVVALFKTRDQDSGENGEVRCSLSRGVPFKIHSSSNNYYKLVTDEALDREQTPEYNVTIAATDRGKPPLSSSKTITLHITDVNDNAPVFGQSAYLVHVPENNQPGASIAQVSASDPDFGLNGRVSYSLIASDLESRTLSSYVSVSAQSGVVFAQRAFDHEQLRTFELTLQARDQGSPALSANVSLRVLVGDRNDNAPRVLYPALGPDGSALFDTVPRAAQPGYLVTKVVAVDADSGHNAWLSYHVVQASEPGLFSLGLRTGEVRMVRALGDKDSVRQRLLVAVRDGGQPPLSATATLHLVFADSLQEVLPDFSDHPTPSDSQAEMQFYLVVALALISVLFLLAVILAIALRLRQSFSPTAGDCFESVLCSKSGPVGPPNYSEGTLPYAYNFCVPGDQMNPEFNFFTSVDHCPATQDNLNKDSMLLASILTPSVEADKKILKQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 3414 - protein, 934 aa, unidentified
MVPEAWRSGLVSTGRVVGVLLLLGALNKASTVIHYEIPEEREKGFAVGNVVANLGLDLGSLSARRFRVVSGASRRFFEVNRETGEMFVNDRLDREELCGTLPSCTVTLELVVENPLELFSVEVVIQDINDNNPAFPTQEMKLEISEAVAPGTRFPLESAHDPDVGSNSLQTYELSRNEYFALRVQTREDSTKYAELVLERALDREREPSLQLVLTALDGGTPALSASLPIHIKVLDANDNAPVFNQSLYRARVLEDAPSGTRVVQVLATDLDEGPNGEIIYSFGSHNRAGVRQLFALDLVTGMLTIKGRLDFEDTKLHEIYIQAKDKGANPEGAHCKVLVEVVDVNDNAPEITVTSVYSPVPEDAPLGTVIALLSVTDLDAGENGLVTCEVPPGLPFSLTSSLKNYFTLKTSADLDRETVPEYNLSITARDAGTPSLSALTIVRVQVSDINDNPPQSSQSSYDVYIEENNLPGAPILNLSVWDPDAPQNARLSFFLLEQGAETGLVGRYFTINRDNGIVSSLVPLDYEDRREFELTAHISDGGTPVLATNISVNIFVTDRNDNAPQVLYPRPGGSSVEMLPRGTSAGHLVSRVVGWDADAGHNAWLSYSLLGSPNQSLFAIGLHTGQISTARPVQDTDSPRQTLTVLIKDNGEPSLSTTATLTVSVTEDSPEARAEFPSGSAPREQKKNLTFYLLLSLILVSVGFVVTVFGVIIFKVYKWKQSRDLYRAPVSSLYRTPGPSLHADAVRGGLMSPHLYHQVYLTTDSRRSDPLLKKPGAASPLASRQNTLRSCDPVFYRQVLGAESAPPGQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 3415 - protein, 938 aa, unidentified
MLRKVRSWTEIWRWATLLFLFYHLGYVCGQIRYPVPEESQEGTFVGNVAQDFLLDTDSLSARRLQVAGEVNQRHFRVDLDSGALLIKNPIDREALCGLSASCIVPLEFVTEGPLEMYRAEVEIVDVNDHAPRFPRQQLDLEIGEAAPPGQRFPLEKAQDADVGSNSISSYRLSSNEHFALDVKKRSDGSLVPELLLEKPLDREKQSDYRLVLTAVDGGNPPRSGTAELRVSVLDVNDNAPAFQQSSYRISVLESAPAGMVLIQLNASDPDLGPSGNVTFYFSGHTPDRVRNLFSLHPTTGKLTLLGPLDFESENYYEFDVRARDGGSPAMEQHCSLRVDLLDVNDNAPYITVTSELGTLPESAEPGTVVALISVQDPDSGSNGDVSLRIPDHLPFALKSAFRNQFSLVTAGPLDREAKSSYDIMVTASDAGNPPLSTHRTIFLNISDVNDNPPSFFQRSHEVFVPENNRPGDLLCSLAASDPDSGLNALISYSLLEPRNRDVSASSFISLNPQTGAVHATRSFDYEQTQTLQFEVQARDRGNPPLSSTVTVRLFVLDLNDNAPAVLRPRARPGSLCPQALPPSVGAGHLITKVTAVDLDSGYNAWVSYQLLEAPDPSLFAVSRYAGEVRTAVPIPADLPPQKLVIVVKDSGSPPLSTSVTLLVSLEEDTHPVVPDLRESSAPREGESRLTLYLAVSLVAICFVSFGSFVALLSKCLRGAACGVTCFPAGTCACLTRSRRREGLPPSNGILRIQLGSDDPIKFVDVGGHSHGCTPLASAPTRSDSFMMVKSPSAPMAGEPVRPSCPPSDLLYGLEQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 3416 - protein, 944 aa, unidentified
MGPKTLPQLAGKWQVLCMLSLCCWGWVSGQLRYSVVEESEPGTLVGNVAQDLGLKMTDLLSRRLQLGSEENGRYFSLSLMSGALAVNQKIDRESLCGASTSCLLPVQVVTEHPLELIRVEVEILDLNDNSPSFATPEREMRISESAASGARFPLDSAQDPDVGTNTVSFYTLSPNSHFSLNVKTLKDGKPFPELVLEQQLDREAQARHQLVLTAVDGGTPARSGTTLISVIVLDINDNAPTFQSSVLRVGIPENAPIGTLLLRLNATDPDEGTNGQLDYSFGDHTSEAVRNLFGLDPSSGAIHVLGPIDFEESRFYEIHARARDQGQPAMEGHCVIQVDVGDVNDNAPEVLLASLANPVLESTPVGTVVGLFNVRDRDSGRNGEVSLDISPDLPFQIKPSENHYSLLTSQPLDREATSHYIIELLASDAGSPSLHKHLTIRLNISDVNDNAPRFNQQLYTAYILENRPPGSLLCTVAASDPDTGDNARLTYSIVGNQVQGAPASSFVYVNPEDGRIFAQRTFDYELLQMLQIVVGVRDSGSPPLHANTSLHVFVLDENDNAPAVLHPRPDWEHSAPQRLPRSAPPGSLVTKVTAVDADAGHNAWLSYSLLPQSTAPGLFLVSTHTGEVRTARALLEDDSDTQQVVVLVRDNGDPSLSSTATVLLVLEDEDPEEMPKSSDFLIHPPERSDLTLYLIVALATVSLLSLVTFTFLSAKCLQGNADGDGGGGQCCRRQDSPSPDFYKQSSPNLQVSSDGTLKYMEVTLRPTDSQSHCYRTCFSPASDGSDFTFLRPLSVQQPTALALEPDAIRSRSNTLRERSQQAPPNTDWRFSQAQRPGTSGSQNGDDTGTWPNNQFDTEMLQAMILASASEAADGSSTLGGGAGTMGLSARYGPQFTLQHVPDYRQNVYIPGSNATLTNAAGKRDGKAPAGGNGNKKKSGKKEKK

SEQ ID NO: 3417 - protein, 5142 aa, unidentified
MGNEASLEGEGLPEGLAAAAAAGGGASGAGSPSHTAIPAGMEADLSQLSEEERRQIAAVMSRAQGLPKGSVPPAAAESPSMHRKQELDSSHPPKQSGRPPDPGRPAQPGLSKSRTTDTFRSEQKLPGRSPSTISLKESKSRTDLKEEHKSSMMPGFLSEVNALSAVSSVVNKFNPFDLISDSEASQEETTKKQKVVQKEQGKPEGIIKPPLQQQPPKPIPKQQGPGRDPLQQDGTPKSISSQQPEKIKSQPPGTGKPIQGPTQTPQTDHAKLPLQRDASRPQTKQADIVRGESVKPSLPSPSKPPIQQPTPGKPPAQQPGHEKSQPGPAKPPAQPSGLTKPLAQQPGTVKPPVQPPGTTKPPAQPLGPAKPPAQQTGSEKPSSEQPGPKALAQPPGVGKTPAQQPGPAKPPTQQVGTPKPLAQQPGLQSPAKAPGPTKTPVQQPGPGKIPAQQAGPGKTSAQQTGPTKPPSQLPGPAKPPPQQPGPAKPPPQQPGSAKPPSQQPGSTKPPPQQPGPAKPSPQQPGSTKPPSQQPGSAKPSAQQPSPAKPSAQQSTKPVSQTGSGKPLQPPTVSPSAKQPPSQGLPKTICPLCNTTELLLHVPEKANFNTCTECQTTVCSLCGFNPNPHLTEVKEWLCLNCQMKRALGGDLAPVPSSPQPKLKTAPVTTTSAVSKSSPQPQQTSPKKDAAPKQDLSKAPEPKKPPPLVKQPTLHGSPSAKAKQPPEADSLSKPAPPKEPSVPSEQDKAPVADDKPKQPKMVKPTTDLVSSSSATTKPDIPSSKVQSQAEEKTTPPLKTDSAKPSQSFPPTGEKVSPFDSKAIPRPASDSKIISHPGPSSESKGQKQVDPVQKKEEPKKAQTKMSPKPDAKPMPKGSPTPPGPRPTAGQTVPTPQQSPKPQEQSRRFSLNLGSITDAPKSQPTTPQETVTGKLFGFGASIFSQASNLISTAGQPGPHSQSGPGAPMKQAPAPSQPPTSQGPPKSTGQAPPAPAKSIPVKKETKAPAAEKLEPKAEQAPTVKRTETEKKPPPIKDSKSLTAEPQKAVLPTKLEKSPKPESTCPLCKTELNIGSKDPPNFNTCTECKNQVCNLCGFNPTPHLTEIQEWLCLNCQTQRAISGQLGDIRKMPPAPSGPKASPMPVPTESSSQKTAVPPQVKLVKKQEQEVKTEAEKVILEKVKETLSMEKIPPMVTTDQKQEESKLEKDKASALQEKKPLPEEKKLIPEEEKIRSEEKKPLLEEKKPTPEDKKLLPEAKTSAPEEQKHDLLKSQVQIAEEKLEGRVAPKTVQEGKQPQTKMEGLPSGTPQSLPKEDDKTTKTIKEQPQPPCTAKPDQVEPGKEKTEKEDDKSDTSSSQQPKSPQGLSDTGYSSDGISSSLGEIPSLIPTDEKDILKGLKKDSFSQESSPSSPSDLAKLESTVLSILEAQASTLADEKSEKKTQPHEVSPEQPKDQEKTQSLSETLEITISEEEIKESQEERKDTFKKDSQQDIPSSKDHKEKSEFVDDITTRREPYDSVEESSESENSPVPQRKRRTSVGSSSSDEYKQEDSQGSGEEEDFIRKQIIEMSADEDASGSEDDEFIRNQLKEISSSTESQKKEETKGKGKITAGKHRRLTRKSSTSIDEDAGRRHSWHDEDDEAFDESPELKYRETKSQESEELVVTGGGGLRRFKTIELNSTIADKYSAESSQKKTSLYFDEEPELEMESLTDSPEDRSRGEGSSSLHASSFTPGTSPTSVSSLDEDSDSSPSHKKGESKQQRKARHRPHGPLLPTIEDSSEEEELREEEELLKEQEKQREIEQQQRKSSSKKSKKDKDELRAQRRRERPKTPPSNLSPIEDASPTEELRQAAEMEELHRSSCSEYSPSIESDPEGFEISPEKIIEVQKVYKLPTAVSLYSPTDEQSIMQKEGSQKALKSAEEMYEEMMHKTHKYKAFPAANERDEVFEKEPLYGGMLIEDYIYESLVEDTYNGSVDGSLLTRQEEENGFMQQKGREQKIRLSEQIYEDPMQKITDLQKEFYELESLHSVVPQEDIVSSSFIIPESHEIVDLGTMVTSTEEERKLLDADAAYEELMKRQQMQLTPGSSPTQAPIGEDMTESTMDFDRMPDASLTSSVLSGASLTDSTSSATLSIPDVKITQHFSTEEIEDEYVTDYTREIQEIIAHESLILTYSEPSESATSVPPSDTPSLTSSVSSVCTTDSSSPITTLDSITTVYTEPVDMITKFEDSEEISSSTYFPGSIIDYPEEISVSLDRTAPPDGRASADHIVISLSDMASSIIESVVPKPEGPVADTVSTDLLISEKDPVKKAKKETGNGIILEVLEAYRDKKELEAERTKSSLSETVFDHPPSSVIALPMKEQLSTTYFTSGETFGQEKPASQLPSGSPSVSSLPAKPRPFFRSSSLDISAQPPPPPPPPPPPPPPPPPPPPPPLPPPTSPKPTILPKKKLTVASPVTTATPLFDAVTTLETTAVLRSNGLPVTRICTTAPPPVPPKPSSIPSGLVFTHRPEPSKPPIAPKPVIPQLPTTTQKPTDIHPKPTGLSLTSSMTLNLVTSADYKLPSPTSPLSPHSNKSSPRFSKSLTETYVVITLPSEPGTPTDSSASQAITSWPLGSPSKDLVSVEPVFSVVPPVTAVEIPISSEQTFYISGALQTFSATPVTAPSSFQAAPTSVTQFLTTEVSKTEVSATRSTAPSVGLSSISITIPPEPLALDNIHLEKPQYKEDGKLQLVGDVIDLRTVPKVEVKTTDKCIDLSASTMDVKRQITANEVYGKQISAVQPSIINLSVTSSIVTPVSLATETVTFVTCTASASYTTGTESLVGAEHAMTTPLQLTTSKHAEPPYRIPSDQVFPIAREEAPINLSLGTPAHAVTLAITKPVTVPPVGVTNGWTDSTVSQGITDGEVVDLSTTKSHRTVVTMDESTSSVMTKIIEDEKPVDLTAGRRAVCCDVVYKLPFGRSCTAQQPATTLPEDRFGYRDDHYQYDRSGPYGYRGIGGMKPSMSDTNLAEAGHFFYKSKNAFDYSEGTDTAVDLTSGRVTTGEVMDYSSKTTGPYPETRQVISGAGISTPQYSTARMTPPPGPQYCVGSVLRSSNGVVYSSVATPTPSTFAITTQPGSIFSTTVRDLSGIHTADAVTSLPAMHHSQPMPRSYFITTGASETDIAVTGIDISASLQTITMESLTAETIDSVPTLTTASEVFPEVVGDESALLIVPEEDKQQQQLDLERELLELEKIKQQRFAEELEWERQEIQRFREQEKIMVQKKLEELQSMKQHLLFQQEEERQAQFMMRQETLAQQQLQLEQIQQLQQQLHQQLEEQKIRQIYQYNYDPSGTASPQTTTEQAILEGQYAALEGSQFWATEDATTTASAVVAIEIPQSQGWYTVQSDGVTQYIAPPGILSTVSEIPLTDVVVKEEKQPKKRSSGAKVRGQYDDMGENMTDDPRSFKKIVDSGVQTDDEDATDRSYVSRRRRTKKSVDTSVQTDDEDQDEWDMPTRSRRKARVGKYGDSMTEADKTKPLSKVSSIAVQTVAEISVQTEPVGTIRTPSIRARVDAKVEIIKHISAPEKTYKGGSLGCQTEADSDTQSPQYLSATSPPKDKKRPTPLEIGYSSHLRADSTVQLAPSPPKSPKVLYSPISPLSPGKALESAFVPYEKPLPDDISPQKVLHPDMAKVPPASPKTAKMMQRSMSDPKPLSPTADESSRAPFQYTEGYTTKGSQTMTSSGAQKKVKRTLPNPPPEEISTGTQSTFSTMGTVSRRRICRTNTMARAKILQDIDRELDLVERESAKLRKKQAELDEEEKEIDAKLRYLEMGINRRKEALLKEREKRERAYLQGVAEDRDYMSDSEVSSTRPTRIESQHGIERPRTAPQTEFSQFIPPQTQTESQLVPPTSPYTQYQYSSPALPTQAPTSYTQQSHFEQQTLYHQQVSPYQTQPTFQAVATMSFTPQVQPTPTPQPSYQLPSQMMVIQQKPRQTTLYLEPKITSNYEVIRNQPLMIAPVSTDNTFAVSHLGSKYNSLDLRIGLEERSSMASSPISSISADSFYADIDHHTPRNYVLIDDIGEITKGTAALSTAFSLHEKDLSKTDRLLRTTETRRSQEVTDFLAPLQSSSRLHSYVKAEEDPMEDPYELKLLKHQIKQEFRRGTESLDHLAGLSHYYHADTSYRHFPKSEKYSISRLTLEKQAAKQLPAAILYQKQSKHKKSLIDPKMSKFSPIQESRDLEPDYSSYMTSSTSSIGGISSRARLLQDDITFGLRKNITDQQKFMGSSLGTGLGTLGNTIRSALQDEADKPYSSGSRSRPSSRPSSVYGLDLSIKRDSSSSSLRLKAQEAEALDVSFSHASSSARTKPTSLPISQSRGRIPIVAQNSEEESPLSPVGQPMGMARAAAGPLPPISADTRDQFGSSHSLPEVQQHMREESRTRGYDRDIAFIMDDFQHAMSDSEAYHLRREETDWFDKPRESRLENGHGLDRKLPERLVHSRPLSQHQEQIIQMNGKTMHYIFPHARIKITRDSKDHTVSGNGLGIRIVGGKEIPGHSGEIGAYIAKILPGGSAEQTGKLMEGMQVLEWNGIPLTSKTYEEVQSIISQQSGEAEICVRLDLNMLSDSENSQHLELHEPPKAVDKAKSPGVDPKQLAAELQKVSLQQSPLVLSSVVEKGSHVHSGPTSAGSSSVPSPGQPGSPSVSKKKHGSSKPTDGTKVVSHPITGEIQLQINYDLGNLIIHILQARNLVPRDNNGYSDPFVKVYLLPGRGQVMVVQNASAEYKRRTKHVQKSLNPEWNQTVIYKSISMEQLKKKTLEVTVWDYDRFSSNDFLGEVLIDLSSTSHLDNTPRWYPLKEQTESIDHGKSHSSQSSQQSPKPSVIKSRSHGIFPDPSKDMQVPTIEKSHSSPGSSKSSSEGHLRSHGPSRSQSKTSVTQTHLEDAGAAIAAAEAAVQQLRIQPTKPPNHRPAESSVSTGSSGSSFGSGYSVDSEGSSSTAGETNLFPIPRIGKMGQNGQEPVKQPGVGVGLADTEAKTQVMGEIKIALKKEMKTDGEQLIVEILQCRNITYKFKSPDHLPDLYVKIYVMNISTQKKVIKKKTRVCRHDREPSFNETFRFSLSPAGHSLQILLFSNGGKFMKKTLIGEACIWLDKVDLRKRIVNWHKLLVSPTQTH

SEQ ID NO: 3418 - protein, 2341 aa, unidentified
MGSQTLQILRQGVWAALSGGWYYDPHQATFVNALHLYLWLFLLGLPFTLYMALPSTMIIVAVYCPVIAAVFIVLKMVNYRLHRALDAGEVVDRTANEFTDQRTKAEQGNCSTRRKDSNGPSDPGGGIEMSEFIREATPPVGCSSRNSYAGLDPSNQIGSGSSRLGTAATIKGDTDTAKTSDDISLSLGQSSSLCKEGSEEQDLAADRKLFRLVSNDSFISIQPSLSSCGQDLPRDFSDKVNLPSHNHHHHVDQSLSSACDTEVASLVPLHSHSYRKDHRPRGVPRTSSSAVAFPDTSLNDFPLYQQRRGLDPVSELESSKPLSGSKESLVENSGLSGEFQLAGDLKINTSQPPTKSGKSKPLKAEKSMDSLRSLSTRSSGSTESYCSGTDRDTNSTVSSYKSEQTSSTHIESILSEHEESPKAGTKSGRKKECCAGPEEKNSCASDKRTSSEKIAMEASTNSGVHEAKDPTPSDEMHNQRGLSTSASEEANKNPHANEFTSQGDRPPGNTAENKEEKSDKSAVSVDSKVRKDVGGKQKEGDVRPKSSSVIHRTASAHKSGRRRTGKKRASSFDSSRHRDYVCFRGVSGTKPHSAIFCHDEDSSDQSDLSRASSVQSAHQFSSDSSSSTTSHSCQSPEGRYSALKTKHTHKERGTDSEHTHKAHLVPEGTSKKRATRRTSSTNSAKTRARVLSLDSGTVACLNDSNRLMAPESIKPLTTSKSDLEAKEGEVLDELSLLGRASQLETVTRSRNSLPNQVAFPEGEEQDAVSGAAQASEEAVSFRRERSTFRRQAVRRRHNAGSNPTPPTLLIGSPLSLQDGQQGQQSTAQVKVQSRPPSQAAVLSASASLLVRNGSVHLEASHDNASAVGGSSLHDELGKFSSTLYETGGCDMSLVNFEPAARRASNICDTDSHVSSSTSVRFYPHDVLSLPQIRLNRLLTIDTDLLEQQDIDLSPDLAATYGPTEEAAQKVKHYYRFWILPQLWIGINFDRLTLLALFDRNREILENVLAVILAILVAFLGSILLIQGFFRDIWVFQFCLVIASCQYSLLKSVQPDSSSPRHGHNRIIAYSRPVYFCICCGLIWLLDYGSRNLTATKFKLYGITFTNPLVFISARDLVIVFTLCFPIVFFIGLLPQVNTFVMYLCEQLDIHIFGGNATTSLLAALYSFICSIVAVALLYGLCYGALKDSWDGQHIPVLFSIFCGLLVAVSYHLSRQSSDPSVLFSLVQSKIFPKTEEKNPEDPLSEVKDPLPEKLRNSVSERLQSDLVVCIVIGVLYFAIHVSTVFTVLQPALKYVLYTLVGFVGFVTHYVLPQVRKQLPWHCFSHPLLKTLEYNQYEVRNAATMMWFEKLHVWLLFVEKNIIYPLIVLNELSSSAETIASPKKLNTELGALMITVAGLKLLRSSFSSPTYQYVTVIFTVLFFKFDYEAFSETMLLDLFFMSILFNKLWELLYKLQFVYTYIAPWQITWGSAFHAFAQPFAVPHSAMLFIQAAVSAFFSTPLNPFLGSAIFITSYVRPVKFWERDYNTKRVDHSNTRLASQLDRNPGSDDNNLNSIFYEHLTRSLQHSLCGDLLLGRWGNYSTGDCFILASDYLNALVHLIEIGNGLVTFQLRGLEFRGTYCQQREVEAITEGVEEDEGFCCCEPGHIPHMLSFNAAFSQRWLAWEVIVTKYILEGYSITDNSAASMLQVFDLRKVLTTYYVKGIIYYVTTSSKLEEWLANETMQEGLRLCADRNYVDVDPTFNPNIDEDYDHRLAGISRESFCVIYLNWIEYCSSRRAKPVDVDKDSSLVTLCYGLCVLGRRALGTASHHMSSNLESFLYGLHALFKGDFRISSIRDEWIFADMELLRKVVVPGIRMSIKLHQDHFTSPDEYDDPTVLYEAIVSHEKNLVIAHEGDPAWRSAVLANSPSLLALRHVMDDGTNEYKIIMLNRRYLSFRVIKVNKECVRGLWAGQQQELVFLRNRNPERGSIQNAKQALRNMINSSCDQPIGYPIFVSPLTTSYSDSHEQLKDILGGPISLGNIRNFIVSTWHRLRKGCGAGCNSGGNIEDSDTGGGTSCTGNNATTANNPHSNVTQGSIGNPGQGSGTGLHPPVTSYPPTLGTSHSSHSVQSGLVRQSPARASVASQSSYCYSSRHSSLRMSTTGFVPCRRSSTSQISLRNLPSSIQSRLSMVNQMEPSGQSGLACVQHGLPSSSSSSQSIPACKHHTLVGFLATEGGQSSATDAQPGNTLSPANNSHSRKAEVIYRVQIVDPSQILEGINLSKRKELQWPDEGIRLKAGRNSWKDWSPQEGMEGHVIHRWVPCSRDPGTRSHIDKAVLLVQIDDKYVTVIETGVLELGAEV

SEQ ID NO: 3419 - protein, 2137 aa, unidentified
MVSQVLQLLRQGVWAALTGGWYHDPEQSKFTNSCHLYLWLFLLLLPLALHLAFPPNAIIVFFYCSAVTIFFTIIKLVSYRLHLMFDKGEVIQQKPSRKEEKPNKDKEAKGEHITNHRNPSNNRQIHNGKKEEASRNLSTPPLRCSSRGQSITSHHSSGPLELSAQETVEDLKGVILLEDHPIAPVSSTSPGIKVESLPASQAHMLETTTKSVIPVKPVATETLINGKGKERGGKGQPPLRHRSEGGLVDKGPLKKLPHLSLSQYDLLETDVSFQPWGSENSVLIPEPVSCPRGSIRERVQSKSPQDSLSSSCPQCDTIVAKPVEEPADTSCQVDTSCQGDLPLHQEVDSSDSEVAVTLIDTSQPGDPLSLHEPIKIVITMSSTPNSMTDLESSLHLRVVGTEKTSVKSDAEPTNPGAAGSPNAEQISIPVITLDLPEGGGGGVPCPEGNGSERTPERLKTRVSTNQCSGYGSGEGGNAIKDHSSSSREPWESVSRLTPDTGSESKVGKEGQTNLDPSSCKSSHEKRHARVLSVDSGTDVFLSKSSAEIVNDTEKTMPTSKSDLEAKEGQMPNESNFLEFVSLLESINTSKMTASSQLNGSAEQNEESGLLRDNCSQEKKEEILENEKPSGHSSKQGKPDLQSQDHTSTGPACTQPAKTTAFFQGNRQRQIIYRVTSQQDSSVLQVISGPETSVQEEISVDAMHVFIDEHGEIRSCYLKSGNQKEGPLQPLPSNNDCLSQAREMQVSSSSTTTSESQDPSSGDPAVSALQQQLLLMVARRTQSETPRHVSQDLEASSCSSTQGKFNREQFYKFIIFPGKWIKVWYDRLTLLALLDRTEDIKENVLAILLIVLVSLLGFLTLSQGFCKDMWVLLFCLVMASCQYSLLKSVQPDPASPIHGHNQIITYSRPIYFCVLCGLILLLDTGAKARHPPSYVVYGLKLFSPVFLQSARDYLIVFLYCFPAISLLGLFPQINTFCTYLLEQIDMLFFGGSAVSGITSAVYSVARSVLAAALLHAVCFSAVKEPWSMQHIPALFSAFCGLLVALSYHLSRQSSDPSVLMSFIQCRLFPKFLHQNLAESAADPLPKKMKDSVTDVLKWDLIVCAVVAVLSFAVSASTVFLSLRPFLSIVLFALAGAVGFVTHYVLPQLRKHHPWMWISHPILKNKEYHQREVRDVAHLMWFERLYVWLQCFEKYILYPALILNALTIDAFLISNHRRLGTHWDIFLMIIAGMKLLRTSFCNPVYQFINLSFTVIFFHFDYKDISESFLLDFFMVSILFSKLGDLLHKLQFVLTYVAPWQMAWGSSFHVFAQLFAIPHSAMLFFQTIATSIFSTPLSPFLGSVIFITSYVRPVKFWEKNYNTRRVDNSNTRLAVQIERDPGNDDNNLNSIFYEHLTRTLQESLCGDLVLGRWGNYSSGDCFILASDDLNAFVHLIEIGNGLVTFQLRGLEFRGTYCQQREVEAIMEGDEEDRGCCCCKPGHLPHLLSCNAAFHLRWLTWEITQTQYILEGYSILDNNAATMLQVFDLRRILIRYYIKSIIYYMVTSPKLLSWIKNESLLKSLQPFAKWHYIERDLAMFNINIDDDYVPCLQGITRASFCNVYLEWIQHCARKRQEPSTTLDSDEDSPLVTLSFALCTLGRRALGTAAHNMAISLDSFLYGLHVLFKGDFRITARDEWVFADMDLLHKVVAPAIRMSLKLHQDQFTCPDEYEDPAVLYEAIQSFEKKVVICHEGDPAWRGAVLSNKEELLTLRHVVDEGADEYKVIMLHRSFLSFKVIKVNKECVRGLWAGQQQELIFLRNRNPERGSIQNNKQVLRNLINSSCDQPLGYPMYVSPLTTSYLGTHRQLKNIWGGPITLDRIRTWFWTKWVRMRKDCNARQHSGGNIEDVDGGGAPTTGGNNAPSGGSQESSAEQPRKGGAQHGVSSCEGTQRTGRRKGRSQSVQAHSALSQRPPMLSSSGPILESRQTFLQTSTSVHELAQRLSGSRLSLHASATSLHSQPPPVTTTGHLSVRERAEALIRSSLGSSTSSTLSFLFGKRSFSSALVISGLSAAEGGNTSDTQSSSSVNIVMGPSARAASQATRHLSEPCEPPDATEQGQLHDRCLAEAVADTLGVVCRRASQEDMGLDDTASQQSVSDEQ

SEQ ID NO: 3420 - protein, 2034 aa, unidentified
MGSQVLQILRQGVWASLTGGWFFDPHQSTFSNCFHLYVWIFLLIFPFLLYMVLPPSLMVAGVYCLVVAVIFATIKTVNYRLHAMFDQGEIVEKRSSTMGELEEEPAQGDSNPPRDPGVEMTVFRKVSSTPPVRCSSQHSVFGFNQVSELLPRMEDSGPLRDIKELVREQGSNNVIVTSADREMLKLSSQEKLIGDLPQTPPGAVPDPSLASTDSSEPSPLAGDGAPWSGSSMADTPMSPLLKGSLSQELSKSFLTLTQPDRALVRTSSRREQRRGAGGYQPLDRRGSGEPTPQKAGSSDSCFSGTDRETLSSFKSEKTNSTHLDSPPGGPAPEGSDTDPPSEAELPASPDAGVPSDDTLRSFDTVIGAGTPPGLAEPLLVVRPKDLALLRPSKRQPPLRRHSPPGRAPRRPLLEGGGFFEDEDTSEGSELSPASSLRSQRRYSTDSSSSTSCYSPESSRGAAGGPRKRRAPHGAEEGTAVPPKRPYGTQRTPSTASAKTHARVLSMDGAGGDVLRPPLAGCKAELEAQVGVEQAASEPVVLPAEARRGPAANQPGWRGELQEEGAVGGAAEETGRRDRSSSVRRTQAIRRRHNAGSNPTPPASVMGSPPSSLQEAQRGRAASHSRALTLPSALHFASSLLLTRAGANVHEACTFDDTSEGAVHYFYDESGVRRSYTFGLAGGGYENPVGQQGEQTANGAWDRHSHSSSFHSADVPEATGGLNLLQPRPVVLQGMQVRRVPLEIPEEQTLMEEAPPRAQHSYKYWLLPGRWTSVRYERLALLALLDRTRGVLENIFGVGLSSLVAFLGYLLLLKGFFTDIWVFQFCLVIASCQYSLLKSVQPDAASPMHGHNWVIAYSRPVYFCICCLLIWLLDALGSAQPFPPVSLYGLTLFSASFFFCARDVATVFTLCFPFVFLLGLLPQVNTCLMYLLEQIDMHGFGGTAATSPLTAVFSLSRSLLAAALLYGFCLGAIKTPWPEQHVPVLFSVFCGLLVALSYHLSRQSSDPTVLWSLIRSKLFPELEERSLETARAEPPDPLPDKMRQSVREVLHSDLVMCVVIAVLTFAISASTVFIALKSVLGFVLYALAGAVGFFTHYLLPQLRKQLPWFCLSQPVLKPLEYSQYEVRGAAQVMWFEKLYAGLQCVEKYLIYPAVVLNALTVDAHTVVSHPDKYCFYCRALLMTVAGLKLLRSAFCCPPQQYLTLAFTVLLFHFDYPRLSQGFLLDYFLMSLLCSKLWDLLYKLRFVLTYIAPWQITWGSAFHAFAQPFAVPHSAMLFVQALLSGLFSTPLNPLLGSAVFIMSYARPLKFWERDYNTKRVDHSNTRLVTQLDRNPGADDNNLNSIFYEHLTRSLQHTLCGDLVLGRWGNYGPGDCFVLASDYLNALVHLIEVGNGLVTFQLRGLEFRGTYCQQREVEAITEGVEEDEGCCCCEPGHLPRVLSFNAAFGQRWLAWEVTASKYVLEGYSISDNNAASMLQVFDLRKILITYYVKSIIYYVSRSPKLEVWLSHEGITAALRPVRVPGYADSDPTFSLSVDEDYDLRLSGLSLPSFCAVHLEWIQYCASRRSQPVDQDWNSPLVTLCFGLCVLGRRALGTASHSMSASLEPFLYGLHALFKGDFRITSPRDEWVFADMDLLHRVVAPGVRMALKLHQDHFTSPDEYEEPAALYDAIAANEERLVISHEGDPAWRSAILSNTPSLLALRHVLDDASDEYKIIMLNRRHLSFRVIKVNRECVRGLWAGQQQELVFLRNRNPERGSIQNAKQALRNMINSSCDQPLGYPIYVSPLTTSLAGSHPQLRALWGGPISLGAIAHWLLRTWERLHKGCGAGCNSGGNVDDSDCSGGGGLTSLSNNPPVAHPTPENTAGNGDQPLPPGPGWGPRSSLSGSGDGRPPPLLQWPPPRLPGPPPASPIPTEGPRTSRPPGPGLLSSEGPSGKWSLGGRKGLGGSDGEPASGSPKGGTPKSQAPLDLSLSLSLSLSPDVSTEASPPRASQDIPCLDSSAPESGTPMGALGDWPAPIEERESPAAQPLLEHQY

SEQ ID NO: 3421 - protein, 1172 aa, unidentified
MSPDVPLLNDYKQDFFLKRFPQTVLGGPRFKLGYCAPPYIYVNQIILFLMPWVWGGVGTLLYQLGILKDYYTAALSGGLMLFTAFVIQFTSLYAKNKSTTVERILTTDILAEEDEHEFTSCTGAETVKFLIPGKKYVANTVFHSILAGLACGLGTWYLLPNRITLLYGSTGGTALLFFFGWMTLCIAEYSLIVNTATETATFQTQDTYEIIPLMRPLYIFFFVSVDLAHRFVVNMPALEHMNQILHILFVFLPFLWALGTLPPPDALLLWAMEQVLEFGLGGSSMSTHLRLLVMFIMSAGTAIASYFIPSTVGVVLFMTGFGFLLSLNLSDMGHKIGTKSKDLPSGPEKHFSWKECLFYIIILVLALLETSLLHHFAGFSQISKSNSQAIVGYGLMILLIILWILREIQSVYIIGIFRNPFYPKDVQTVTVFFEKQTRLMKIGIVRRILLTLVSPFAMIAFLSLDSSLQGLHSVSVCIGFTRAFRMVWQNTENALLETVIVSTVHLISSTDIWWNRSLDTGLRLLLVGIIRDRLIQFISKLQFAVTVLLTSWTEKKQRRKTTATLCILNIVFSPFVLVIIVFSTLLSSPLLPLFTLPVFLVGFPRPIQSWPGAAGTTACVCADTVYYYQMVPRLTAVLQTAMAAGSLGLLLPGSHYLGRFQDRLMWIMILECGYTYCSINIKGLELQETSCHTAEARRVDEVFEDAFEQEYTRVCSLNEHFGNVLTPCTVLPVKLYSDARNVLSGIIDSHENLKEFKGDLIKVLVWILVQYCSKRPGMKENVHNTENKGKAPLMLPALNTLPPPKSPEDIDSLNSETFNDWSDDNIFDDEPTIKKVIEEKHQLKDLPGTNLFIPGSVESQRVGDHSTGTVPENDLYKAVLLGYPAVDKGKQEDMPYIPLMEFSCSHSHLVCLPAEWRTSCMPSSKMKEMSSLFPEDWYQFVLRQLECYHSEEKASNVLEEIAKDKVLKDFYVHTVMTCYFSLFGIDNMAPSPGHILRVYGGVLPWSVALDWLTEKPELFQLALKAFRYTLKLMIDKASLGPIEDFRELIKYLEEYERDWYIGLVSDEKWKEAILQEKPYLFSLGYDSNMGIYTGRVLSLQELLIQVGKLNPEAVRGQWANLSWELLYATNDDEERYSIQAHPLLLRNLTVQAAEPPLGYPIYSSKPLHIHLY

SEQ ID NO: 3422 - protein, 755 aa, unidentified
MRPAPIALWLRLVLALALVRPRAVGWAPVRAPIYVSSWAVQVSQGNREVERLARKFGFVNLGPIFPDGQYFHLRHRGVVQQSLTPHWGHRLHLKKNPKVQWFQQQTLQRRVKRSVVVPTDPWFSKQWYMNSEAQPDLSILQAWSQGLSGQGIVVSVLDDGIEKDHPDLWANYDPLASYDFNDYDPDPQPRYTPSKENRHGTRCAGEVAAMANNGFCGVGVAFNARIGGVRMLDGTITDVIEAQSLSLQPQHIHIYSASWGPEDDGRTVDGPGILTREAFRRGVTKGRGGLGTLFIWASGNGGLHYDNCNCDGYTNSIHTLSVGSTTQQGRVPWYSEACASTLTTTYSSGVATDPQIVTTDLHHGCTDQHTGTSASAPLAAGMIALALEANPFLTWRDMQHLVVRASKPAHLQAEDWRTNGVGRQVSHHYGYGLLDAGLLVDTARTWLPTQPQRKCAVRVQSRPTPILPLIYIRENVSACAGLHNSIRSLEHVQAQLTLSYSRRGDLEISLTSPMGTRSTLVAIRPLDVSTEGYNNWVFMSTHFWDENPQGVWTLGLENKGYYFNTGTLYRYTLLLYGTAEDMTARPTGPQVTSSACVQRDTEGLCQACDGPAYILGQLCLAYCPPRFFNHTRLVTAGPGHTAAPALRVCSSCHASCYTCRGGSPRDCTSCPPSSTLDQQQGSCMGPTTPDSRPRLRAAACPHHRCPASAMVLSLLAVTLGGPVLCGMSMDLPLYAWLSRARATPTKPQVWLPAGT

SEQ ID NO: 3423 - protein, 1860 aa, unidentified
MGWGSRCCCPGRLDLLCVLALLGGCLLPVCRTRVYTNHWAVKIAGGFPEANRIASKYGFINIGQIGALKDYYHFYHSRTIKRSVISSRGTHSFISMEPKVEWIQQQVVKKRTKRDYDFSRAQSTYFNDPKWPSMWYMHCSDNTHPCQSDMNIEGAWKRGYTGKNIVVTILDDGIERTHPDLMQNYDALASCDVNGNDLDPMPRYDASNENKHGTRCAGEVAAAANNSHCTVGIAFNAKIGGVRMLDGDVTDMVEAKSVSFNPQHVHIYSASWGPDDDGKTVDGPAPLTRQAFENGVRMGRRGLGSVFVWASGNGGRSKDHCSCDGYTNSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGPCDPECSEVGCDGPGPDHCNDCLHYYYKLKNNTRICVSSCPPGHYHADKKRCRKCAPNCESCFGSHGDQCMSCKYGYFLNEETNSCVTHCPDGSYQDTKKNLCRKCSENCKTCTEFHNCTECRDGLSLQGSRCSVSCEDGRYFNGQDCQPCHRFCATCAGAGADGCINCTEGYFMEDGRCVQSCSISYYFDHSSENGYKSCKKCDISCLTCNGPGFKNCTSCPSGYLLDLGMCQMGAICKDGEYVDEHGHCQTCEASCAKCQGPTQEDCTTCPMTRIFDDGRCVSNCPSWKFEFENQCHPCHHTCQRCQGSGPTHCTSCGADNYGREHFLYQGECGDSCPEGHYATEGNTCLPCPDNCELCHSVHVCTRCMKGYFIAPTNHTCQKLECGQGEVQDPDYEECVPCEEGCLGCSLDDPGTCTSCAMGYYRFDHHCYKTCPEKTYSEEVECKACDSNCGSCDQNGCYWCEEGFFLLGGSCVRKCGPGFYGDQEMGECESCHRACETCTGPGHDECSSCQEGLQLLRGMCVHATKTQEEGKFWNDILRKLQPCHSSCKTCNGSATLCTSCPKGAYLLAQACVSSCPQGTWPSVRSGSCENCTEACAICSGADLCKKCQMQPGHPLFLHEGRCYSKCPEGSYAEDGICERCSSPCRTCEGNATNCHSCEGGHVLHHGVCQENCPERHVAVKGVCKHCPEMCQDCIHEKTCKECTPEFFLHDDMCHQSCPRGFYADSRHCVPCHKDCLECSGPKADDCELCLESSWVLYDGLCLEECPAGTYYEKETKECRDCHKSCLTCSSSGTCTTCQKGLIMNPRGSCMANEKCSPSEYWDEDAPGCKPCHVKCFHCMGPAEDQCQTCPMNSLLLNTTCVKDCPEGYYADEDSNRCAHCHSSCRTCEGRHSRQCHSCRPGWFQLGKECLLQCREGYYADNSTGRCERCNRSCKGCQGPRPTDCLSCDRFFFLLRSKGECHRSCPDHYYVEQSTQTCERCHPTCDQCKGKGALNCLSCVWSYHLMGGICTSDCLVGEYRVGEGEKFNCEKCHESCMECKGPGAKNCTLCPANLVLHMDDSHCLHCCNTSDPPSAQECCDCQDTTDECILRTSKVRPATEHFKTALFITSSMMLVLLLGAAVVVWKKSRGRVQPAAKAGYEKLADPNKSYSSYKSSYRESTSFEEDQVIEYRDRDYDEDDDDDIVYMGQDGTVYRKFKYGLLDDDDIDELEYDDESYSYYQ

SEQ ID NO: 3424 - protein, 785 aa, unidentified
MPKGRQKVPHLDAPLGLPTCLWLELAGLFLLVPWVMGLAGTGGPDGQGTGGPSWAVHLESLEGDGEEETLEQQADALAQAAGLVNAGRIGELQGHYLFVQPAGHRPALEVEAIRQQVEAVLAGHEAVRWHSEQRLLRRAKRSVHFNDPKYPQQWHLNNRRSPGRDINVTGVWERNVTGRGVTVVVVDDGVEHTIQDIAPNYSPEGSYDLNSNDPDPMPHPDVENGNHHGTRCAGEIAAVPNNSFCAVGVAYGSRIAGIRVLDGPLTDSMEAVAFNKHYQINDIYSCSWGPDDDGKTVDGPHQLGKAALQHGVIAGRQGFGSIFVVASGNGGQHNDNCNYDGYANSIYTVTIGAVDEEGRMPFYAEECASMLAVTFSGGDKMLRSIVTTDWDLQKGTGCTEGHTGTSAAAPLAAGMIALMLQVRPCLTWRDVQHIIVFTATRYEDRRAEWVTNEAGFSHSHQHGFGLLNAWRLVNAAKIWTSVPYLASYVSPVLKENKAIPQSPRSLEVLWNVSRMDLEMSGLKTLEHVAVTVSITHPRRGSLELKLFCPSGMMSLIGAPRSMDSDPNGFNDWTFSTVRCWGERARGTYRLVIRDVGDESFQVGILRQWQLTLYGSVWSAVDIRDRQRLLESAMSGKYLHDDFALPCPPGLKIPEEDGYTITPNTLKTLVLVGCFTVFWTVYYMLEVYLSQRNVASNQVCRSGPCHWPHRSRKAKEEGTELESVPLCSSKDPDEVETESRGPPTTSDLLAPDLLEQGDWSLSQNKSALDCPHQHLDVPHGKEEQIC

SEQ ID NO: 3425 - protein, 288 aa, unidentified
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 3426 - protein, 273 aa, unidentified
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCIIAFIFIATVIALRKQLCQKLYSSKDTTKRPVTTTKREVNSAI

SEQ ID NO: 3427 - protein, 1141 aa, unidentified
MAVPGDAARVRDKPVHSGVSQAPTAGRDCHHRADPASPRDSGCRGCWGDLVLQPLRSSRKLSSALCAGSLSFLLALLVRLVRGEVGCDLEQCKEAAAAEEEEAAPGAEGGVFPGPRGGAPGGGARLSPWLQPSALLFSLLCAFFWMGLYLLRAGVRLPLAVALLAACCGGEALVQIGLGVGEDHLLSLPAAGVVLSCLAAATWLVLRLRLGVLMIALTSAVRTVSLISLERFKVAWRPYLAYLAGVLGILLARYVEQILPQSAEAAPREHLGSQLIAGTKEDIPVFKRRRRSSSVVSAEMSGCSSKSHRRTSLPCIPREQLMGHSEWDHKRGPRGSQSSGTSITVDIAVMGEAHGLITDLLADPSLPPNVCTSLRAVSNLLSTQLTFQAIHKPRVNPVTSLSENYTCSDSEESSEKDKLAIPKRLRRSLPPGLLRRVSSTWTTTTSATGLPTLEPAPVRRDRSTSIKLQEAPSSSPDSWNNPVMMTLTKSRSFTSSYAISAANHVKAKKQSRPGALAKISPLSSPCSSPLQGTPASSLVSKISAVQFPESADTTAKQSLGSHRALTYTQSAPDLSPQILTPPVICSSCGRPYSQGNPADEPLERSGVATRTPSRTDDTAQVTSDYETNNNSDSSDIVQNEDETECLREPLRKASACSTYAPETMMFLDKPILAPEPLVMDNLDSIMEQLNTWNFPIFDLVENIGRKCGRILSQVSYRLFEDMGLFEAFKIPIREFMNYFHALEIGYRDIPYHNRIHATDVLHAVWYLTTQPIPGLSTVINDHGSTSDSDSDSGFTHGHMGYVFSKTYNVTDDKYGCLSGNIPALELMALYVAAAMHDYDHPGRTNAFLVATSAPQAVLYNDRSVLENHHAAAAWNLFMSRPEYNFLINLDHVEFKHFRFLVIEAILATDLKKHFDFVAKFNGKVNDDVGIDWTNENDRLLVCQMCIKLADINGPAKCKELHLQWTDGIVNEFYEQGDEEASLGLPISPFMDRSAPQLANLQESFISHIVGPLCNSYDSAGLMPGKWVEDSDESGDTDDPEEEEEEAPAPNEEETCENNESPKKKTFKRRKIYCQITQHLLQNHKMWKKVIEEEQRLAGIENQSLDQTPQSHSSEQIQAIKEEEEEKGKPRGEEIPTQKPDQ

SEQ ID NO: 3428 - protein, 1112 aa, unidentified
MRRDERDAKAMRSLQPPDGAGSPPESLRNGYVKSCVSPLRQDPPRGFFFHLCRFCNVELRPPPASPQQPRRCSPFCRARLSLGALAAFVLALLLGAEPESWAAGAAWLRTLLSVCSHSLSPLFSIACAFFFLTCFLTRTKRGPGPGRSCGSWWLLALPACCYLGDFLVWQWWSWPWGDGDAGSAAPHTPPEAAAGRLLLVLSCVGLLLTLAHPLRLRHCVLVLLLASFVWWVSFTSLGSLPSALRPLLSGLVGGAGCLLALGLDHFFQIREAPLHPRLSSAAEEKVPVIRPRRRSSCVSLGETAASYYGSCKIFRRPSLPCISREQMILWDWDLKQWYKPHYQNSGGGNGVDLSVLNEARNMVSDLLTDPSLPPQVISSLRSISSLMGAFSGSCRPKINPLTPFPGFYPCSEIEDPAEKGDRKLNKGLNRNSLPTPQLRRSSGTSGLLPVEQSSRWDRNNGKRPHQEFGISSQGCYLNGPFNSNLLTIPKQRSSSVSLTHHVGLRRAGVLSSLSPVNSSNHGPVSTGSLTNRSPIEFPDTADFLNKPSVILQRSLGNAPNTPDFYQQLRNSDSNLCNSCGHQMLKYVSTSESDGTDCCSGKSGEEENIFSKESFKLMETQQEEETEKKDSRKLFQEGDKWLTEEAQSEQQTNIEQEVSLDLILVEEYDSLIEKMSNWNFPIFELVEKMGEKSGRILSQVMYTLFQDTGLLEIFKIPTQQFMNYFRALENGYRDIPYHNRIHATDVLHAVWYLTTRPVPGLQQIHNGCGTGNETDSDGRINHGRIAYISSKSCSNPDESYGCLSSNIPALELMALYVAAAMHDYDHPGRTNAFLVATNAPQAVLYNDRSVLENHHAASAWNLYLSRPEYNFLLHLDHVEFKRFRFLVIEAILATDLKKHFDFLAEFNAKANDVNSNGIEWSNENDRLLVCQVCIKLADINGPAKVRDLHLKWTEGIVNEFYEQGDEEANLGLPISPFMDRSSPQLAKLQESFITHIVGPLCNSYDAAGLLPGQWLEAEEDNDTESGDDEDGEELDTEDEEMENNLNPKPPRRKSRRRIFCQLMHHLTENHKIWKEIVEEEEKCKADGNKLQVENSSLPQADEIQVIEEADEEE

SEQ ID NO: 3429 - protein, 1089 aa, unidentified
MGTSHPAFLVLGCLLTGLSLILCQLSLPSILPNENEKVVQLNSSFSLRCFGESEVSWQYPMSEEESSDVEIRNEENNSGLFVTVLEVSSASAAHTGLYTCYYNHTQTEENELEGRHIYIYVPDPDVAFVPLGMTDYLVIVEDDDSAIIPCRTTDPETPVTLHNSEGVVPASYDSRQGFNGTFTVGPYICEATVKGKKFQTIPFNVYALKATSELDLEMEALKTVYKSGETIVVTCAVFNNEVVDLQWTYPGEVKGKGITMLEEIKVPSIKLVYTLTVPEATVKDSGDYECAARQATREVKEMKKVTISVHEKGFIEIKPTFSQLEAVNLHEVKHFVVEVRAYPPPRISWLKNNLTLIENLTEITTDVEKIQEIRYRSKLKLIRAKEEDSGHYTIVAQNEDAVKSYTFELLTQVPSSILDLVDDHHGSTGGQTVRCTAEGTPLPDIEWMICKDIKKCNNETSWTILANNVSNIITEIHSRDRSTVEGRVTFAKVEETIAVRCLAKNLLGAENRELKLVAPTLRSELTVAAAVLVLLVIVIISLIVLVVIWKQKPRYEIRWRVIESISPDGHEYIYVDPMQLPYDSRWEFPRDGLVLGRVLGSGAFGKVVEGTAYGLSRSQPVMKVAVKMLKPTARSSEKQALMSELKIMTHLGPHLNIVNLLGACTKSGPIYIITEYCFYGDLVNYLHKNRDSFLSHHPEKPKKELDIFGLNPADESTRSYVILSFENNGDYMDMKQADTTQYVPMLERKEVSKYSDIQRSLYDRPASYKKKSMLDSEVKNLLSDDNSEGLTLLDLLSFTYQVARGMEFLASKNCVHRDLAARNVLLAQGKIVKICDFGLARDIMHDSNYVSKGSTFLPVKWMAPESIFDNLYTTLSDVWSYGILLWEIFSLGGTPYPGMMVDSTFYNKIKSGYRMAKPDHATSEVYEIMVKCWNSEPEKRPSFYHLSEIVENLLPGQYKKSYEKIHLDFLKSDHPAVARMRVDSDNAYIGVTYKNEEDKLKDWEGGLDEQRLSADSGYIIPLPDIDPVPEEEDLGKRNRHSSQTSEESAIETGSSSSTFIKREDETIEDIDMMDDIGIDSSDLVEDSFL

SEQ ID NO: 3430 - protein, 1106 aa, unidentified
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQVSSINVSVNAVQTVVRQGENITLMCIVIGNEVVNFEWTYPRKESGRLVEPVTDFLLDMPYHIRSILHIPSAELEDSGTYTCNVTESVNDHQDEKAINITVVESGYVRLLGEVGTLQFAELHRSRTLQVVFEAYPPPTVLWFKDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKRCPRELPPTLLGNSSEEESQLETNVTYWEEEQEFEVVSTLRLQHVDRPLSVRCTLRNAVGQDTQEVIVVPHSLPFKVVVISAILALVVLTIISLIILIMLWQKKPRYEIRWKVIESVSSDGHEYIYVDPMQLPYDSTWELPRDQLVLGRTLGSGAFGQVVEATAHGLSHSQATMKVAVKMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESDGGYMDMSKDESVDYVPMLDMKGDVKYADIESSNYMAPYDNYVPSAPERTCRATLINESPVLSYMDLVGFSYQVANGMEFLASKNCVHRDLAARNVLICEGKLVKICDFGLARDIMRDSNYISKGSTFLPLKWMAPESIFNSLYTTLSDVWSFGILLWEIFTLGGTPYPELPMNEQFYNAIKRGYRMAQPAHASDEIYEIMQKCWEEKFEIRPPFSQLVLLLERLLGEGYKKKYQQVDEEFLRSDHPAILRSQARLPGFHGLRSPLDTSSVLYTAVQPNEGDNDYIIPLPDPKPEVADEGPLEGSPSLASSTLNEVNTSSTISCDSPLEPQDEPEPEPQLELQVEPEPELEQLPDSGCPAPRAEAEDSFL

SEQ ID NO: 3431 - protein, 440 aa, unidentified
MALLVLGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 3432 - protein, 341 aa, unidentified
MVSSQPKYDLIREVGRGSYGVVYEAVIRKTSARVAVKKIRCHAPENVELALREFWALSSIKSQHPNVIHLEECILQKDGMVQKMSHGSNSSLYLQLVETSLKGEIAFDPRSAYYLWFVMDFCDGGDMNEYLLSRKPNRKTNTSFMLQLSSALAFLHKNQIIHRDLKPDNILISQTRLDTSDLEPTLKVADFGLSKVCSASGQNPEEPVSVNKCFLSTACGTDFYMAPEVWEGHYTAKADIFALGIIIWAMLERITFIDTETKKELLGSYVKQGTEIVPVGEALLENPKMELLIPVKKKSMNGRMKQLIKEMLAANPQDRPDAFELELRLVQIAFKDSSWET

SEQ ID NO: 3433 - protein, 596 aa, unidentified
MSNYSVSLVGPAPWGFRLQGGKDFNMPLTISSLKDGGKAAQANVRIGDVVLSIDGINAQGMTHLEAQNKIKGCTGSLNMTLQRASAAPKPEPVPVQKGEPKEVVKPVPITSPAVSKVTSTNNMAYNKAPRPFGSVSSPKVTSIPSPSSAFTPAHATTSSHASPSPVAAVTPPLFAASGLHANANLSADQSPSALSAGKTAVNVPRQPTVTSVCSETSQELAEGQRRGSQGDSKQQNGPPRKHIVERYTEFYHVPTHSDASKKRLIEDTEDWRPRTGTTQSRSFRILAQITGTEHLKESEADNTKKANNSQEPSPQLASSVASTRSMPESLDSPTSGRPGVTSLTAAAAFKPVGSTGVIKSPSWQRPNQGVPSTGRISNSATYSGSVAPANSALGQTQPSDQDTLVQRAEHIPAGKRTPMCAHCNQVIRGPFLVALGKSWHPEEFNCAHCKNTMAYIGFVEEKGALYCELCYEKFFAPECGRCQRKILGEVISALKQTWHVSCFVCVACGKPIRNNVFHLEDGEPYCETDYYALFGTICHGCEFPIEAGDMFLEALGYTWHDTCFVCSVCCESLEGQTFFSKKDKPLCKKHAHSVNF

SEQ ID NO: 3434 - protein, 162 aa, unidentified
MWKVSALLFVLGSASLWVLAEGASTGQPEDDTETTGLEGGVAMPGAEDDVVTPGTSEDRYKSGLTTLVATSVNSVTGIRIEDLPTSESTVHAQEQSPSATASNVATSHSTEKVDGDTQTTVEKDGLSTVTLVGIIVGVLLAIGFIGAIIVVVMRKMSGRYSP

SEQ ID NO: 3435 - protein, 114 aa, unidentified
MSALSLLILGLLTAVPPASCQQGLGNLQPWMQGLIAVAVFLVLVAIAFAVNHFWCQEEPEPAHMILTVGNKADGVLVGTDGRYSSMAASFRSSEHENAYENVPEEEGKVRSTPM

SEQ ID NO: 3436 - protein, 1037 aa, unidentified
MSPPLCPLLLLAVGLRLAGTLNPSDPNTCSFWESFTTTTKESHSRPFSLLPSEPCERPWEGPHTCPQPTVVYRTVYRQVVKTDHRQRLQCCHGFYESRGFCVPLCAQECVHGRCVAPNQCQCVPGWRGDDCSSECAPGMWGPQCDKPCSCGNNSSCDPKSGVCSCPSGLQPPNCLQPCTPGYYGPACQFRCQCHGAPCDPQTGACFCPAERTGPSCDVSCSQGTSGFFCPSTHSCQNGGVFQTPQGSCSCPPGWMGTICSLPCPEGFHGPNCSQECRCHNGGLCDRFTGQCRCAPGYTGDRCREECPVGRFGQDCAETCDCAPDARCFPANGACLCEHGFTGDRCTDRLCPDGFYGLSCQAPCTCDREHSLSCHPMNGECSCLPGWAGLHCNESCPQDTHGPGCQEHCLCLHGGVCQATSGLCQCAPGYTGPHCASLCPPDTYGVNCSARCSCENAIACSPIDGECVCKEGWQRGNCSVPCPPGTWGFSCNASCQCAHEAVCSPQTGACTCTPGWHGAHCQLPCPKGQFGEGCASRCDCDHSDGCDPVHGRCQCQAGWMGARCHLSCPEGLWGVNCSNTCTCKNGGTCLPENGNCVCAPGFRGPSCQRSCQPGRYGKRCVPCKCANHSFCHPSNGTCYCLAGWTGPDCSQPCPPGHWGENCAQTCQCHHGGTCHPQDGSCICPLGWTGHHCLEGCPLGTFGANCSQPCQCGPGEKCHPETGACVCPPGHSGAPCRIGIQEPFTVMPTTPVAYNSLGAVIGIAVLGSLVVALVALFIGYRHWQKGKEHHHLAVAYSSGRLDGSEYVMPDVPPSYSHYYSNPSYHTLSQCSPNPPPPNKVPGPLFASLQNPERPGGAQGHDNHTTLPADWKHRREPPPGPLDRGSSRLDRSYSYSYSNGPGPFYNKGLISEEELGASVASLSSENPYATIRDLPSLPGGPRESSYMEMKGPPSGSPPRQPPQFWDSQRRRQPQPQRDSGTYEQPSPLIHDRDSVGSQPPLPPGLPPGHYDSPKNSHIPGHYDLPPVRHPPSPPLRRQDR

SEQ ID NO: 3437 - protein, 199 aa, unidentified
MTRLLGYVDPLDPSFVAAVITITFNPLYWNVVARWEHKTRKLSRAFGSPYLACYSLSVTILLLNFLRSHCFTQAMLSQPRMESLDTPAAYSLGLALLGLGVVLVLSSFFALGFAGTFLGDYFGILKEARVTVFPFNILDNPMYWGSTANYLGWAIMHASPTGLLLTVLVALTYIVALLYEEPFTAEIYRQKASGSHKRS

SEQ ID NO: 3438 - protein, 193 aa, unidentified
MIRCGLACERCRWILPLLLLSAIAFDIIALAGRGWLQSSDHGQTSSLWWKCSQEGGGSGSYEEGCQSLMEYAWGRAAAAMLFCGFIILVICFILSFFALCGPQMLVFLRVIGGLLALAAVFQIISLVIYPVKYTQTFTLHANPAVTYIYNWAYGFGWAATIILIGCAFFFCCLPNYEDDLLGNAKPRYFYTSA

SEQ ID NO: 3439 - protein, 326 aa, unidentified
MAPAAASPPEVIRAAQKDEYYRGGLRSAAGGALHSLAGARKWLEWRKEVELLSDVAYFGLTTLAGYQTLGEEYVSIIQVDPSRIHVPSSLRRGVLVTLHAVLPYLLDKALLPLEQELQADPDSGRPLQGSLGPGGRGCSGARRWMRHHTATLTEQQRRALLRAVFVLRQGLACLQRLHVAWFYIHGVFYHLAKRLTGITYLRVRSLPGEDLRARVSYRLLGVISLLHLVLSMGLQLYGFRQRQRARKEWRLHRGLSHRRASLEERAVSRNPLCTLCLEERRHPTATPCGHLFCWECITAWCSSKAECPLCREKFPPQKLIYLRHYR

SEQ ID NO: 3440 - protein, 247 aa, unidentified
MDAFTRFTNQTQGRDRLFRATQYTCMLLRYLLEPKAGKEKVVMKLKKLESSVSTGRKWFRLGNVVHAIQATEQSIHATDLVPRLCLTLANLNRVIYFICDTILWVRSVGLTSGINKEKWRTRAAHHYYYSLLLSLVRDLYEISLQMKRVTCDRAKKEKSASQDPLWFSVAEEETEWLQSFLLLLFRSLKQHPPLLLDTVKNLCDILNPLDQLGIYKSNPGIIGLGGLVSSIAGMITVAYPQMKLKTR

SEQ ID NO: 3441 - protein, 259 aa, unidentified
MDAWVRFSAQSQARERLCRAAQYACSLLGHALQRHGASPELQKQIRQLESHLSLGRKLLRLGNSADALESAKRAVHLSDVVLRFCITVSHLNRALYFACDNVLWAGKSGLAPRVDQEKWAQRSFRYYLFSLIMNLSRDAYEIRLLMEQESSACSRRLKGSGGGVPGGSETGGLGGPGTPGGGLPQLALKLRLQVLLLARVLRGHPPLLLDVVRNACDLFIPLDKLGLWRCGPGIVGLCGLVSSILSILTLIYPWLRLKP

SEQ ID NO: 3442 - protein, 241 aa, unidentified
MASLSGLASALESYRGRDRLIRVLGYCCQLVGGVLVEQCPARSEVGTRLLVVSTQLSHCRTILRLFDDLAMFVYTKQYGLGAQEEDAFVRCVSVLGNLADQLYYPCEHVAWAADARVLHVDSSRWWTLSTTLWALSLLLGVARSLWMLLKLRQRLRSPTAPFTSPLPRGKRRAMEAQMQSEALSLLSNLADLANAVHWLPRGVLWAGRFPPWLVGLMGTISSILSMYQAARAGGQAEATTP

SEQ ID NO: 3443 - protein, 359 aa, unidentified
MAEHGAHFTAASVADDQPSIFEVVAQDSLMTAVRPALQHVVKVLAESNPTHYGFLWRWFDEIFTLLDLLLQQHYLSRTSASFSENFYGLKRIVMGDTHKSQRLASAGLPKQQLWKSIMFLVLLPYLKVKLEKLVSSLREEDEYSIHPPSSRWKRFYRAFLAAYPFVNMAWEGWFLVQQLRYILGKAQHHSPLLRLAGVQLGRLTVQDIQALEHKPAKASMMQQPARSVSEKINSALKKAVGGVALSLSTGLSVGVFFLQFLDWWYSSENQETIKSLTALPTPPPPVHLDYNSDSPLLPKMKTVCPLCRKTRVNDTVLATSGYVFCYRCVFHYVRSHQACPITGYPTEVQHLIKLYSPEN

SEQ ID NO: 3444 - protein, 403 aa, unidentified
MASQPPPPPKPWETRRIPGAGPGPGPGPTFQSADLGPTLMTRPGQPALTRVPPPILPRPSQQTGSSSVNTFRPAYSSFSSGYGAYGNSFYGGYSPYSYGYNGLGYNRLRVDDLPPSRFVQQAEESSRGAFQSIESIVHAFASVSMMMDATFSAVYNSFRAVLDVANHFSRLKIHFTKVFSAFALVRTIRYLYRRLQRMLGLRRGSENEDLWAESEGTVACLGAEDRAATSAKSWPIFLFFAVILGGPYLIWKLLSTHSDEVTDSINWASGEDDHVVARAEYDFAAVSEEEISFRAGDMLNLALKEQQPKVRGWLLASLDGQTTGLIPANYVKILGKRKGRKTVESSKVSKQQQSFTNPTLTKGATVADSLDEQEAAFESVFVETNKVPVAPDSIGKDGEKQDL

SEQ ID NO: 3445 - protein, 377 aa, unidentified
MASSEQAEQPSQPSSTPGSENVLPREPLIATAVKFLQNSRVRQSPLATRRAFLKKKGLTDEEIDMAFQQSGTAADEPSSLGPATQVVPVQPPHLISQPYSPAGSRWRDYGALAIIMAGIAFGFHQLYKKYLLPLILGGREDRKQLERMEAGLSELSGSVAQTVTQLQTTLASVQELLIQQQQKIQELAHELAAAKATTSTNWILESQNINELKSEINSLKGLLLNRRQFPPSPSAPKIPSWQIPVKSPSPSSPAAVNHHSSSDISPVSNESTSSSPGKEGHSPEGSTVTYHLLGPQEEGEGVVDVKGQVRMEVQGEEEKREDKEDEEDEEDDDVSHVDEEDCLGVQREDRRGGDGQINEQVEKLRRPEGASNESERD

SEQ ID NO: 3446 - protein, 336 aa, unidentified
MEKLRLLGLRYQEYVTRHPAATAQLETAVRGFSYLLAGRFADSHELSELVYSASNLLVLLNDGILRKELRKKLPVSLSQQKLLTWLSVLECVEVFMEMGAAKVWGEVGRWLVIALVQLAKAVLRMLLLLWFKAGLQTSPPIVPLDRETQAQPPDGDHSPGNHEQSYVGKRSNRVVRTLQNTPSLHSRHWGAPQQREGRQQQHHEELSATPTPLGLQETIAEFLYIARPLLHLLSLGLWGQRSWKPWLLAGVVDVTSLSLLSDRKGLTRRERRELRRRTILLLYYLLRSPFYDRFSEARILFLLQLLADHVPGVGLVTRPLMDYLPTWQKIYFYSWG

SEQ ID NO: 3447 - protein, 305 aa, unidentified
MASRKENAKSANRVLRISQLDALELNKALEQLVWSQFTQCFHGFKPGLLARFEPEVKACLWVFLWRFTIYSKNATVGQSVLNIKYKNDFSPNLRYQPPSKNQKIWYAVCTIGGRWLEERCYDLFRNHHLASFGKVKQCVNFVIGLLKLGGLINFLIFLQRGKFATLTERLLGIHSVFCKPQNICEVGFEYMNRELLWHGFAEFLIFLLPLINVQKLKAKLSSWCIPLTGAPNSDNTLATSGKECALCGEWPTMPHTIGCEHIFCYFCAKSSFLFDVYFTCPKCGTEVHSLQPLKSGIEMSEVNAL

SEQ ID NO: 3448 - protein, 305 aa, unidentified
MKSDSSTSAAPLRGLGGPLRSSEPVRAVPARAPAVDLLEEAADLLVVHLDFRAALETCERAWQSLANHAVAEEPAGTSLEVKCSLCVVGIQALAEMDRWQEVLSWVLQYYQVPEKLPPKVLELCILLYSKMQEPGAVLDVVGAWLQDPANQNLPEYGALAEFHVQRVLLPLGCLSEAEELVVGSAAFGEERRLDVLQAIHTARQQQKQEHSGSEEAQKPNLEGSVSHKFLSLPMLVRQLWDSAVSHFFSLPFKKSLLAALILCLLVVRFDPASPSSLHFLYKLAQLFRWIRKAAFSRLYQLRIRD

SEQ ID NO: 3449 - protein, 373 aa, unidentified
MLRSVWNFLKRHKKKCIFLGTVLGGVYILGKYGQKKIREIQEREAAEYIAQARRQYHFESNQRTCNMTVLSMLPTLREALMQQLNSESLTALLKNRPSNKLEIWEDLKIISFTRSTVAVYSTCMLVVLLRVQLNIIGGYIYLDNAAVGKNGTTILAPPDVQQQYLSSIQHLLGDGLTELITVIKQAVQKVLGSVSLKHSLSLLDLEQKLKEIRNLVEQHKSSSWINKDGSKPLLCHYMMPDEETPLAVQACGLSPRDITTIKLLNETRDMLESPDFSTVLNTCLNRGFSRLLDNMAEFFRPTEQDLQHGNSMNSLSSVSLPLAKIIPIVNGQIHSVCSETPSHFVQDLLTMEQVKDFAANVYEAFSTPQQLEK

SEQ ID NO: 3450 - protein, 122 aa, unidentified
MAAPVDLELKKAFTELQAKVIDTQQKVKLADIQIEQLNRTKKHAHLTDTEIMTLVDETNMYEGVGRMFILQSKEAIHSQLLEKQKIAEEKIKELEQKKSYLERSVKEAEDNIREMLMARRAQ

SEQ ID NO: 3451 - protein, 188 aa, unidentified
MAGWQSYVDNLMCDGCCQEAAIVGYCDAKYVWAATAGGVFQSITPIEIDMIVGKDREGFFTNGLTLGAKKCSVIRDSLYVDGDCTMDIRTKSQGGEPTYNVAVGRAGRALVIVMGKEGVHGGTLNKKAYELALYLRRYPNITIWSVSSLFFIGPIFICSLSFYMKLHYCGLGCLVMNFFHMYSVPYYC

SEQ ID NO: 3452 - protein, 922 aa, unidentified
MFLHSVNLWNLAFYVFMVFLATLGLWDVFFGFEENKCSMSYMFEYPEYQKIELPKKLAKRYPAYELYLYGEGSYAEEHKILPLTGIPVLFLPGNAGSYKQVRSIGSIALRKAEDIDFKYHFDFFSVNFNEELVALYGGSLQKQTKFVHECIKTILKLYKGQEFAPKSVAIIGHSMGGLVARALLTLKNFKHDLINLLITQATPHVAPVMPLDRFITDFYTTVNNYWILNARHINLTTLSVAGGFRDYQVRSGLTFLPKLSHHTSALSVVSSAVPKTWVSTDHLSIVWCKQLQLTTVRAFFDLIDADTKQITQNSKKKLSVLYHHFIRHPSKHFEENPAIISDLTGTSMWVLVKVSKWTYVAYNESEKIYFTFPLENHRKIYTHVYCQSTMLDTNSWIFACINSTSMCLQGVDLSWKAELLPTIKYLTLRLQDYPSLSHLVVYVPSVRGSKFVVDCEFFKKEKRYIQLPVTHLFSFGLSSRKVVLNTNGLYYNLELLNFGQIYQAFKINVVSKCSAVKEEITSIYRLHIPWSYEDSLTIAQAPSSTEISLKLHIAQPENNTHVALFKMYTSSDCRYEVTVKTSFSQILGQVVRFHGGALPAYVVSNILLAYRGQLYSLFSTGCCLEYATMLDKEAKPYKVDPFVIIIKFLLGYKWFKELWDVLLLPELDAVILTCQSMCFPLISLILFLFGTCTAYWSGLLSSASVRLLSSLWLALKRPSELPKDIKMISPDLPFLTIVLIIVSWTTCGALAILLSYLYYVFKVVHLQASLTTFKNSQPVNPKHSRRSEKKSNHHKDSSIHHLRLSANDAEDSLRMHSTVINLLTWIVLLSMPSLIYWLKNLRYYFKLNPDPCKPLAFILIPTMAILGNTYTVSIKSSKLLKTTSQFPLPLAVGVIAFGSAHLYRLPCFVFIPLLLHALCNFM

SEQ ID NO: 3453 - protein, 254 aa, unidentified
MYQVPLPLDRDGTLVRLRFTMVALVTVCCPLVAFLFCILWSLLFHFKETTATHCGVPNYLPSVSSAIGGEVPQRYVWRFCIGLHSAPRFLVAFAYWNHYLSCTSPCSCYRPLCRLNFGLNVVENLALLVLTYVSSSEDFTIHENAFIVFIASSLGHMLLTCILWRLTKKHTVSQEDRKSYSWKQRLFIINFISFFSALAVYFRHNMYCEAGVYTIFAILEYTVVLTNMAFHMTAWWDFGNKELLITSQPEEKRF

SEQ ID NO: 3454 - protein, 320 aa, unidentified
MAGLAARLVLLAGAAALASGSQGDREPVYRDCVLQCEEQNCSGGALNHFRSRQPIYMSLAGWTCRDDCKYECMWVTVGLYLQEGHKVPQFHGKWPFSRFLFFQEPASAVASFLNGLASLVMLCRYRTFVPASSPMYHTCVAFAWVSLNAWFWSTVFHTRDTDLTEKMDYFCASTVILHSIYLCCVRTVGLQHPAVVSAFRALLLLMLTVHVSYLSLIRFDYGYNLVANVAIGLVNVVWWLAWCLWNQRRLPHVRKCVVVVLLLQGLSLLELLDFPPLFWVLDAHAIWHISTIPVHVLFFSFLEDDSLYLLKESEDKFKLD

SEQ ID NO: 3455 - protein, 576 aa, unidentified
MAQGVLWILLGLLLWSDPGTASLPLLMDSVIQALAELEQKVPAAKTRHTASAWLMSAPNSGPHNRLYHFLLGAWSLNATELDPCPLSPELLGLTKEVARHDVREGKEYGVVLAPDGSTVAVEPLLAGLEAGLQGRRVINLPLDSMAAPWETGDTFPDVVAIAPDVRATSSPGLRDGSPDVTTADIGANTPDATKGCPDVQASLPDAKAKSPPTMVDSLLAVTLAGNLGLTFLRGSQTQSHPDLGTEGCWDQLSAPRTFTLLDPKASLLTMAFLNGALDGVILGDYLSRTPEPRPSLSHLLSQYYGAGVARDPGFRSNFRRQNGAALTSASILAQQVWGTLVLLQRLEPVHLQLQCMSQEQLAQVAANATKEFTEAFLGCPAIHPRCRWGAAPYRGRPKLLQLPLGFLYVHHTYVPAPPCTDFTRCAANMRSMQRYHQDTQGWGDIGYSFVVGSDGYVYEGRGWHWVGAHTLGHNSRGFGVAIVGNYTAALPTEAALRTVRDTLPSCAVRAGLLRPDYALLGHRQLVRTDCPGDALFDLLRTWPHFTATVKPRPARSVSKRSRREPPPRTLPATDLQ

SEQ ID NO: 3456 - protein, 195 aa, unidentified
MAAEDVVATGADPSDLESGGLLHEIFTSPLNLLLLGLCIFLLYKIVRGDQPAASGDSDDDEPPPLPRLKRRDFTPAELRRFDGVQDPRILMAINGKVFDVTKGRKFYGPEGPYGVFAGRDASRGLATFCLDKEALKDEYDDLSDLTAAQQETLSDWESQFTFKYHHVGKLLKEGEEPTVYSDEEEPKDESARKND

SEQ ID NO: 3457 - protein, 223 aa, unidentified
MAAGDGDVKLGTLGSGSESSNDGGSESPGDAGAAAEGGGWAAAALALLTGGGEMLLNVALVALVLLGAYRLWVRWGRRGLGAGAGAGEESPATSLPRMKKRDFSLEQLRQYDGSRNPRILLAVNGKVFDVTKGSKFYGPAGPYGIFAGRDASRGLATFCLDKDALRDEYDDLSDLNAVQMESVREWEMQFKEKYDYVGRLLKPGEEPSEYTDEEDTKDHNKQD

SEQ ID NO: 3458 - protein, 749 aa, unidentified
MEAETGSSVETGKKANRGTRIALVVFVGGTLVLGTILFLVSQGLLSLQAKQEYCLKPECIEAAAAILSKVNLSVDPCDNFFRFACDGWISNNPIPEDMPSYGVYPWLRHNVDLKLKELLEKSISRRRDTEAIQKAKILYSSCMNEKAIEKADAKPLLHILRHSPFRWPVLESNIGPEGVWSERKFSLLQTLATFRGQYSNSVFIRLYVSPDDKASNEHILKLDQATLSLAVREDYLDNSTEAKSYRDALYKFMVDTAVLLGANSSRAEHDMKSVLRLEIKIAEIMIPHENRTSEAMYNKMNISELSAMIPQFDWLGYIKKVIDTRLYPHLKDISPSENVVVRVPQYFKDLFRILGSERKKTIANYLVWRMVYSRIPNLSRRFQYRWLEFSRVIQGTTTLLPQWDKCVNFIESALPYVVGKMFVDVYFQEDKKEMMEELVEGVRWAFIDMLEKENEWMDAGTKRKAKEKARAVLAKVGYPEFIMNDTHVNEDLKAIKFSEADYFGNVLQTRKYLAQSDFFWLRKAVPKTEWFTNPTTVNAFYSASTNQIRFPAGELQKPFFWGTEYPRSLSYGAIGVIVGHEFTHGFDNNGRKYDKNGNLDPWWSTESEEKFKEKTKCMINQYSNYYWKKAGLNVKGKRTLGENIADNGGLREAFRAYRKWINDRRQGLEEPLLPGITFTNNQLFFLSYAHVRCNSYRPEAAREQVQIGAHSPPQFRVNGAISNFEEFQKAFNCPPNSTMNRGMDSCRLW

SEQ ID NO: 3459 - protein, 387 aa, unidentified
MTRDEALPDSHSAQDFYENYEPKEILGRGVSSVVRRCIHKPTSQEYAVKVIDVTGGGSFSPEEVRELREATLKEVDILRKVSGHPNIIQLKDTYETNTFFFLVFDLMKRGELFDYLTEKVTLSEKETRKIMRALLEVICTLHKLNIVHRDLKPENILLDDNMNIKLTDFGFSCQLEPGERLREVCGTPSYLAPEIIECSMNEDHPGYGKEVDMWSTGVIMYTLLAGSPPFWHRKQMLMLRMIMSGNYQFGSPEWDDYSDTVKDLVSRFLVVQPQNRYTAEEALAHPFFQQYLVEEVRHFSPRGKFKVIALTVLASVRIYYQYRRVKPVTREIVIRDPYALRPLRRLIDAYAFRIYGHWVKKGQQQNRAALFENTPKAVLLSLAEEDY

SEQ ID NO: 3460 - protein, 406 aa, unidentified
MTLDVGPEDELPDWAAAKEFYQKYDPKDVIGRGVSSVVRRCVHRATGHEFAVKIMEVTAERLSPEQLEEVREATRRETHILRQVAGHPHIITLIDSYESSSFMFLVFDLMRKGELFDYLTEKVALSEKETRSIMRSLLEAVSFLHANNIVHRDLKPENILLDDNMQIRLSDFGFSCHLEPGEKLRELCGTPGYLAPEILKCSMDETHPGYGKEVDLWACGVILFTLLAGSPPFWHRRQILMLRMIMEGQYQFSSPEWDDRSSTVKDLISRLLQVDPEARLTAEQALQHPFFERCEGSQPWNLTPRQRFRVAVWTVLAAGRVALSTHRVRPLTKNALLRDPYALRSVRHLIDNCAFRLYGHWVKKGEQQNRAALFQHRPPGPFPIMGPEEEGDSAAITEDEAVLVLG

SEQ ID NO: 3461 - protein, 1253 aa, unidentified
MEEHSYIQKELDLQNGSLEEDSVVHSVENDSQNMMESLSPKKYSSSLRFKANGDYSGSYLTLSQPVPAKRSPSPLGTSVRSSPSLAKIQGSKQFSYDGTDKNIPMKPPTPLLNTTSSLSGYPLGRADFDHYTGRDSERALRLSEKPPYSKYSSRHKSHDNVYSLGGLEGRKASGSLLAMWNGSSLSDAGPPPISRSGAASMPSSPKQARKMSIQDSLALQPKLTRHKELASENINLRTRKYSSSSLSHMGAYSRSLPRLYRATENQLTPLSLPPRNSLGNSKRTKLGEKDLPHSVIDNDNYLNFSSLSSGALPYKTSASEGNPYVSSTLSVPASPRVARKMLLASTSSCASDDFDQASYVGTNPSHSLLAGESDRVFATRRNFSCGSVEFDEADLESLRQASGTPQPALRERKSSISSISGRDDLMDYHRRQREERLREQEMERLERQRLETILSLCAEYTKPDSRLSTGTTVEDVQKINKELEKLQLSDEESVFEEALMSPDTRYRCHRKDSLPDADLASCGSLSQSSASFFTPRSTRNDELLSDLTRTPPPPSSTFPKASSESSYLSILPKTPEGISEEQRSQELAAMEETRIVILNNLEELKQKIKDINDQMDESFRELDMECALLDGEQKSETTELMKEKEILDHLNRKIAELEKNIVGEKTKEKVKLDAEREKLERLQELYSEQKTQLDNCPESMREQLQQQLKRDADLLDVESKHFEDLEFQQLEHESRLDEEKENLTQQLLREVAEYQRNIVSRKEKISALKKQANHIVQQAQREQDHFVKEKNNLIMMLQREKENLCNLEKKYSSLSGGKGFPVNPNTLKEGYISVNEINEPCGNSTNLSPSTQFPADADAVATEPATAVLASQPQSKEHFRSLEERKKQHKEGLYLSDTLPRKKTTSSISPHFSSATMGRSITPKAHLPLGQSNSCGSVLPPSLAAMAKDSESRRMLRGYNHQQMSEGHRQKSEFYNRTASESNVYLNSFHYPDHSYKDQAFDTLSLDSSDSMETSISACSPDNISSASTSNIARIEEMERLLKQAHAEKTRLLESREREMEAKKRALEEEKRRREILEKRLQEETSQRQKLIEKEVKIRERQRAQARPLTRYLPVRKEDFDLRSHVETAGHNIDTCYHVSITEKTCRGFLIKMGGKIKTWKKRWFVFDRNKRTFSYYADKHETKLKGVIYFQAIEEVYYDHLKNANKSPNPLLTFSVKTHDRIYYMVAPSPEAMRIWMDVIVTGAEGYTHFLL

SEQ ID NO: 3462 - protein, 762 aa, unidentified
MASNERDAISWYQKKIGAYDQQIWEKSIEQTQIKGLKNKPKKMGHIKPDLIDVDLIRGSTFAKAKPEIPWTSLTRKGLVRVVFFPLFSNWWIQVTSLRIFVWLLLLYFMQVIAIVLYLMMPIVNISEVLGPLCLMLLMGTVHCQIVSTQITRPSGNNGNRRRRKLRKTVNGDGSRENGNNSSDKVRGIETLESVPIIGGFWETIFGNRIKRVKLISNKGTETDNDPSCVHPIIKRRQCRPEIRMWQTREKAKFSDGEKCRREAFRRLGNGVSDDLSSEEDGEARTQMILLRRSVEGASSDNGCEVKNRKSILSRHLNSQVKKTTTRWCHIVRDSDSLAESEFESAAFSQGSRSGVSGGSRSLNMSRRDSESTRHDSETEDMLWDDLLHGPECRSSVTSDSEGAHVNTLHSGTKRDPKEDVFQQNHLFWLQNSSPSSDRVSAIIWEGNECKKMDMSVLEISGIIMSRVNAYQQGVGYQMLGNVVTIGLAFFPFLHRLFREKSLDQLKSISAEEILTLFCGAPPVTPIIVLSIINFFERLCLTWMFFFMMCVAERTYKQRFLFAKLFSHITSARKARKYEIPHFRLKKVENIKIWLSLRSYLKRRGPQRSVDVVVSSVFLLTLSIAFICCAQVLQGHKTFLNDAYNWEFLIWETALLLFLLRLASLGSETNKKYSNVSILLTEQINLYLKMEKKPNKKEQLTLVNNVLKLSTKLLKELDTPFRLYGLTMNPLIYNITRVVILSAVSGVISDLLGFNIRLWKIKS

SEQ ID NO: 3463 - protein, 785 aa, unidentified
MASKVTDAIVWYQKKEFLSVATTAPGPQQVLPGYCQCSLKDQGLFIQCLIGAYDQQIWEKSVEQREIKFIKLGLRNKPKKTAHVKPDLIDVDLVRGSAFAKAKPESPWTSLTRKGIVRVVFFPFFFRWWLQVTSKVIFFWLLVLYLLQVAAIVLFCSTSSPHSIPLTEVIGPIWLMLLLGTVHCQIVSTRTPKPPLSTGGKRRRKLRKAAHLEVHREGDGSSTTDNTQEGAVQNHGTSTSHSVGTVFRDLWHAAFFLSGSKKAKNSIDKSTETDNGYVSLDGKKTVKSGEDGIQNHEPQCETIRPEETAWNTGTLRNGPSKDTQRTITNVSDEVSSEEGPETGYSLRRHVDRTSEGVLRNRKSHHYKKHYPNEDAPKSGTSCSSRCSSSRQDSESARPESETEDVLWEDLLHCAECHSSCTSETDVENHQINPCVKKEYRDDPFHQSHLPWLHSSHPGLEKISAIVWEGNDCKKADMSVLEISGMIMNRVNSHIPGIGYQIFGNAVSLILGLTPFVFRLSQATDLEQLTAHSASELYVIAFGSNEDVIVLSMVIISFVVRVSLVWIFFFLLCVAERTYKQRLLFAKLFGHLTSARRARKSEVPHFRLKKVQNIKMWLSLRSYLKRRGPQRSVDVIVSSAFLLTISVVFICCAQLLHVHEIFLDCHYNWELVIWCISLTLFLLRFVTLGSETSKKYSNTSILLTEQINLYLKMEKKPNKKEELTLVNNVLKLATKLLKELDSPFRLYGLTMNPLLYNITQVVILSAVSGVISDLLGFNLKLWKIKS

SEQ ID NO: 3464 - protein, 463 aa, unidentified
MHGSCSFLMLLLPLLLLLVATTGPVGALTDEEKRLMVELHNLYRAQVSPTASDMLHMRWDEELAAFAKAYARQCVWGHNKERGRRGENLFAITDEGMDVPLAMEEWHHEREHYNLSAATCSPGQMCGHYTQVVWAKTERIGCGSHFCEKLQGVEETNIELLVCNYEPPGNVKGKRPYQEGTPCSQCPSGYHCKNSLCEPIGSPEDAQDLPYLVTEAPSFRATEASDSRKMGTPSSLATGIPAFLVTEVSGSLATKALPAVETQAPTSLATKDPPSMATEAPPCVTTEVPSILAAHSLPSLDEEPVTFPKSTHVPIPKSADKVTDKTKVPSRSPENSLDPKMSLTGARELLPHAQEEAEAEAELPPSSEVLASVFPAQDKPGELQATLDHTGHTSSKSLPNFPNTSATANATGGRALALQSSLPGAEGPDKPSVVSGLNSGPGHVWGPLLGLLLLPPLVLAGIF

SEQ ID NO: 3465 - protein, 2102 aa, unidentified
MAAAPARGGGGGGGGGGGCSGSGSSASRGFYFNTVLSLARSLAVQRPASLEKVQKLLCMCPVDFHGIFQLDERRRDAVIALGIFLIESDLQHKDCVVPYLLRLLKGLPKVYWVEESTARKGRGALPVAESFSFCLVTLLSDVAYRDPSLRDEILEVLLQVLHVLLGMCQALEIQDKEYLCKYAIPCLIGISRAFGRYSNMEESLLSKLFPKIPPHSLRVLEELEGVRRRSFNDFRSILPSNLLTVCQEGTLKRKTSSVSSISQVSPERGMPPPSSPGGSAFHYFEASCLPDGTALEPEYYFSTISSSFSVSPLFNGVTYKEFNIPLEMLRELLNLVKKIVEEAVLKSLDAIVASVMEANPSADLYYTSFSDPLYLTMFKMLRDTLYYMKDLPTSFVKEIHDFVLEQFNTSQGELQKILHDADRIHNELSPLKLRCQANAACVDLMVWAVKDEQGAENLCIKLSEKLQSKTSSKVIIAHLPLLICCLQGLGRLCERFPVVVHSVTPSLRDFLVIPSPVLVKLYKYHSQYHTVAGNDIKISVTNEHSESTLNVMSGKKSQPSMYEQLRDIAIDNICRCLKAGLTVDPVIVEAFLASLSNRLYISQESDKDAHLIPDHTIRALGHIAVALRDTPKVMEPILQILQQKFCQPPSPLDVLIIDQLGCLVITGNQYIYQEVWNLFQQISVKASSVVYSATKDYKDHGYRHCSLAVINALANIAANIQDEHLVDELLMNLLELFVQLGLEGKRASERASEKGPALKASSSAGNLGVLIPVIAVLTRRLPPIKEAKPRLQKLFRDFWLYSVLMGFAVEGSGLWPEEWYEGVCEIATKSPLLTFPSKEPLRSVLQYNSAMKNDTVTPAELSELRSTIINLLDPPPEVSALINKLDFAMSTYLLSVYRLEYMRVLRSTDPDRFQVMFCYFEDKAIQKDKSGMMQCVIAVADKVFDAFLNMMADKAKTKENEEELERHAQFLLVNFNHIHKRIRRVADKYLSGLVDKFPHLLWSGTVLKTMLDILQTLSLSLSADIHKDQPYYDIPDAPYRITVPDTYEARESIVKDFAARCGMILQEAMKWAPTVTKSHLQEYLNKHQNWVSGLSQHTGLAMATESILHFAGYNKQNTTLGATQLSERPACVKKDYSNFMASLNLRNRYAGEVYGMIRFSGTTGQMSDLNKMMVQDLHSALDRSHPQHYTQAMFKLTAMLISSKDCDPQLLHHLCWGPLRMFNEHGMETALACWEWLLAGKDGVEVPFMREMAGAWHMTVEQKFGLFSAEIKEADPLAASEASQPKPCPPEVTPHYIWIDFLVQRFEIAKYCSSDQVEIFSSLLQRSMSLNIGGAKGSMNRHVAAIGPRFKLLTLGLSLLHADVVPNATIRNVLREKIYSTAFDYFSCPPKFPTQGEKRLREDISIMIKFWTAMFSDKKYLTASQLVPPDNQDTRSNLDITVGSRQQATQGWINTYPLSSGMSTISKKSGMSKKTNRGSQLHKYYMKRRTLLLSLLATEIERLITWYNPLSAPELELDQAGENSVANWRSKYISLSEKQWKDNVNLAWSISPYLAVQLPARFKNTEAIGNEVTRLVRLDPGAVSDVPEAIKFLVTWHTIDADAPELSHVLCWAPTDPPTGLSYFSSMYPPHPLTAQYGVKVLRSFPPDAILFYIPQIVQALRYDKMGYVREYILWAASKSQLLAHQFIWNMKTNIYLDEEGHQKDPDIGDLLDQLVEEITGSLSGPAKDFYQREFDFFNKITNVSAIIKPYPKGDERKKACLSALSEVKVQPGCYLPSNPEAIVLDIDYKSGTPMQSAAKAPYLAKFKVKRCGVSELEKEGLRCRSDSEDECSTQEADGQKISWQAAIFKVGDDCRQDMLALQIIDLFKNIFQLVGLDLFVFPYRVVATAPGCGVIECIPDCTSRDQLGRQTDFGMYDYFTRQYGDESTLAFQQARYNFIRSMAAYSLLLFLLQIKDRHNGNIMLDKKGHIIHIDFGFMFESSPGGNLGWEPDIKLTDEMVMIMGGKMEATPFKWFMEMCVRGYLAVRPYMDAVVSLVTLMLDTGLPCFRGQTIKLLKHRFSPNMTEREAANFIMKVIQSCFLSNRSRTYDMIQYYQNDIPY

SEQ ID NO: 3466 - protein, 282 aa, unidentified
MESRMWPALLLSHLLPLWPLLLLPLPPPAQGSSSSPRTPPAPARPPCARGGPSAPRHVCVWERAPPPSRSPRVPRSRRQVLPGTAPPATPSGFEEGPPSSQYPWAIVWGPTVSREDGGDPNSANPGFLDYGFAAPHGLATPHPNSDSMRGDGDGLILGEAPATLRPFLFGGRGEGVDPQLYVTITISIIIVLVATGIIFKFCWDRSQKRRRPSGQQGALRQEESQQPLTDLSPAGVTVLGAFGDSPTPTPDHEEPRGGPRPGMPHPKGAPAFQLNRIPLVNL

SEQ ID NO: 3467 - protein, 621 aa, unidentified
MADFEELRNMVSSFRVSELQVLLGFAGRNKSGRKHDLLMRALHLLKSGCSPAVQIKIRELYRRRYPRTLEGLSDLSTIKSSVFSLDGGSSPVEPDLAVAGIHSLPSTSVTPHSPSSPVGSVLLQDTKPTFEMQQPSPPIPPVHPDVQLKNLPFYDVLDVLIKPTSLVQSSIQRFQEKFFIFALTPQQVREICISRDFLPGGRRDYTVQVQLRLCLAETSCPQEDNYPNSLCIKVNGKLFPLPGYAPPPKNGIEQKRPGRPLNITSLVRLSSAVPNQISISWASEIGKNYSMSVYLVRQLTSAMLLQRLKMKGIRNPDHSRALIKEKLTADPDSEIATTSLRVSLMCPLGKMRLTIPCRAVTCTHLQCFDAALYLQMNEKKPTWICPVCDKKAAYESLILDGLFMEILNDCSDVDEIKFQEDGSWCPMRPKKEAMKVSSQPCTKIESSSVLSKPCSVTVASEASKKKVDVIDLTIESSSDEEEDPPAKRKCIFMSETQSSPTKGVLMYQPSSVRVPSVTSVDPAAIPPSLTDYSVPFHHTPISSMSSDLPGLDFLSLIPVDPQYCPPMFLDSLTSPLTASSTSVTTTSSHESSTHVSSSSSRSETGVITSSGSNIPDIISLD

SEQ ID NO: 3468 - protein, 2521 aa, unidentified
MEPHVLGAVLYWLLLPCALLAACLLRFSGLSLVYLLFLLLLPWFPGPTRCGLQGHTGRLLRALLGLSLLFLVAHLALQICLHIVPRLDQLLGPSCSRWETLSRHIGVTRLDLKDIPNAIRLVAPDLGILVVSSVCLGICGRLARNTRQSPHPRELDDDERDVDASPTAGLQEAATLAPTRRSRLAARFRVTAHWLLVAAGRVLAVTLLALAGIAHPSALSSVYLLLFLALCTWWACHFPISTRGFSRLCVAVGCFGAGHLICLYCYQMPLAQALLPPAGIWARVLGLKDFVGPTNCSSPHALVLNTGLDWPVYASPGVLLLLCYATASLRKLRAYRPSGQRKEAAKGYEARELELAELDQWPQERESDQHVVPTAPDTEADNCIVHELTGQSSVLRRPVRPKRAEPREASPLHSLGHLIMDQSYVCALIAMMVWSITYHSWLTFVLLLWACLIWTVRSRHQLAMLCSPCILLYGMTLCCLRYVWAMDLRPELPTTLGPVSLRQLGLEHTRYPCLDLGAMLLYTLTFWLLLRQFVKEKLLKWAESPAALTEVTVADTEPTRTQTLLQSLGELVKGVYAKYWIYVCAGMFIVVSFAGRLVVYKIVYMFLFLLCLTLFQVYYSLWRKLLKAFWWLVVAYTMLVLIAVYTFQFQDFPAYWRNLTGFTDEQLGDLGLEQFSVSELFSSILVPGFFLLACILQLHYFHRPFMQLTDMEHVSLPGTRLPRWAHRQDAVSGTPLLREEQQEHQQQQQEEEEEEEDSRDEGLGVATPHQATQVPEGAAKWGLVAERLLELAAGFSDVLSRVQVFLRRLLELHVFKLVALYTVWVALKEVSVMNLLLVVLWAFALPYPRFRPMASCLSTVWTCVIIVCKMLYQLKVVNPQEYSSNCTEPFPNSTNLLPTEISQSLLYRGPVDPANWFGVRKGFPNLGYIQNHLQVLLLLVFEAIVYRRQEHYRRQHQLAPLPAQAVFASGTRQQLDQDLLGCLKYFINFFFYKFGLEICFLMAVNVIGQRMNFLVTLHGCWLVAILTRRHRQAIARLWPNYCLFLALFLLYQYLLCLGMPPALCIDYPWRWSRAVPMNSALIKWLYLPDFFRAPNSTNLISDFLLLLCASQQWQVFSAERTEEWQRMAGVNTDRLEPLRGEPNPVPNFIHCRSYLDMLKVAVFRYLFWLVLVVVFVTGATRISIFGLGYLLACFYLLLFGTALLQRDTRARLVLWDCLILYNVTVIISKNMLSLLACVFVEQMQTGFCWVIQLFSLVCTVKGYYDPKEMMDRDQDCLLPVEEAGIIWDSVCFFFLLLQRRVFLSHYYLHVRADLQATALLASRGFALYNAANLKSIDFHRRIEEKSLAQLKRQMERIRAKQEKHRQGRVDRSRPQDTLGPKDPGLEPGPDSPGGSSPPRRQWWRPWLDHATVIHSGDYFLFESDSEEEEEAVPEDPRPSAQSAFQLAYQAWVTNAQAVLRRRQQEQEQARQEQAGQLPTGGGPSQEVEPAEGPEEAAAGRSHVVQRVLSTAQFLWMLGQALVDELTRWLQEFTRHHGTMSDVLRAERYLLTQELLQGGEVHRGVLDQLYTSQAEATLPGPTEAPNAPSTVSSGLGAEEPLSSMTDDMGSPLSTGYHTRSGSEEAVTDPGEREAGASLYQGLMRTASELLLDRRLRIPELEEAELFAEGQGRALRLLRAVYQCVAAHSELLCYFIIILNHMVTASAGSLVLPVLVFLWAMLSIPRPSKRFWMTAIVFTEIAVVVKYLFQFGFFPWNSHVVLRRYENKPYFPPRILGLEKTDGYIKYDLVQLMALFFHRSQLLCYGLWDHEEDSPSKEHDKSGEEEQGAEEGPGVPAATTEDHIQVEARVGPTDGTPEPQVELRPRDTRRISLRFRRRKKEGPARKGAAAIEAEDREEEEGEEEKEAPTGREKRPSRSGGRVRAAGRRLQGFCLSLAQGTYRPLRRFFHDILHTKYRAATDVYALMFLADVVDFIIIIFGFWAFGKHSAATDITSSLSDDQVPEAFLVMLLIQFSTMVVDRALYLRKTVLGKLAFQVALVLAIHLWMFFILPAVTERMFNQNVVAQLWYFVKCIYFALSAYQIRCGYPTRILGNFLTKKYNHLNLFLFQGFRLVPFLVELRAVMDWVWTDTTLSLSSWMCVEDIYANIFIIKCSRETEKKYPQPKGQKKKKIVKYGMGGLIILFLIAIIWFPLLFMSLVRSVVGVVNQPIDVTVTLKLGGYEPLFTMSAQQPSIIPFTAQAYEELSRQFDPQPLAMQFISQYSPEDIVTAQIEGSSGALWRISPPSRAQMKRELYNGTADITLRFTWNFQRDLAKGGTVEYANEKHMLALAPNSTARRQLASLLEGTSDQSVVIPNLFPKYIRAPNGPEANPVKQLQPNEEADYLGVRIQLRREQGAGATGFLEWWVIELQECRTDCNLLPMVIFSDKVSPPSLGFLAGYGIMGLYVSIVLVIGKFVRGFFSEISHSIMFEELPCVDRILKLCQDIFLVRETRELELEEELYAKLIFLYRSPETMIKWTREKE

SEQ ID NO: 3469 - protein, 2752 aa, unidentified
MASEVVCGLIFRLLLPICLAVACAFRYNGLSFVYLIYLLLIPLFSEPTKTTMQGHTGRLLKSLCFISLSFLLLHIIFHITLVSLEAQHRIAPGYNCSTWEKTFRQIGFESLKGADAGNGIRVFVPDIGMFIASLTIWLLCRNIVQKPVTDEAAQSNPEFENEELAEGEKIDSEEALIYEEDFNGGDGVEGELEESTKLKMFRRLASVASKLKEFIGNMITTAGKVVVTILLGSSGMMLPSLTSSVYFFVFLGLCTWWSWCRTFDPLLFSCLCVLLAIFTAGHLIGLYLYQFQFFQEAVPPNDYYARLFGIKSVIQTDCSSTWKIIVNPDLSWYHHANPILLLVMYYTLATLIRIWLQEPLVQDEGTKEEDKALACSPIQITAGRRRSLWYATHYPTDERKLLSMTQDDYKPSDGLLVTVNGNPVDYHTIHPSLPMENGPGKADLYSTPQYRWEPSDESSEKREEEEEEKEEFEEERSREEKRSIKVHAMVSVFQFIMKQSYICALIAMMAWSITYHSWLTFVLLIWSCTLWMIRNRRKYAMISSPFMVVYGNLLLILQYIWSFELPEIKKVPGFLEKKEPGELASKILFTITFWLLLRQHLTEQKALQEKEALLSEVKIGSQENEEKDEELQDIQVEGEPKEEEEEEAKEEKQERKKVEQEEAEEEDEQDIMKVLGNLVVAMFIKYWIYVCGGMFFFVSFEGKIVMYKIIYMVLFLFCVALYQVHYEWWRKILKYFWMSVVIYTMLVLIFIYTYQFENFPGLWQNMTGLKKEKLEDLGLKQFTVAELFTRIFIPTSFLLVCILHLHYFHDRFLELTDLKSIPSKEDNTIYRLAHPEGSLPDLTMMHLTASLEKPEVRKLAEPGEEKLEGYSEKAQKGDLGKDSEESEEDGEEEEESEEEEETSDLRNKWHLVIDRLTVLFLKFLEYFHKLQVFMWWILELHIIKIVSSYIIWVSVKEVSLFNYVFLISWAFALPYAKLRRLASSVCTVWTCVIIVCKMLYQLQTIKPENFSVNCSLPNENQTNIPFNELNKSLLYSAPIDPTEWVGLRKSSPLLVYLRNNLLMLAILAFEVTIYRHQEYYRGRNNLTAPVSRTIFHDITRLHLDDGLINCAKYFINYFFYKFGLETCFLMSVNVIGQRMDFYAMIHACWLIAVLYRRRRKAIAEIWPKYCCFLACIITFQYFICIGIPPAPCRDYPWRFKGASFNDNIIKWLYFPDFIVRPNPVFLVYDFMLLLCASLQRQIFEDENKAAVRIMAGDNVEICMNLDAASFSQHNPVPDFIHCRSYLDMSKVIIFSYLFWFVLTIIFITGTTRISIFCMGYLVACFYFLLFGGDLLLKPIKSILRYWDWLIAYNVFVITMKNILSIGACGYIGTLVHNSCWLIQAFSLACTVKGYQMPAANSPCTLPSGEAGIIWDSICFAFLLLQRRVFMSYYFLHVVADIKASQILASRGAELFQATIVKAVKARIEEEKKSMDQLKRQMDRIKARQQKYKKGKERMLSLTQEPGEGQDMQKLSEEDDEREADKQKAKGKKKQWWRPWVDHASMVRSGDYYLFETDSEEEEEEELKKEDEEPPRRSAFQFVYQAWITDPKTALRQRHKEKKRSAREERKRRRKGSKEGPVEWEDREDEPIKKKSDGPDNIIKRIFNILKFTWVLFLATVDSFTTWLNSISREHIDISTVLRIERCMLTREIKKGNVPTRESIHMYYQNHIMNLSRESGLDTIDEHPGAASGAQTAHRMDSLDSHDSISSEPTQCTMLYSRQGTTETIEEVEAEQEEEAGSTAPEPREAKEYEATGYDVGAMGAEEASLTPEEELTQFSTLDGDVEAPPSYSKAVSFEHLSFGSQDDSAGKNRMAVSPDDSRTDKLGSSILPPLTHELTASELLLKKMFHDDELEESEKFYVGQPRFLLLFYAMYNTLVARSEMVCYFVIILNHMVSASMITLLLPILIFLWAMLSVPRPSRRFWMMAIVYTEVAIVVKYFFQFGFFPWNKNVEVNKDKPYHPPNIIGVEKKEGYVLYDLIQLLALFFHRSILKCHGLWDEDDMTESGMAREESDDELSLGHGRRDSSDSLKSINLAASVESVHVTFPEQQTAVRRKRSGSSSEPSQRSSFSSNRSQRGSTSTRNSSQKGSSVLSIKQKGKRELYMEKLQEHLIKAKAFTIKKTLEIYVPIKQFFYNLIHPEYSAVTDVYVLMFLADTVDFIIIVFGFWAFGKHSAAADITSSLSEDQVPGPFLVMVLIQFGTMVVDRALYLRKTVLGKVIFQVILVFGIHFWMFFILPGVTERKFSQNLVAQLWYFVKCVYFGLSAYQIRCGYPTRVLGNFLTKSYNYVNLFLFQGFRLVPFLTELRAVMDWVWTDTTLSLSSWICVEDIYAHIFILKCWRESEKRYPQPRGQKKKKVVKYGMGGMIIVLLICIVWFPLLFMSLIKSVAGVINQPLDVSVTITLGGYQPIFTMSAQQSQLKVMDQQSFNKFIQAFSRDTGAMQFLENYEKEDITVAELEGNSNSLWTISPPSKQKMIHELLDPNSSFSVVFSWSIQRNLSLGAKSEIATDKLSFPLKNITRKNIAKMIAGNSTESSKTPVTIEKIYPYYVKAPSDSNSKPIKQLLSENNFMDITIILSRDNTTKYNSEWWVLNLTGNRIYNPNSQALELVVFNDKVSPPSLGFLAGYGIMGLYASVVLVIGKFVREFFSGISHSIMFEELPNVDRILKLCTDIFLVRETGELELEEDLYAKLIFLYRSPETMIKWTREKTN

SEQ ID NO: 3470 - protein, 484 aa, unidentified
MACRGGAGNGHRASATLSRVSPGSLYTCRTRTHNICMVSDFFYPNMGGVESHIYQLSQCLIERGHKVIIVTHAYGNRKGIRYLTSGLKVYYLPLKVMYNQSTATTLFHSLPLLRYIFVRERVTIIHSHSSFSAMAHDALFHAKTMGLQTVFTDHSLFGFADVSSVLTNKLLTVSLCDTNHIICVSYTSKENTVLRAALNPEIVSVIPNAVDPTDFTPDPFRRHDSITIVVVSRLVYRKGIDLLSGIIPELCQKYPDLNFIIGGEGPKRIILEEVRERYQLHDRVRLLGALEHKDVRNVLVQGHIFLNTSLTEAFCMAIVEAASCGLQVVSTRVGGIPEVLPENLIILCEPSVKSLCEGLEKAIFQLKSGTLPAPENIHNIVKTFYTWRNVAERTEKVYDRVSVEAVLPMDKRLDRLISHCGPVTGYIFALLAVFNFLFLIFLRWMTPDSIIDVAIDATGPRGAWTNNYSHSKRGGENNEISETR

SEQ ID NO: 3471 - protein, 554 aa, unidentified
MRRPLSKCGMEPGGGDASLTLHGLQNRSHGKIKLRKRKSTLYFNTQEKSARRRGDLLGENIYLLLFTIALRILNCFLVQTSFVPDEYWQSLEVSHHMVFNYGYLTWEWTERLRSYTYPLIFASIYKILHLLGKDSVQLLIWIPRLAQALLSAVADVRLYSLMKQLENQEVARWVFFCQLCSWFTWYCCTRTLTNTMETVLTIIALFYYPLEGSKSMNSVKYSSLVALAFIIRPTAVILWTPLLFRHFCQEPRKLDLILHHFLPVGFVTLSLSLMIDRIFFGQWTLVQFNFLKFNVLQNWGTFYGSHPWHWYFSQGFPVILGTHLPFFIHGCYLAPKRYRILLVTVLWTLLVYSMLSHKEFRFIYPVLPFCMVFCGYSLTHLKTWKKPALSFLFLSNLFLALYTGLVHQRGTLDVMSHIQKVCYNNPNKSSASIFIMMPCHSTPYYSHVHCPLPMRFLQCPPDLTGKSHYLDEADVFYLNPLNWLHREFHDDASLPTHLITFSILEEEISAFLISSNYKRTAVFFHTHLPEGRIGSHIYVYERKLKGKFNMKMKF

SEQ ID NO: 3472 - protein, 297 aa, unidentified
MYAQPVTNTKEVKWQKVLYERQPFPDNYVDRRFLEELRKNIHARKYQYWAVVFESSVVIQQLCSVCVFVVIWWYMDEGLLAPHWLLGTGLASSLIGYVLFDLIDGGEGRKKSGQTRWADLKSALVFITFTYGFSPVLKTLTESVSTDTIYAMSVFMLLGHLIFFDYGANAAIVSSTLSLNMAIFASVCLASRLPRSLHAFIMVTFAIQIFALWPMLQKKLKACTPRSYVGVTLLFAFSAVGGLLSISAVGAVLFALLLMSISCLCPFYLIRLQLFKENIHGPWDEAEIKEDLSRFLS

SEQ ID NO: 3473 - protein, 219 aa, unidentified
MKDNDIKRLLYTHLLCIFSIILSVFIPSLFLENFSILETHLTWLCICSGFVTAVNLVLYLVVKPNTSSKRSSLSHKVTGFLKCCIYFLMSCFSFHVIFVLYGAPLIELALETFLFAVILSTFTTVPCLCLLGPNLKAWLRVFSRNGVTSIWENSLQITTISSFVGAWLGALPIPLDWERPWQVWPISCTLGATFGYVAGLVISPLWIYWNRKQLTYKNN

SEQ ID NO: 3474 - protein, 983 aa, unidentified
MRLGSGTFATCCVAIEVLGIAVFLRGFFPAPVRSSARAEHGAEPPAPEPSAGASSNWTTLPPPLFSKVVIVLIDALRDDFVFGSKGVKFMPYTTYLVEKGASHSFVAEAKPPTVTMPRIKALMTGSLPGFVDVIRNLNSPALLEDSVIRQAKAAGKRIVFYGDETWVKLFPKHFVEYDGTTSFFVSDYTEVDNNVTRHLDKVLKRGDWDILILHYLGLDHIGHISGPNSPLIGQKLSEMDSVLMKIHTSLQSKERETPLPNLLVLCGDHGMSETGSHGASSTEEVNTPLILISSAFERKPGDIRHPKHVQQTDVAATLAIALGLPIPKDSVGSLLFPVVEGRPMREQLRFLHLNTVQLSKLLQENVPSYEKDPGFEQFKMSERLHGNWIRLYLEEKHSEVLFNLGSKVLRQYLDALKTLSLSLSAQVAQYDIYSMMVGTVVVLEVLTLLLLSVPQALRRKAELEVPLSSPGFSLLFYLVILVLSAVHVIVCTSAESSCYFCGLSWLAAGGVMVLASALLCVIVSVLTNVLVGGNTPRKNPMHPSSRWSELDLLILLGTAGHVLSLGASSFVEEEHQTWYFLVNTLCLALSQETYRNYFLGDDGEPPCGLCVEQGHDGATAAWQDGPGCDVLERDKGHGSPSTSEVLRGREKWMVLASPWLILACCRLLRSLNQTGVQWAHRPDLGHWLTSSDHKAELSVLAALSLLVVFVLVQRGCSPVSKAALALGLLGVYCYRAAIGSVRFPWRPDSKDISKGIIEARFVYVFVLGILFTGTKDLLKSQVIAADFKLKTVGLWEIYSGLVLLAALLFRPHNLPVLAFSLLIQTLMTKFIWKPLRHDAAEITVMHYWFGQAFFYFQGNSNNIATVDISAGFVGLDTYVEIPAVLLTAFGTYAGPVLWASHLVHFLSSETRSGSALSHACFCYALICSIPVFTYIVLVTSLRYHLFIWSVFSPKLLYEGMHLLITAAVCVFFTAMDQTRLTQS

SEQ ID NO: 3475 - protein, 188 aa, unidentified
MEDERSFSDICGGRLALQRRYYSPSCREFCLSCPRLSLRSLTAVTCTVWLAAYGLFTLCENSMILSAAIFITLLGLLGYLHFVKIDQETLLIIDSLGIQMTSSYASGKESTTFIEMGKVKDIVINEAIYMQKVIYYLCILLKDPVEPHGISQVVPVFQSAKPRLDCLIEVYRSCQEILAHQKATSTSP

SEQ ID NO: 3476 - protein, 395 aa, unidentified
MAVTDSLSRAATVLATVLLLSFGSVAASHIEDQAEQFFRSGHTNNWAVLVCTSRFWFNYRHVANTLSVYRSVKRLGIPDSHIVLMLADDMACNPRNPKPATVFSHKNMELNVYGDDVEVDYRSYEVTVENFLRVLTGRIPPSTPRSKRLLSDDRSNILIYMTGHGGNGFLKFQDSEEITNIELADAFEQMWQKRRYNELLFIIDTCQGASMYERFYSPNIMALASSQVGEDSLSHQPDPAIGVHLMDRYTFYVLEFLEEINPASQTNMNDLFQVCPKSLCVSTPGHRTDLFQRDPKNVLITDFFGSVRKVEITTETIKLQQDSEIMESSYKEDQMDEKLMEPLKYAEQLPVAQIIHQKPKLKDWHPPGGFILGLWALIIMVFFKTYGIKHMKFIF

SEQ ID NO: 3477 - protein, 423 aa, unidentified [sequence omitted]

SEQ ID NO: 3478 - protein, 931 aa, unidentified
MLLFFTLGLLIHFVFFASIFDIYFTSPLVHGMTPQFTPLPPPARRLVLFVADGLRADALYELDENGNSRAPFIRNIIMHEGSWGISHTRVPTESRPGHVALIAGFYEDVSAVAKGWKENPVEFDSLFNESKYTWSWGSPDILPMFAKGASGDHVYTYSYDAKREDFGAQDATKLDTWVFDNVKDFFHHARNNQSLFSKINEEKIVFFLHLLGIDTNGHAHRPSSRDYKHNIKKVDDGVKEIVSMFNHFYGNDGKTTFIFTSDHGMTDWGSHGAGHPSETLTPLVTWGAGIKYPQRVSAQQFDDAFLKEWRLENWKRLDVNQADIAPLMTSLIGVPFPLNSVGILPVDYLNNTDLFKAESMFTNAVQILEQFKVKMTQKKEVTLPFLFTPFKLLSDSKQFNILRKARSYIKHRKFDEVVSLCKELIHLALKGLSYYHTYDRFFLGVNVVIGFVGWISYASLLIIKSHSNLIKGVSKEVKKPSHLLPCSFVAIGILVAFFLLIQACPWTYYVYGLLPLPIWYAVLREFQVIQDLVVSVLTYPLSHFVGYLLAFTLGIEVLVLSFFYRYMLTAGLTAFAAWPFLTRLWTRAKMTSLSWTFFSLLLAVFPLMPVVGRKPDISLVMGAGLLVLLLSLCVVTSLMKRKDSFIKEELLVHLLQVLSTVLSMYVVYSTQSSLLRKQGLPLMNQIISWATLASSLVVPLLSSPVLFQRLFSILLSLMSTYLLLSTGYEALFPLVLSCLMFVWINIEQETLQQSGVCCKQKLTSIQFSYNTDITQFRQLYLDDIRRAFFLVFFLVTAFFGTGNIASINSFDLASVYCFLTVFSPFMMGALMMWKILIPFVLVMCAFEAVQLTTQLSSKSLFLIVLVISDIMALHFFFLVKDYGSWLDIGTSISHYVIVMSMTIFLVFLNGLAQLLTTKKLRLCGKPKSHFM

SEQ ID NO: 3479 - protein, 1089 aa, unidentified
MQKASVLLFLAWVCFLFYAGIALFTSGFLLTRLELTNHSSCQEPPGPGSLPWGSQGKPGACWMASRFSRVVLVLIDALRFDFAQPQHSHVPREPPVSLPFLGKLSSLQRILEIQPHHARLYRSQVDPPTTTMQRLKALTTGSLPTFIDAGSNFASHAIVEDNLIKQLTSAGRRVVFMGDDTWKDLFPGAFSKAFFFPSFNVRDLDTVDNGILEHLYPTMDSGEWDVLIAHFLGVDHCGHKHGPHHPEMAKKLSQMDQVIQGLVERLENDTLLVVAGDHGMTTNGDHGGDSELEVSAALFLYSPTAVFPSTPPEEPEVIPQVSLVPTLALLLGLPIPFGNIGEVMAELFSGGEDSQPHSSALAQASALHLNAQQVSRFLHTYSAATQDLQAKELHQLQNLFSKASADYQWLLQSPKGAEATLPTVIAELQQFLRGARAMCIESWARFSLVRMAGGTALLAASCFICLLASQWAISPGFPFCPLLLTPVAWGLVGAIAYAGLLGTIELKLDLVLLGAVAAVSSFLPFLWKAWAGWGSKRPLATLFPIPGPVLLLLLFRLAVFFSDSFVVAEARATPFLLGSFILLLVVQLHWEGQLLPPKLLTMPRLGTSATTNPPRHNGAYALRLGIGLLLCTRLAGLFHRCPEETPVCHSSPWLSPLASMVGGRAKNLWYGACVAALVALLAAVRLWLRRYGNLKSPEPPMLFVRWGLPLMALGTAAYWALASGADEAPPRLRVLVSGASMVLPRAVAGLAASGLALLLWKPVTVLVKAGAGAPRTRTVLTPFSGPPTSQADLDYVVPQIYRHMQEEFRGRLERTKSQGPLTVAAYQLGSVYSAAMVTALTLLAFPLLLLHAERISLVFLLLFLQSFLLLHLLAAGIPVTTPGPFTVPWQAVSAWALMATQTFYSTGHQPVFPAIHWHAAFVGFPEGHGSCTWLPALLVGANTFASHLLFAVGCPLLLLWPFLCESQGLRKRQQPPGNEADARVRPEEEEEPLMEMRLRDAPQHFYAALLQLGLKYLFILGIQILACALAASILRRHLMVWKVFAPKFIFEAVGFIVSSVGLLLGIALVMRVDGAVSSWFRQLFLAQQR

SEQ ID NO: 3480 - protein, 158 aa, unidentified
MVPRSTSLTLIVFLFHRLSKAPGKMVENSPSPLPERAIYGFVLFLSSQFGFILYLVWAFIPESWLNSLGLTYWPQKYWAVALPVYLLIAIVIGYVLLFGINMMSTSPLDSIHTITDNYAKNQQQKKYQEEAIPALRDISISEVNQMFFLAAKELYTKN

SEQ ID NO: 3481 - protein, 760 aa, unidentified
MVLKAFFPTCCVSTDSGLLVGRWVPEQSSAVVLAVLHFPFIPIQVKQLLAQVRQASQVGVAVLGTWCHCRQEPEESLGRFLESLGAVFPHEPWLRLCRERGGTFWSCEATHRQAPTAPGAPGEDQVMLIFYDQRQVLLSQLHLPTVLPDRQAGATTASTGGLAAVFDTVARSEVLFRSDRFDEGPVRLSHWQSEGVEASILAELARRASGPICLLLASLLSLVSAVSACRVFKLWPLSFLGSKLSTCEQLRHRLEHLTLIFSTRKAENPAQLMRKANTVASVLLDVALGLMLLSWLHGRSRIGHLADALVPVADHVAEELQHLLQWLMGAPAGLKMNRALDQVLGRFFLYHIHLWISYIHLMSPFVEHILWHVGLSACLGLTVALSLLSDIIALLTFHIYCFYVYGARLYCLKIHGLSSLWRLFRGKKWNVLRQRVDSCSYDLDQLFIGTLLFTILLFLLPTTALYYLVFTLLRLLVVAVQGLIHLLVDLINSLPLYSLGLRLCRPYRLADKPTALQPRGAHLPPPQLWLPPQALLGRPVPQAVPWGAHLPLEAERGQAGLRELLARLAPPHGHSQPSALPGWHQLSWRMSCALWTLLCAPEHGRPCYHTLGLEVIGSEQMWGWPARLAALHHWHCLPWDPLPTCCGHHGGEHSNPRCPEHCPMPTLCTQVQRVRPPQQPQVEGWSPWGLPSGSALAVGVEGPCQDEPPSPRHPLAPSAEQHPASGGLKQSLTPVPSGPGPSLPEPHGVYLRMFPGEVAL

SEQ ID NO: 3482 - protein, 764 aa, unidentified
MLLFVLTCLLAVFPAISTKSPIFGPEEVNSVEGNSVSITCYYPPTSVNRHTRKYWCRQGARGGCITLISSEGYVSSKYAGRANLTNFPENGTFVVNIAQLSQDDSGRYKCGLGINSRGLSFDVSLEVSQGPGLLNDTKVYTVDLGRTVTINCPFKTENAQKRKSLYKQIGLYPVLVIDSSGYVNPNYTGRIRLDIQGTGQLLFSVVINQLRLSDAGQYLCQAGDDSNSNKKNADLQVLKPEPELVYEDLRGSVTFHCALGPEVANVAKFLCRQSSGENCDVVVNTLGKRAPAFEGRILLNPQDKDGSFSVVITGLRKEDAGRYLCGAHSDGQLQEGSPIQAWQLFVNEESTIPRSPTVVKGVAGGSVAVLCPYNRKESKSIKYWCLWEGAQNGRCPLLVDSEGWVKAQYEGRLSLLEEPGNGTFTVILNQLTSRDAGFYWCLTNGDTLWRTTVEIKIIEGEPNLKVPGNVTAVLGETLKVPCHFPCKFSSYEKYWCKWNNTGCQALPSQDEGPSKAFVNCDENSRLVSLTLNLVTRADEGWYWCGVKQGHFYGETAAVYVAVEERKAAGSRDVSLAKADAAPDEKVLDSGFREIENKAIQDPRLFAEEKAVADTRDQADGSRASVDSGSSEEQGGSSRALVSTLVPLGLVLAVGAVAVGVARARHRKNVDRVSIRSYRTDISMSDFENSREFGANDNMGASSITQETSLGGKEEFVATTESTTETKEPKKAKRSSKEEAEMAYKDFLLQSSTVAAEAQDGPQEA

SEQ ID NO: 3483 - protein, 555 aa, unidentified
MAAAGAAATHLEVARGKRAALFFAAVAIVLGLPLWWKTTETYRASLPYSQISGLNALQLRLMVPVTVVFTRESVPLDDQEKLPFTVVHEREIPLKYKMKIKCRFQKAYRRALDHEEEALSSGSVQEAEAMLDEPQEQAEGSLTVYVISEHSSLLPQDMMSYIGPKRTAVVRGIMHREAFNIIGRRIVQVAQAMSLTEDVLAAALADHLPEDKWSAEKRRPLKSSLGYEITFSLLNPDPKSHDVYWDIEGAVRRYVQPFLNALGAAGNFSVDSQILYYAMLGVNPRFDSASSSYYLDMHSLPHVINPVESRLGSSAASLYPVLNFLLYVPELAHSPLYIQDKDGAPVATNAFHSPRWGGIMVYNVDSKTYNASVLPVRVEVDMVRVMEVFLAQLRLLFGIAQPQLPPKCLLSGPTSEGLMTWELDRLLWARSVENLATATTTLTSLAQLLGKISNIVIKDDVASEVYKAVAAVQKSAEELASGHLASAFVASQEAVTSSELAFFDPSLLHLLYFPDDQKFAIYIPLFLPMAVPILLSLVKIFLETRKSWRKPEKTD

SEQ ID NO: 3484 - protein, 578 aa, unidentified
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTDVDKSWKELSNVLSGIFCASLNFIDSTNTVTPTASFKPLGLANDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 3485 - protein, 435 aa, unidentified
MAAPLVLVLVVAVTVRAALFRSSLAEFISERVEVVSPLSSWKRVVEGLSLLDLGVSPYSGAVFHETPLIIYLFHFLIDYAELVFMITDALTAIALYFAIQDFNKVVFKKQKLLLELDQYAPDVAELIRTPMEMRYIPLKVALFYLLNPYTILSCVAKSTCAINNTLIAFFILTTIKGSAFLSAIFLALATYQSLYPLTLFVPGLLYLLQRQYIPVKMKSKAFWIFSWEYAMMYVGSLVVIICLSFFLLSSWDFIPAVYGFILSVPDLTPNIGLFWYFFAEMFEHFSLFFVCVFQINVFFYTIPLAIKLKEHPIFFMFIQIAVIAIFKSYPTVGDVALYMAFFPVWNHLYRFLRNIFVLTCIIIVCSLLFPVLWHLWIYAGSANSNFFYAITLTFNVGQILLISDYFYAFLRREYYLTHGLYLTAKDGTEAMLVLK

SEQ ID NO: 3486 - protein, 493 aa, unidentified
MWPQDPSRKEVLRFAVSCRILTLMLQALFNAIIPDHHAEAFSPPRLAPSGFVDQLVEGLLGGLSHWDAEHFLFIAEHGYLYEHNFAFFPGFPLALLVGTELLRPLRGLLSLRSCLLISVASLNFLFFMLAAVALHDLGCLVLHCPHQSFYAALLFCLSPANVFLAAGYSEALFALLTFSAMGQLERGRVWTSVLLFAFATGVRSNGLVSVGFLMHSQCQGFFSSLTMLNPLRQLFKLMASLFLSVFTLGLPFALFQYYAYTQFCLPGSARPIPEPLVQLAVDKGYRIAEGNEPPWCFWDVPLIYSYIQDVYWNVGFLKYYELKQVPNFLLAAPVAILVAWATWTYVTTHPWLCLTLGLQRSKNNKTLEKPDLGFLSPQVFVYVVHAAVLLLFGGLCMHVQVLTRFLGSSTPIMYWFPAHLLQDQEPLLRSLKTVPWKPLAEDSPPGQKVPRNPIMGLLYHWKTCSPVTRYILGYFLTYWLLGLLLHCNFLPWT

SEQ ID NO: 3487 - protein, 258 aa, unidentified
MAARVAAVRAAAWLLLGAATGLTRGPAAAFTAARSDAGIRAMCSEIILRQEVLKDGFHRDLLIKVKFGESIEDLHTCRLLIKQDIPAGLYVDPYELASLRERNITEAVMVSENFDIEAPNYLSKESEVLIYARRDSQCIDCFQAFLPVHCRYHRPHSEDGEASIVVNNPDLLMFCDQEFPILKCWAHSEVAAPCALENEDICQWNKMKYKSVYKNVILQVPVGLTVHTSLVCSVTLLITILCSTLILVAVFKYGHFSL

SEQ ID NO: 3488 - protein, 71 aa, unidentified
MFLSLPTLTVLIPLVSLAGLFYSASVEENFPQGCTSTASLCFYSLLLPITIPVYVFFHLWTWMGIKLFRHN

SEQ ID NO: 3489 - protein, 579 aa, unidentified
MQICGSSVASVAAGTSFQVLGPVCWQQLDLKMAVRVLWGGLSLLRVLWCLLPQTGYVHPDEFFQSPEVMAEDILGVQAARPWEFYPSSSCRSVLFPLLISGSTFWLLRLWEELGPWPGLVSGYALLVGPRLLLTALSFALDGAVYHLAPPMGADRWNALALLSGSYVTLVFYTRTFSNTIEGLLFTWLLVLVSSHVTWGPTRKEPAPGPRWRSWLLGGIVAAGFFNRPTFLAFAVVPLYLWGTRGATNPGLKSLTREALVLLPGAALTAAVFVATDSWYFSSPATSRNLVLTPVNFLHYNLNPQNLARHGTHARLTHLAVNGFLLFGVLHAQALQAAWQRLQVGLQASAQMGLLRALGARSLLSSPRSYLLLLYFMPLALLSAFSHQEARFLIPLLVPLVLLCSPQTQPVPWKGTVVLFNALGALLFGCLHQGGLVPGLEYLEQVVHAPVLPSTPTHYTLLFTHTYMPPRHLLHLPGLGAPVEVVDMGGTEDWALCQTLKSFTRQPACQVAGGPWLCRLFVVTPGTTRRAVEKCSFPFKNETLLFPHLTLEDPPALSSLLSGAWRDHLSLHIVELGEET

SEQ ID NO: 3490 - protein, 263 aa, unidentified
MLLAWVQAFLVSNMLLAEAYGSGGCFWDNGHLYREDQTSPAPGLRCLNWLDAQSGLASAPVSGAGNHSYCRNPDEDPRGPWCYVSGEAGVPEKRPCEDLRCPETTSQALPAFTTEIQEASEGPGADEVQVFAPANALPARSEAAAVQPVIGISQRVRMNSKEKKDLGTLGYVLGITMMVIIIAIGAGIILGYSYKRGKDLKEQHDQKVCEREMQRITLPLSAFTNPTCEIVDEKTVVVHTSQTPVDPQEGTTPLMGQAGTPGA

SEQ ID NO: 3491 - protein, 303 aa, unidentified
MGRPLLLPLLPLLLPPAFLQPSGSTGSGPSYLYGVTQPKHLSASMGGSVEIPFSFYYPWELATAPDVRISWRRGHFHRQSFYSTRPPSIHKDYVNRLFLNWTEGQKSGFLRISNLQKQDQSVYFCRVELDTRSSGRQQWQSIEGTKLSITQAVTTTTQRPSSMTTTWRLSSTTTTTGLRVTQGKRRSDSWHISLETAVGVAVAVTVLGIMILGLICLLRWRRRKGQQRTKATTPAREPFQNTEEPYENIRNEGQNTDPKLNPKDDGIVYASLALSSSTSPRAPPSHRPLKSPQNETLYSVLKA

SEQ ID NO: 3492 - protein, 227 aa, unidentified
MGRPLLLPLLLLLQPPAFLQPGGSTGSGPSYLYGVTQPKHLSASMGGSVEIPFSFYYPWELAIVPNVRISWRRGHFHGQSFYSTRPPSIHKDYVNRLFLNWTEGQESGFLRISNLRKEDQSVYFCRVELDTRRSGRQQLQSIKGTKLTITQAVTTTTTWRPSSTTTIAGLRVTESKGHSESWHLSLDTAIRVALAVAVLKTVILGLLCLLLLWWRRRKGSRAPSSDF

SEQ ID NO: 3493 - protein, 311 aa, unidentified
MLTKPLQGPPAPPGTPTPPPGGKDREAFEAEYRLGPLLGKGGFGTVFAGHRLTDRLQVAIKVIPRNRVLGWSPLSDSVTCPLEVALLWKVGAGGGHPGVIRLLDWFETQEGFMLVLERPLPAQDLFDYITEKGPLGEGPSRCFFGQVVAAIQHCHSRGVVHRDIKDENILIDLRRGCAKLIDFGSGALLHDEPYTDFDGTRVYSPPEWISRHQYHALPATVWSLGILLYDMVCGDIPFERDQEILEAELHFPAHVSPDCCALIRRCLAPKPSSRPSLEEILLDPWMQTPAEDVPLNPSKGGPAPLAWSLLP

SEQ ID NO: 3494 - protein, 137 aa, unidentified
MTMETLPKVLEVDEKSPEAKDLLPSQTASSLCISSRSESVWTTTPRSNWEIYRKPIVIMSVGGAILLFGVVITCLAYTLKLSDKSLSILKMVGPGFLSLGLMMLVCGLVWVPIIKKKQKHRQKSNFLRSLKSFFLTR

SEQ ID NO: 3495 - protein, 409 aa, unidentified
MATSVGHRCLGLLHGVAPWRSSLHPCEITALSQSLQPLRKLPFRAFRTDARKIHTAPARTMFLLRPLPILLVTGGGYAGYRQYEKYRERELEKLGLEIPPKLAGHWEVALYKSVPTRLLSRAWGRLNQVELPHWLRRPVYSLYIWTFGVNMKEAAVEDLHHYRNLSEFFRRKLKPQARPVCGLHSVISPSDGRILNFGQVKNCEVEQVKGVTYSLESFLGPRMCTEDLPFPPAASCDSFKNQLVTREGNELYHCVIYLAPGDYHCFHSPTDWTVSHRRHFPGSLMSVNPGMARWIKELFCHNERVVLTGDWKHGFFSLTAVGATNVGSIRIYFDRDLHTNSPRHSKGSYNDFSFVTHTNREGVPMRKGEHLGEFNLGSTIVLIFEAPKDFNFQLKTGQKIRFGEALGSL

SEQ ID NO: 3496 - protein, 4303 aa, unidentified
MPPAAPARLALALGLGLWLGALAGGPGRGCGPCEPPCLCGPAPGAACRVNCSGRGLRTLGPALRIPADATALDVSHNLLRALDVGLLANLSALAELDISNNKISTLEEGIFANLFNLSEINLSGNPFECDCGLAWLPRWAEEQQVRVVQPEAATCAGPGSLAGQPLLGIPLLDSGCGEEYVACLPDNSSGTVAAVSFSAAHEGLLQPEACSAFCFSTGQGLAALSEQGWCLCGAAQPSSASFACLSLCSGPPPPPAPTCRGPTLLQHVFPASPGATLVGPHGPLASGQLAAFHIAAPLPVTATRWDFGDGSAEVDAAGPAASHRYVLPGRYHVTAVLALGAGSALLGTDVQVEAAPAALELVCPSSVQSDESLDLSIQNRGGSGLEAAYSIVALGEEPARAVHPLCPSDTEIFPGNGHCYRLVVEKAAWLQAQEQCQAWAGAALAMVDSPAVQRFLVSRVTRSLDVWIGFSTVQGVEVGPAPQGEAFSLESCQNWLPGEPHPATAEHCVRLGPTGWCNTDLCSAPHSYVCELQPGGPVQDAENLLVGAPSGDLQGPLTPLAQQDGLSAPHEPVEVMVFPGLRLSREAFLTTAEFGTQELRRPAQLRLQVYRLLSTAGTPENGSEPESRSPDNRTQLAPACMPGGRWCPGANICLPLDASCHPQACANGCTSGPGLPGAPYALWREFLFSVPAGPPAQYSVTLHGQDVLMLPGDLVGLQHDAGPGALLHCSPAPGHPGPRAPYLSANASSWLPHLPAQLEGTWACPACALRLLAATEQLTVLLGLRPNPGLRLPGRYEVRAEVGNGVSRHNLSCSFDVVSPVAGLRVIYPAPRDGRLYVPTNGSALVLQVDSGANATATARWPGGSVSARFENVCPALVATFVPGCPWETNDTLFSVVALPWLSEGEHVVDVVVENSASRANLSLRVTAEEPICGLRATPSPEARVLQGVLVRYSPVVEAGSDMVFRWTINDKQSLTFQNVVFNVIYQSAAVFKLSLTASNHVSNVTVNYNVTVERMNRMQGLQVSTVPAVLSPNATLALTAGVLVDSAVEVAFLWTFGDGEQALHQFQPPYNESFPVPDPSVAQVLVEHNVMHTYAAPGEYLLTVLASNAFENLTQQVPVSVRASLPSVAVGVSDGVLVAGRPVTFYPHPLPSPGGVLYTWDFGDGSPVLTQSQPAANHTYASRGTYHVRLEVNNTVSGAAAQADVRVFEELRGLSVDMSLAVEQGAPVVVSAAVQTGDNITWTFDMGDGTVLSGPEATVEHVYLRAQNCTVTVGAASPAGHLARSLHVLVFVLEVLRVEPAACIPTQPDARLTAYVTGNPAHYLFDWTFGDGSSNTTVRGCPTVTHNFTRSGTFPLALVLSSRVNRAHYFTSICVEPEVGNVTLQPERQFVQLGDEAWLVACAWPPFPYRYTWDFGTEEAAPTRARGPEVTFIYRDPGSYLVTVTASNNISAANDSALVEVQEPVLVTSIKVNGSLGLELQQPYLFSAVGRGRPASYLWDLGDGGWLEGPEVTHAYNSTGDFTVRVAGWNEVSRSEAWLNVTVKRRVRGLVVNASRTVVPLNGSVSFSTSLEAGSDVRYSWVLCDRCTPIPGGPTISYTFRSVGTFNIIVTAENEVGSAQDSIFVYVLQLIEGLQVVGGGRYFPTNHTVQLQAVVRDGTNVSYSWTAWRDRGPALAGSGKGFSLTVLEAGTYHVQLRATNMLGSAWADCTMDFVEPVGWLMVAASPNPAAVNTSVTLSAELAGGSGVVYTWSLEEGLSWETSEPFTTHSFPTPGLHLVTMTAGNPLGSANATVEVDVQVPVSGLSIRASEPGGSFVAAGSSVPFWGQLATGTNVSWCWAVPGGSSKRGPHVTMVFPDAGTFSIRLNASNAVSWVSATYNLTAEEPIVGLVLWASSKVVAPGQLVHFQILLAAGSAVTFRLQVGGANPEVLPGPRFSHSFPRVGDHVVSVRGKNHVSWAQAQVRIVVLEAVSGLQVPNCCEPGIATGTERNFTARVQRGSRVAYAWYFSLQKVQGDSLVILSGRDVTYTPVAAGLLEIQVRAFNALGSENRTLVLEVQDAVQYVALQSGPCFTNRSAQFEAATSPSPRRVAYHWDFGDGSPGQDTDEPRAEHSYLRPGDYRVQVNASNLVSFFVAQATVTVQVLACREPEVDVVLPLQVLMRRSQRNYLEAHVDLRDCVTYQTEYRWEVYRTASCQRPGRPARVALPGVDVSRPRLVLPRLALPVGHYCFVFVVSFGDTPLTQSIQANVTVAPERLVPIIEGGSYRVWSDTRDLVLDGSESYDPNLEDGDQTPLSFHWACVASTQREAGGCALNFGPRGSSTVTIPRERLAAGVEYTFSLTVWKAGRKEEATNQTVLIRSGRVPIVSLECVSCKAQAVYEVSRSSYVYLEGRCLNCSSGSKRGRWAARTFSNKTLVLDETTTSTGSAGMRLVLRRGVLRDGEGYTFTLTVLGRSGEEEGCASIRLSPNRPPLGGSCRLFPLGAVHALTTKVHFECTGWHDAEDAGAPLVYALLLRRCRQGHCEEFCVYKGSLSSYGAVLPPGFRPHFEVGLAVVVQDQLGAAVVALNRSLAITLPEPNGSATGLTVWLHGLTASVLPGLLRQADPQHVIEYSLALVTVLNEYERALDVAAEPKHERQHRAQIRKNITETLVSLRVHTVDDIQQIAAALAQCMGPSRELVCRSCLKQTLHKLEAMMLILQAETTAGTVTPTAIGDSILNITGDLIHLASSDVRAPQPSELGAESPSRMVASQAYNLTSALMRILMRSRVLNEEPLTLAGEEIVAQGKRSDPRSLLCYGGAPGPGCHFSIPEAFSGALANLSDVVQLIFLVDSNPFPFGYISNYTVSTKVASMAFQTQAGAQIPIERLASERAITVKVPNNSDWAARGHRSSANSANSVVVQPQASVGAVVTLDSSNPAAGLHLQLNYTLLDGHYLSEEPEPYLAVYLHSEPRPNEHNCSASRRIRPESLQGADHRPYTFFISPGSRDPAGSYHLNLSSHFRWSALQVSVGLYTSLCQYFSEEDMVWRTEGLLPLEETSPRQAVCLTRHLTAFGASLFVPPSHVRFVFPEPTADVNYIVMLTCAVCLVTYMVMAAILHKLDQLDASRGRAIPFCGQRGRFKYEILVKTGWGRGSGTTAHVGIMLYGVDSRSGHRHLDGDRAFHRNSLDIFRIATPHSLGSVWKIRVWHDNKGLSPAWFLQHVIVRDLQTARSAFFLVNDWLSVETEANGGLVEKEVLAASDAALLRFRRLLVAELQRGFFDKHIWLSIWDRPPRSRFTRIQRATCCVLLICLFLGANAVWYGAVGDSAYSTGHVSRLSPLSVDTVAVGLVSSVVVYPVYLAILFLFRMSRSKVAGSPSPTPAGQQVLDIDSCLDSSVLDSSFLTFSGLHAEQAFVGQMKSDLFLDDSKSLVCWPSGEGTLSWPDLLSDPSIVGSNLRQLARGQAGHGLGPEEDGFSLASPYSPAKSFSASDEDLIQQVLAEGVSSPAPTQDTHMETDLLSSLSSTPGEKTETLALQRLGELGPPSPGLNWEQPQAARLSRTGLVEGLRKRLLPAWCASLAHGLSLLLVAVAVAVSGWVGASFPPGVSVAWLLSSSASFLASFLGWEPLKVLLEALYFSLVAKRLHPDEDDTLVESPAVTPVSARVPRVRPPHGFALFLAKEEARKVKRLHGMLRSLLVYMLFLLVTLLASYGDASCHGHAYRLQSAIKQELHSRAFLAITRSEELWPWMAHVLLPYVHGNQSSPELGPPRLRQVRLQEALYPDPPGPRVHTCSAAGGFSTSDYDVGWESPHNGSGTWAYSAPDLLGAWSWGSCAVYDSGGYVQELGLSLEESRDRLRFLQLHNWLDNRSRAVFLELTRYSPAVGLHAAVTLRLEFPAAGRALAALSVRPFALRRLSAGLSLPLLTSVCLLLFAVHFAVAEARTWHREGRWRVLRLGAWARWLLVALTAATALVRLAQLGAADRQWTRFVRGRPRRFTSFDQVAQLSSAARGLAASLLFLLLVKAAQQLRFVRQWSVFGKTLCRALPELLGVTLGLVVLGVAYAQLAILLVSSCVDSLWSVAQALLVLCPGTGLSTLCPAESWHLSPLLCVGLWALRLWGALRLGAVILRWRYHALRGELYRPAWEPQDYEMVELFLRRLRLWMGLSKVKEFRHKVRFEGMEPLPSRSSRGSKVSPDVPPPSAGSDASHPSTSSSQLDGLSVSLGRLGTRCEPEPSRLQAVFEALLTQFDRLNQATEDVYQLEQQLHSLQGRRSSRAPAGSSRGPSPGLRPALPSRLARASRGVDLATGPSRTPLRAKNKVHPSST

SEQ ID NO: 3497 - protein, 2849 aa, unidentified
MAEEAAQNISDDQERCLQAACCLSFGGELSVSTDKSWGLHLCSCSPPGGGLWVEVYANHVLLMSDGKCGCPWCALNGKAEDRESQSPSSSASRQKNIWKTTSEAALSVVNEKTQAVVNEKTQAPLDCDNSADRIPHKPFIIIARAWSSGGPRFHHRRLCATGTADSTFSALLQLQGTTSAAAPCSLKMEASCCVLRLLCCAEDVATGLLPGTVTMETPTKVARPTQTSSQRVPLWPISHFPTSPRSSHGLPPGIPRTPSFTASQSGSEILYPPTQHPPVAILARNSDNFMNPVLNCSLEVEARAPPNLGFRVHMASGEALCLMMDFGDSSGVEMRLHNMSEAMAVTAYHQYSKGIFFHLLHFQLDMSTYKEAETQNTTLNVYLCQSENSCLEDSDPSNLGYELISAFVTKGVYMLKAVIYNEFHGTEVELGPYYVEIGHEAVSAFMNSSSVHEDEVLVFADSQVNQKSTVVIHHFPSIPSYNVSFISQTQVGDSQAWHSMTVWYKMQSVSVYTNGTVFATDTDITFTAVTKETIPLEFEWYFGEDPPVRTTSRSIKKRLSIPQWYRVMVKASNRMSSVVSEPHVIRVQKKIVANRLTSPSSALVNASVAFECWINFGTDVAYLWDFGDGTVSLGSSSSSHVYSREGEFTVEVLAFNNVSASTLRQQLFIVCEPCQPPLVKNMGPGKVQIWRSQPVRLGVTFEAAVFCDISQGLSYTWNLMDSEGLPVSLPAAVDTHRQTLILPSHTLEYGNYTALAKVQIEGSVVYSNYCVGLEVRAQAPVSVISEGTHLFFSRTTSSPIVLRGTQSFDPDDPGATLRYHWECATAGSPAHPCFDSSTAHQLDAAAPTVSFEAQWLSDSYDQFLVMLRVSSGGRNSSETRVFLSPYPDSAFRFVHISWVSFKDTFVNWNDELSLQAMCEDCSEIPNLSYSWDLFLVNATEKNRIEVPFCRVVGLLGSLGLGAISESSQLNLLPTEPGTADPDATTTPFSREPSPVTLGQPATSAPRGTPTEPMTGVYWIPPAGDSAVLGEAPEEGSLDLEPGPQSKGSLMTGRSERSQPTHSPDPHLSDFEAYYSDIQEAIPSGGRQPAKDTSFPGSGPSLSAEESPGDGDNLVDPSLSAGRAEPVLMIDWPKALLGRAVFQGYSSSGITEQTVTIKPYSLSSGETYVLQVSVASKHGLLGKAQLYLTVNPAPRDMACQVQPHHGLEAHTVFSVFCMSGKPDFHYEFSYQIGNTSKHTLYHGRDTQYYFVLPAGEHLDNYKVMVSTEITDGKGSKVQPCTVVVTVLPRYHGNDCLGEDLYNSSLKNLSTLQLMGSYTEIRNYITVITRILSRLSKEDKTASCNQWSRIQDALISSVCRLAFVDQEEMIGSVLMLRDLVSFSNKLGFMSAVLILKYTRALLAQGQFSGPFVIDKGVRLELIGLISRVWEVSEQENSKEEVYRHEEGITVISDLLLGCLSLNHVSTGQMEFRTLLHYNLQSSVQSLGSVQVHLPGDLAGHSPAGAETQSPCYISQLILFKKNPYPGSQAPGQIGGVVGLNLYTCSSRRPINRQWLRKPVMVEFGEEDGLDNRRNKTTFVLLRDKVNLHQFTELSENPQESLQIEIEFSKPVTRAFPVMLLVRFSEKPTPSDFLVKQIYFWDESIVQIYIPAASQKDASVGYLSLLDADYDRKPPNRYLAKAVNYTVHFQWIRCLFWDKREWKSERFSPQPGTSPEKVNCSYHRLAAFALLRRKLKASFEVSDISKLQSHPENLLPSIFIMGSVILYGFLVAKSRQVDHHEKKKAGYIFLQEASLPGHQLYAVVIDTGFRAPARLTSKVYIVLCGDNGLSETKELSCPEKPLFERNSRHTFILSAPAQLGLLRKIRLWHDSRGPSPGWFISHVMVKELHTGQGWFFPAQCWLSAGRHDGRVERELTCLQGGLGFRKLFYCKFTEYLEDFHVWLSVYSRPSSSRYLHTPRLTVSFSLLCVYACLTALVAAGGQEQPHLDVSPTLGSFRVGLLCTLLASPGAQLLSLLFRLSKEAPGSARVEPHSPLRGGAQTEAPHGPNSWGRIPDAQEPRKQPASAILSGSGRAQRKAASDNGTACPAPKLQVHGADHSRTSLMGKSHCCPPHTQAPSSGLEGLMPQWSRALQPWWSSAVWAICGTASLACSLGTGFLAYRFGQEQCVQWLHLLSLSVVCCIFITQPLMVCLMALGFAWKRRADNHFFTESLCEATRDLDSELAERSWTRLPFSSSCSIPDCAGEVEKVLAARQQARHLRWAHPPSKAQLRGTRQRMRRESRTRAALRDISMDILMLLLLLCVIYGRFSQDEYSLNQAIRKEFTRNARNCLGGLRNIADWWDWSLTTLLDGLYPGGTPSARVPGAQPGALGGKCYLIGSSVIRQLKVFPRHLCKPPRPFSALIEDSIPTCSPEVGGPENPYLIDPENQNVTLNGPGGCGTREDCVLSLGRTRTEAHTALSRLRASMWIDRSTRAVSVHFTLYNPPTQLFTSVSLRVEILPTGSLVPSSLVESFSIFRSDSALQYHLMLPQLVFLALSLIHLCVQLYRMMDKGVLSYWRKPRNWLELSVVGVSLTYYAVSGHLVTLAGDVTNQFHRGLCRAFMDLTLMASWNQRARWLRGILLFLFTLKCVYLPGIQNTMASCSSMMRHSLPSIFVAGLVGALMLAALSHLHRFLLSMWVLPPGTFTDAFPGLLFHFPRRSQKDCLLGLSKSDQRAMACYFGILLIVSATLCFGMLRGFLMTLPQKRKSFQSKSFVRLKDVTAYMWEKVLTFLRLETPKLEEAEMVENHNYYLDEFANLLDELLMKINGLSDSLQLPLLEKTSNNTGEARTEESPLVDISSYQAAEPADIKDF

SEQ ID NO: 3498 - protein, 968 aa, unidentified
MVNSSRVQPQQPGDAKRPPAPRAPDPGRLMAGCAAVGASLAAPGGLCEQRGLEIEMQRIRQAAARDPPAGAAASPSPPLSSCSRQAWSRDNPGFEAEEEEEEVEGEEGGMVVEMDVEWRPGSRRSAASSAVSSVGARSRGLGGYHGAGHPSGRRRRREDQGPPCPSPVGGGDPLHRHLPLEGQPPRVAWAERLVRGLRGLWGTRLMEESSTNREKYLKSVLRELVTYLLFLIVLCILTYGMMSSNVYYYTRMMSQLFLDTPVSKTEKTNFKTLSSMEDFWKFTEGSLLDGLYWKMQPSNQTEADNRSFIFYENLLLGVPRIRQLRVRNGSCSIPQDLRDEIKECYDVYSVSSEDRAPFGPRNGTAWIYTSEKDLNGSSHWGIIATYSGAGYYLDLSRTREETAAQVASLKKNVWLDRGTRATFIDFSVYNANINLFCVVRLLVEFPATGGVIPSWQFQPLKLIRYVTTFDFFLAACEIIFCFFIFYYVVEEILEIRIHKLHYFRSFWNCLDVVIVVLSVVAIGINIYRTSNVEVLLQFLEDQNTFPNFEHLAYWQIQFNNIAAVTVFFVWIKLFKFINFNRTMSQLSTTMSRCAKDLFGFAIMFFIIFLAYAQLAYLVFGTQVDDFSTFQECIFTQFRIILGDINFAEIEEANRVLGPIYFTTFVFFMFFILLNMFLAIINDTYSEVKSDLAQQKAEMELSDLIRKGYHKALVKLKLKKNTVDDISESLRQGGGKLNFDELRQDLKGKGHTDAEIEAIFTKYDQDGDQELTEHEHQQMRDDLEKEREDLDLDHSSLPRPMSSRSFPRSLDDSEEDDDEDSGHSSRRRGSISSGVSYEEFQVLVRRVDRMEHSIGSIVSKIDAVIVKLEIMERAKLKRREVLGRLLDGVAEDERLGRDSEIHREQMERLVREELERWESDDAASQISHGLGTPVGLNGQPRPRSSRPSSSQSTEGMEGAGGNGSSNVHV

SEQ ID NO: 3499 - protein, 805 aa, unidentified
MNAVGSPEGQELQKLGSGAWDNPAYSGPPSPHGTLRVCTISSTGPLQPQPKKPEDEPQETAYRTQVSSCCLHICQGIRGLWGTTLTENTAENRELYIKTTLRELLVYIVFLVDICLLTYGMTSSSAYYYTKVMSELFLHTPSDTGVSFQAISSMADFWDFAQGPLLDSLYWTKWYNNQSLGHGSHSFIYYENMLLGVPRLRQLKVRNDSCVVHEDFREDILSCYDVYSPDKEEQLPFGPFNGTAWTYHSQDELGGFSHWGRLTSYSGGGYYLDLPGSRQGSAEALRALQEGLWLDRGTRVVFIDFSVYNANINLFCVLRLVVEFPATGGAIPSWQIRTVKLIRYVSNWDFFIVGCEVIFCVFIFYYVVEEILELHIHRLRYLSSIWNILDLVVILLSIVAVGFHIFRTLEVNRLMGKLLQQPNTYADFEFLAFWQTQYNNMNAVNLFFAWIKIFKYISFNKTMTQLSSTLARCAKDILGFAVMFFIVFFAYAQLGYLLFGTQVENFSTFIKCIFTQFRIILGDFDYNAIDNANRILGPAYFVTYVFFVFFVLLNMFLAIINDTYSEVKEELAGQKDELQLSDLLKQGYNKTLLRLRLRKERVSDVQKVLQGGEQEIQFEDFTNTLRELGHAEHEITELTATFTKFDRDGNRILDEKEQEKMRQDLEEERVALNTEIEKLGRSIVSSPQGKSGPEAARAGGWVSGEEFYMLTRRVLQLETVLEGVVSQIDAVGSKLKMLERKGWLAPSPGVKEQAIWKHPQPAPAVTPDPWGVQGGQESEVPYKREEEALEERRLSRGEIPTLQRS

SEQ ID NO: 3500 - protein, 624 aa, unidentified
MAEASRWHRGGASKHKLHYRKEVEITTTLQELLLYFIFLINLCILTFGMVNPHMYYLNKVMSSLFLDTSVPGEERTNFKSIRSITDFWKFMEGPLLEGLYWDSWYNNQQLYNLKNSSRIYYENILLGVPRVRQLKVRNNTCKVYSSFQSLMSECYGKYTSANEDLSNFGLQINTEWRYSTSNTNSPWHWGFLGVYRNGGYIFTLSKSKSETKNKFIDLRLNSWITRGTRVIFIDFSLYNANVNLFCIIRLVAEFPATGGILTSWQFYSVKLLRYVSYYDYFIASCEITFCIFLFVFTTQEVKKIKEFKSAYFKSIWNWLELLLLLLCFVAVSFNTYYNVQIFLLLGQLLKSTEKYSDFYFLACWHIYYNNIIAITIFFAWIKIFKFISFNKTMSQLSSTLSRCVKDIVGFAIMFFIIFFAYAQLGFLVFGSQVDDFSTFQNSIFAQFRIVLGDFNFAGIQQANPILGPIYFITFIFFVFFVLLNMFLAIINDTYSEVKADYSIGRRLDFELGKMIKQSYKNVLEKFRLKKAQKDEDKKTKGSGDLAEQARREGFDENEIQNAEQMKKWKERLEKKYYSMEIQDDYQPVTQEEFRELFLYAVELEKELHYINLKLNQVVRKVSAL

SEQ ID NO: 3501 - protein, 2253 aa, unidentified
MRPGPALLLLGVGLSLSVGRLPLPPVPRGAQAAVSGAPGGLLRGAPGLGVRGGRALLSLRPSAVRAGGAVLSGRGSLCFPHGGTGRRWYCLDLRVLLSAQRLPWPAAPALALVDLQLSARGGRLSLTWSVRLPRSPGRLAWAFRLRLLGPGAARPASPAARVSPRSAAPGPRPQQGFVARTECPTDGPARVMLQAVNSSSHRAVESSVSCQINACVIQRVRINTDQKGAPVRLSMQAEATINASVQLDCPAARAIAQYWQVFSVPAVGQAPDWTQPLDLPQLEIRNSPLFIHIPNNSLQWGVYVFNFTVSITTGNPKMPEVKDSDAVYVWIVRSSLQAVMLGDANITANFTEQLILDGSTSSDPDADSPLQGLQFFWYCTTDPRNYGGDRIILGSKEVCHPEQANLKWPWASGPVLTLLPETLKGDHVYFFRMVIRKDSRTAFSDKRVHVLQGPKAIAHITCIENCERNFIVSDRFSLFLNCTNCASRDFYKWSILSSSGGEMLFDWMGETVTGRNGAYLSIKAFAFRHFLEAEFSISLYLACWSGVTSVFRHSFIINHGPQIGECKINPAKGIALITKFVVQCSNFRDKHVPLTYKIIVSDLHSVGEISSVKENTLGTILYLGPQSTVPPSFLPVGMLASQYGLKIYAQVYDSLGAFSQVTLHATAQAPTDKNSSKTVLNQLLSFTVGPSSLLSTLIQKKDFLPAGYLLYIVASVLNNMKTELPLRDDRVNLRKHLIDQSFLLPVSTLVEIGQVVMTITKLTQKPSEFTWDAQKRATMRVWQANQALQEYQQKDKRFRSEQIEIVSTGILMSLSNILKMTSPHQVVKDPFYVIESLSDTILANKVPGNKTTSMRTPNFNMYVKKVEKWGINQLFRNEKHCRNCFYPTLNVSSVPGLSANGPISTMFCDFTNDLFPWLNDQENTSVEVSGFRMTGVADNGSVLEITPDVAEVYLVRKNLTFAAFNLTVGPNSEVDGSLKKTTGGFSFQVDSTVLREVLVHIVTEVMVLFTVLVYTGSQITPTALVATFLVPHDIPPFASQSALFDPACTVKKARVVCLPVSLLQLIAQHSHSPHCTVSIVLQAPRFVMKLNDKLVRISIFSVQCLDMYGIQSEWREGYCILGEKTSWYEVHCICKNVVRARRQLGTIGLTGIHLHTHYVMAKVIVIPNPVDLRLNIIKSLHQNPVTLFTVLFIILLYVGLAFWALYRDEMDQHLRGHVIVLPDNDPYDNLCYLVTIFTGSRWGSGTRANVFVQLRGTVSTSDVHCLSHPHFTTLYRGSINTFLLTTKSDLGDIHSIRVWHNNEGRSPSWYLSRIKVENLFSRHIWLFICQKWLSVDTTLDRTFHVTHPDERLTRKDFFFIDVSSNLRKNHMWFSIFASVVAKTFNRLQRLSCCLAMLLSSLLCNIMFFNLNRQEQTESRERKYMRSMMIGIESVLITIPVQLLITFLFTCSQRKPQADLKEVSPQKHPLMSEASEHWEEYLRKWHAYETAKVHPREVAKPASKGKPRLPKASPKATSKPKHRHRKAQIKTPETLGPNTNSNNNIEDDQDVHSEQHPSQKDLQQLKKKPRIVLPWWCVYVAWFLVFATSSISSFFIVFYGLTYGYDKSIEWLFASFCSFCQSVLLVQPSKIILLSGFRTNKPKYCKNLSWSTKYKYTEIRLDGMRMHPEEMQRIHDQIVRIRGTRMYQPLTEDEIRIFKRKKRIKRRALLFLSYILTHFIFLALLLILIVLLRHTDCFYYNQFIRDRFSMDLATVTKLEDIYRWLNSVLLPLLHNDLNPTFLPESSSKILGLPLMRQVRAKSSEKMCLPAEKFVQNSIRREIHCHPKYGIDPEDTKNYSGFWNEVDKQAIDESTNGFTYKPQGTQWLYYSYGLLHTYGSGGYALYFFPEQQRFNSTLRLKELQESNWLDEKTWAVVLELTTFNPDINLFCSISVIFEVSQLGVVNTSISLHSFSLADFDRKASAEIYLYVAILIFFLAYVVDEGCIIMQERASYVRSVYNLLNFALKCIFTVLIVLFLRKHFLATGIIRFYLSNPEDFIPFHAVSQVDHIMRIILGFLLFLTILKTLRYSRFFYDVRLAQRAIQAALPGICHMAFVVSVYFFVYMAFGYLVFGQHEWNYSNLIHSTQTVFSYCVSAFQNTEFSNNRILGVLFLSSFMLVMICVLINLFQAVILSAYEEMKQPVYEEPSDEVEAMTYLCRKLRTMFSFLTSQSKAKDEPEFFIDMLYGQPEKNSHRYLGLKTRNINGKKMVYLVV

SEQ ID NO: 3502 - protein, 4074 aa, unidentified
MTAWLISLMSIEVLLLAVRHLSLHIEPEEGSLAGGTWITVIFDGLELGVLYPNNGSQLEIHLVNVNMVVPALRSVPCDVFPVFLDLPVVTCRTRSVLSEAHEGLYFLEAYFGGQLVSSPNPGPRDSCTFKFSKAQTPIVHQVYPPSGVPGKLIHVYGWIITGRLETFDFDAEYIDSPVILEAQGDKWVTPCSLINRQMGSCYPIQEDHGLGTLQCHVEGDYIGSQNVSFSVFNKGKSMVHKKAWLISAKQDLFLYQTHSEILSVFPETGSLGGRTNITITGDFFDNSAQVTIAGIPCDIRHVSPRKIECTTRAPGKDVRLTTPQPGNRGLLFEVGDAVEGLELTEATPGYRWQIVPNASSPFGFWSQEGQPFRARLSGFFVAPETNNYTFWIQADSQASLHFSWSEEPRTKVKVASISVGTADWFDSWEQNRDEGTWQQKTPKLELLGGAMYYLEAEHHGIAPSRGMRIGVQIHNTWLNPDVVTTYLREKHQIRVRAQRLPEVQVLNVSGRGNFFLTWDNVSSQPIPANATAHLIQTTIEELLAVKCKLEPLWSNILLRLGFERGPEVSNSDGDLTSGTEPFCGRFSLRQPRHLVLTPPAAQKGYRLDQYTHLCLAYKGHMNKILKMIVSFTIGFQNMVKNTTCDWSLTRTSPESWQFDCTDLWETCVRCFGDLQPPPANSPVLVHQINLLPLAQETGLFYVDEIIIADTNVTVSQADSGTARPGGNLVESVSVVGSPPVYSVTSWLAGCGTELPLITARSVPTEGTEEGSGLVLVTTQRRQRTSPPLGGHFRIQLPNTVISDVPVQISAHHLHQLLQNNADDFTSRYLNASDFTVKEDLYTCYEHVWTLSWSTQIGDLPNFIRVSDENLTGVNPAAATRVVYDGGVFLGPIFGDMLATANQHTQVVVRVNDVPAHCPGSCSFQYLQGSTPCVHSVWYSIDGDINLMIYITGTGFSGDSQFLQVTVNKTSCKVIFSNQTNVVCQTDLLPVGMHRILMLVRPSGLAISATGEDLFLNVKPRLDMVEPSRAADIGGLWATIRGSSLEGVSLILFGSYSCAINVATSNSSRIQCKVPPRGKDGRIVNVTVIRGDYSAVLPRAFTYVSSLNPVIVTLSRNISNIAGGETLVIGVARLMNYTDLDVEVHVQDALAPVHTQSAWGLEVALPPLPAGLHRISVSINGVSIHSQGVDLHIQYLTEVFSIEPCCGSLLGGTILSISGIGFSRDPALVWVLVGNRSCDIVNLTEASIWCETLPAPQIPDAGAPTVPAAVEVWAGNRFFARGPSPSLVGKGFTFMYEAAATPVVTAMQGEITNSSLSLHVGGSNLSNSVILLGNLNCDVETQSFQGNVSLSGCSIPLHSLEAGIYPLQVRQKQMGFANMSVVLQQFAVMPRIMAIFPSQGSACGGTILTVRGLLLNSRRRSVRVDLSGPFTCVILSLGDHTILCQVSLEGDPLPGASFSLNVTVLVNGLTSECQGNCTLFIREEASPVMDALSTNTSGSLTTVLIRGQRLATTADEPMVFVDDQLPCNVTFFNASHVVCQTRDLAPGPHYLSVFYTRNGYACSGNVSRHFYIMPQVFHYFPKNFSLHGGSLLTIEGTGLRGQNTTSVYIDQQTCLTVNIGAELIRCIVPTGNGSVALEIEVDGLWYHIGVIGYNKAFTPELISISQSDDILTFAVAQISGAANIDIFIGMSPCVGVSGNHTVLQCVVPSLPAGEYHVRGYDCIRGWASSALVFTSRVIITAVTENFGCLGGRLVHVFGAGFSPGNVSAAVCGAPCRVLANATVSAFSCLVLPLDVSLAFLCGLKREEDSCEAARHTYVQCDLTVAMATEQLLESWPYLYICEESSQCLFVPDHWAESMFPSFSGLFISPKLERDEVLIYNSSCNITMETEAEMECETPNQPITVKITEIRKRWGQNTQGNFSLQFCRRWSRTHSWFPERLPQDGDNVTVENGQLLLLDTNTSILNLLHIKGGKLIFMAPGPIELRAHAILVSDGGELRIGSEDKPFQGRAQITLYGSSYSTPFFPYGVKFLAVRNGTLSLHGSLPEVIVTCLRATAHALDTVLALEDAVDWNPGDEVVIISGTGVKGAKPMEEIVTVETVQDTDLYLKSPLRYSHNFTENWVAGEHHILKATVALLSRSITIQGNLTNEREKLLVSCQEANAPEGNLQHCLYSMSEKMLGSRDMGARVIVQSFPEEPSQVQLKGVQFQVLGQAFHKHLSSLTLVGAMRESFIQGCTVRNSFSRGLSMCGTLGLKVDSNVFYNILGHALLVGTCTEMRYISWEAIHGRKDDWSGHGNIIRNNVIIQVSGAEGLSNPEMLTPSGIYICSPTNVIEGNRVCGAGYGYFFHLMTNQTSQAPLLSFTQNIAHSCTRYGLFVYPKFQPPWDNVTGTTLFQSFTVWESAGGAQIFRSSNLRLKNFKVYSCRDFGIDVLESDANTSVTDSLLLGHFAHKGSLCMSSGIKTPKRWELMVSNTTFVNFDLINCVAIRTCSDCSQGQGGFTVKTSQLKFTNSSNLVAFPFPHAAILEDLDGSLSGKNRSHILASMETLSASCLVNSSFGRVVHGSACGGGVLFHRMSIGLANTPEVSYDLTMTDSRNKTTTVNYVRDTLSNPRGWMALLLDQETYSLQSENLWINRSLQYSATFDNFAPGNYLLLVHTDLPPYPDILLRCGSRVGLSFPFLPSPGQNQGCDWFFNSQLRQLTYLVSGEGQVQVILRVKEGMPPTISASTSAPESALKWSLPETWQGVEEGWGGYNNTIPGPGDDVLILPNRTVLVDTDLPFFKGLYVMGTLDFPVDRSNVLSVACMVIAGGELKVGTLENPLEKEQKLLILLRASEGVFCDRMNGIHIDPGTIGVYGKVHLYSAYPKNSWTHLGADIASGNERIIVEDAVDWRPHDKIVLSSSSYEPHEAEVLTVKEVKGHHVRIYERLKHRHIGSVHVTEDGRHIRLAAEVGLLTRNIQIQPDVSCRGRLFVGSFRKSSREEFSGVLQLLNVEIQNFGSPLYSSVEFSNVSAGSWIISSTLHQSCGGGIHAAASHGVLLNDNIVFGTAGHGIDLEGQAYTVTNNLVVLMTQPAWSTIWVAGIKVNQVKDINLHGNVVAGSERLGFHIRGHKCSSCELLWSDNVAHSSLHGLHLYKESGLDNCTRISGFLAFKNFDYGAMLHVENSVEIENITLVDNTIGLLAVVYVFSAPQNSVKKVQIVLRNSVIVATSSSFDCIQDKVKPHSANLTSTDRAPSNPRGGRIGILWPVFTSEPNQWPQEPWHKVRNDHSISGIMKLQDVTFSSFVKSCYSDDLDVCILPNAENSGIMHPITAERTRMLKIKDKNKFYFPSLQPRKDLGKVVCPELDCASPRKYLFKDLDGRALGLPPPVSVFPKTEAEWTASFFNAGTFREEQKCTYQFLMQGFICKQTDQVVLILDSADAIWAIQKLYPVVSVTSGFVDVFSSVNANIPCSTSGSVSTFYSILPIRQITKVCFMDQTPQVLRFFLLGNKSTSKLLLAVFYHELQSPHVFLGESFIPPTLVQSASLLLNESIGANYFNIMDNLLYVVLQGEEPIEIRSGVSIHLALTVMVSVLEKGWEIVILERLTNFLQIGQNQIRFIHEMPGHEETLKAIADSRAKRKRNCPTVTCTSHYRRVGQRRPLMMEMNSHRASPPMTVETISKVIVIEIGDSPTVRSTGMISSLSSNKLQNLAHRVITAQQTGVLENVLNMTIGALLVTQSKGVIGYGNTSSFKTGNLIYIRPYALSILVQPSDGEVGNELPVQPQLVFLDEQNRRVESLGPPSEPWTISASLEGASDSVLKGCTQAETQDGYVSFYNLAVLISGSNWHFIFTVTSPPGVNFTARSKPFAVLPVTRKEKSTIILAASLSSVASWLALSCLVCCWLKRSKSRKTKPEEIPESQTNNQNIHIHISSKRRESQGPKKEDTVVGEDMRMKVMLGKVNQCPHQLMNGVSRRKVSRHIVREEEAAVPAPGTTGITSHGHICAPGAPAQQVYLQETGNWKEGQEQLLRYQLAGQNQLLLLCPDFRQERQQLPGQSRLSKQSGSLGLSQEKKASCGATEAFCLHSVHPETIQEQL

SEQ ID NO: 3503 - protein, 4243 aa, unidentified
MGHLWLLGIWGLCGLLLCAADPSTDGSQIIPKVTEIIPKYGSINGATRLTIRGEGFSQANQFNYGVDNAELGNSVQLISSFQSITCDVEKDASHSTQITCYTRAMPEDSYTVRVSVDGVPVTENNTCKGHINSWECTFNAKSFRTPTIRSITPLSGTPGTLITIQGRIFTDVYGSNIALSSNGKNVRILRVYIGGMPCELLIPQSDNLYGLKLDHPNGDMGSMVCKTTGTFIGHHNVSFILDNDYGRSFPQKMAYFVSSLNKIAMFQTYAEVTMIFPSQGSIRGGTTLTISGRFFDQTDFPVRVLVGGEPCDILNVTENSICCKTPPKPHILKTVYPGGRGLKLEVWNNSRPIRLEEILEYNEKTPGYMGASWVDSASYIWLMEQDTFVARFSGFLVAPDSDVYRFYIKGDDRYAIYFSQTGLPEDKVRIAYHSANANSYFSSPTQRSDDIHLQKGKEYYIEILLQEYRLSAFVDVGLYQYRNVYTEQQTGDAVNEEQVIKSQSTILQEVQVITLENWETTNAINEVQKIKVTSPCVEANSCSLYQYRLIYNMEKTVFLPADASEFILQSALNDLWSIKPDTVQVIRTQNPQSYVYMVTFISTRGDFDLLGYEVVEGNNVTLDITEQTKGKPNLETFTLNWDGIASKPLTLWSSEAEFQGAVEEMVSTKCPPQIANFEEGFVVKYFRDYETDFNLEHINRGQKTAETDAYCGRYSLKNPAVLFDSADVKPNRRPYGDILLFPYNQLCLAYKGFLANYIGLKFQYQDNSKITRSTDTQFTYNFAYGNNWTYTCIDLLDLVRTKYTGTNVSLQRISLHKASESQSFYVDVVYIGHTSTISTLDEMPKRRLPALANKGIFLEHFQVNQTKTNGPTMTNQYSVTMTSYNCSYNIPMMAVSFGQIITHETENEFVYRGNNWPGESKIHIQRIQAASPPLSGSFDIQAYGHILKGLPAAVSAADLQFALQSLEGMGRISVTREGTCAGYAWNIKWRSTCGKQNLLQINDSNIIGEKANMTVTRIKEGGLFRQHVLGDLLRTPSQQPQVEVYVNGIPAKCSGDCGFTWDSNITPLVLAISPSQGSYEEGTILTIVGSGFSPSSAVTVSVGPVGCSLLSVDEKELKCQILNGSAGHAPVAVSMADVGLAQNVGGEEFYFVYQSQISHIWPDSGSIAGGTLLTLSGFGFNENSKVLVGNETCNVIEGDLNRITCRTPKKTEGTVDISVTTNGFQATARDAFSYNCLQTPIITDFSPKVRTILGEVNLTIKGYNFGNELTQNMAVYVGGKTCQILHWNFTDIRCLLPKLSPGKHDIYVEVRNWGFASTRDKLNSSIQYVLEVTSMFPQRGSLFGGTEITIRGFGFSTIPAENTVLLGSIPCNVTSSSENVIKCILHSTGNIFRITNNGKDSVHGLGYAWSPPVLNVSVGDTVAWHWQTHPFLRGIGYRIFSVSSPGSVIYDGKGFTSGRQKSTSGSFSYQFTSPGIHYYSSGYVDEAHSIFLQGVINVLPAETRHIPLHLFVGRSEATYAYGGPENLHLGSSVAGCLATEPLCSLNNTRVKNSKRLLFEVSSCFSPSISNITPSTGTVNELITIIGHGFSNLPWANKVTIGSYPCVVEESSEDSITCHIDPQNSMDVGIRETVTLTVYNLGTAINTLSNEFDRRFVLLPNIDLVLPNAGSTTGMTSVTIKGSGFAVSSAGVKVLMGHFPCKVLSVNYTAIECETSPAAQQLVDVDLLIHGVPAQCQGNCTFSYLESITPYITGVFPNSVIGSVKVLIEGEGLGTVLEDIAVFIGNQQFRAIEVNENNITALVTPLPVGHHSVSVVVGSKGLALGNLTVSSPPVASLSPTSGSIGGGTTLVITGNGFYPGNTTVTIGDEPCQIISINPNEVYCRTPAGTTGMVDVKIFVNTIAYPPLLFTYALEDTPFLRGIIPSRGPPGTEIEITGSNFGFEILEISVMINNIQCNVTMANDSVVQCIVGDHAGGTFPVMMHHKTKGSAMSTVVFEYPLNIQNINPSQGSFGGGQTMTVTGTGFNPQNSIILVCGSECAIDRLRSDYTTLLCEIPSNNGTGAEQACEVSVVNGKDLSQSMTPFTYAVSLTPLITAVSPKRGSTAGGTRLTVVGSGFSENMEDVHITIAEAKCDVEYSNKTHIICMTDAHTLSGWAPVCVHIRGVGMAKLDNADFLYVDAWSSNFSWGGKSPPEEGSLVVITKGQTILLDQSTPILKMLLIQGGTLIFDEADIELQAENILITDGGVLQIGTETSPFQHKAVITLHGHLRSPELPVYGAKTLAVREGILDLHGVPVPVTWTRLAHTAKAGERILILQEAVTWKPGDNIVIASTGHRHSQGENEKMTIASVSADGINITLSNPLNYTHLGITVTLPDGTLFEARAEVGILTRNILIRGSDNVEWNNKIPACPDGFDTGEFATQTCLQGKFGEEIGSDQFGGCVMFHAPVPGANMVTGRIEYVEVFHAGQAFRLGRYPIHWHLLGDLQFKSYVRGCAIHQAYNRAVTIHNTHHLLVERNIIYDIKGGAFFIEDGIEHGNILQYNLAVFVQQSTSLLNDDVTPAAFWVTNPNNTIRHNAVAGGTHFGFWYRMNNHPDGPSYDRNICQKRVPLGEFFNNTVHSQGWFGMWIFEEYFPMQTGSCTSTVPAPAIFNSLTTWNCQKGAEWVNGGALQFHNFVMVNNYEAGIETKRILAPYVGGWGETNGAVIKNAKIVGHLDELGMGSAFCTAKGLVLPFSEGLTVSSVHFMNFDRPNCVALGVTSISGVCNDRCGGWSAKFVDVQYSHTPNKAGFRWEHEMVMIDVDGSLTGHKGHTVIPHSSLLDPSHCTQEAEWSIGFPGSVCDASVSFHRLAFNQPSPVSLLEKDVVLSDSFGTSIIPFQKKRLTHMSGWMALIPNANHINWYFKGVDHITNISYTSTFYGFKEEDYVIISHNFTQNPDMFNIIDMRNGSSNPLNWNTSKNGDWHLEANTSTLYYLVSGRNDLHQSQLISGNLDPDVKDVVINFQAYCCILQDCFPVHPPSRKPIPKKRPATYNLWSNDSFWQSSRENNYTVPHPGANVIIPEGTWIVADIDMPSMERLIIWGVLELEDKYNVGAAESSYREVVLNATYISLQGGRLIGGWEDNPFKGDLKIVLRGNHTTQDWALPEGPNQGAKVLGVFGELDLHGIPHSIYKTKLSETAFAGSKVLSLMDAVDWQEGEEIVITTTSYDFHQTETRSIVKILHDHKILILNDSLSYTHFAEKYHVPGTGESYTLAADVGILSRNIKIVGEDYPGWSEDSFGARVLVGSFTENMMTFKGNARISNVEFYHSGQEGFRDSTDPRYAVTFLNLGQIQEHGSSYIRGCAFHHGFSPAIGVFGTDGLDIDDNIIHFTVGEGIRIWGNANRVRGNLIALSVWPGTYQNRKDLSSTLWHAAIEINRGTNTVLQNNVVAGFGRAGYRIDGEPCPGQFNPVEKWFDNEAHGGLYGIYMNQDGLPGCSLIQGFTIWTCWDYGIYFQTTESVHIYNVTLVDNGMAIFPMIYMPAAISHKISSKNVQIKSSLIVGSSPGFNCSDVLTNDDPNIELTAAHRSPRSPSGGRSGICWPTFASAHNMAPRKPHAGIMSYNAISGLLDISGSTFVGFKNVCSGETNVIFITNPLNEDLQHPIHVKNIKLVDTTEQSKIFIHRPDISKVNPSDCVDMVCDAKRKSFLRDIDGSFLGNAGSVIPQAEYEWDGNSQVGIGDYRIPKAMLTFLNGSRIPVTEKAPHKGIIRDSTCKYLPEWQSYQCFGMEYAMMVIESLDPDTETRRLSPVAIMGNGYVDLINGPQDHGWCAGYTCQRRLSLFHSIVALNKSYEVYFTGTSPQNLRLMLLNVDHNKAVLVGIFFSTLQRLDVYVNNLLVCPKTTIWNAQQKHCELNNHLYKDQFLPNLDSTVLGENYFDGTYQMLYLLVKGTIPVEIHTATVIFVSFQLSVATEDDFYTSHNLVKNLALFLKIPSDKIRISKIRGKSLRRKRSMGFIIEIEIGDPPIQFISNGTTGQMQLSELQEIAGSLGQAVILGNISSILGFNISSMSITNPLPSPSDSGWIKVTAQPVERSAFPVHHVAFVSSLLVITQPVAAQPGQPFPQQPSVKATDSDGNCVSVGITALTLRAILKDSNNNQVNGLSGNTTIPFSSCWANYTDLTPLRTGKNYKIEFILDNVVGVESRTFSLLAESVSSSGSSSSSNSKASTVGTYAQIMTVVISCLVGRMWLLEIFMAAVSTLNITLRSY

SEQ ID NO: 3504 - protein, 499 aa, unidentified
MLERPPALAMPMPTEGTPPPLSGTPIPVPAYFRHAEPGFSLKRPRGLSRSLPPPPPAKGSIPISRLFPPRTPGWHQLQPRRVSFRGEASETLQSPGYDPSRPESFFQQSFQRLSRLGHGSYGEVFKVRSKEDGRLYAVKRSMSPFRGPKDRARKLAEVGSHEKVGQHPCCVRLEQAWEEGGILYLQTELCGPSLQQHCEAWGASLPEAQVWGYLRDTLLALAHLHSQGLVHLDVKPANIFLGPRGRCKLGDFGLLVELGTAGAGEVQEGDPRYMAPELLQGSYGTAADVFSLGLTILEVACNMELPHGGEGWQQLRQGYLPPEFTAGLSSELRSVLVMMLEPDPKLRATAEALLALPVLRQPRAWGVLWCMAAEALSRGWALWQALLALLCWLWHGLAHPASWLQPLGPPATPPGSPPCSLLLDSSLSSNWDDDSLGPSLSPEAVLARTVGSTSTPRSRCTPRDALDLSDINSEPPRGSFPSFEPRNLLSLFEDTLDPT

SEQ ID NO: 3505 - protein, 984 aa, unidentified
MASNPERGEILLTELQGDSRSLPFSENVSAVQKLDFSDTMVQQKLDDIKDRIKREIRKELKIKEGAENLRKVTTDKKSLAYVDNILKKSNKKLEELHHKLQELNAHIVVSDPEDITDCPRTPDTPNNDPRCSTSNNRLKALQKQLDIELKVKQGAENMIQMYSNGSSKDRKLHGTAQQLLQDSKTKIEVIRMQILQAVQTNELAFDNAKPVISPLELRMEELRHHFRIEFAVAEGAKNVMKLLGSGKVTDRKALSEAQARFNESSQKLDLLKYSLEQRLNEVPKNHPKSRIIIEELSLVAASPTLSPRQSMISTQNQYSTLSKPAALTGTLEVRLMGCQDILENVPGRSKATSVALPGWSPSETRSSFMSRTSKSKSGSSRNLLKTDDLSNDVCAVLKLDNTVVGQTSWKPISNQSWDQKFTLELDRSRELEISVYWRDWRSLCAVKFLRLEDFLDNQRHGMCLYLEPQGTLFAEVTFFNPVIERRPKLQRQKKIFSKQQGKTFLRAPQMNINIATWGRLVRRAIPTVNHSGTFSPQAPVPTTVPVVDVRIPQLAPPASDSTVTKLDFDLEPEPPPAPPRASSLGEIDESSELRVLDIPGQDSETVFDIQNDRNSILPKSQSEYKPDTPQSGLEYSGIQELEDRRSQQRFQFNLQDFRCCAVLGRGHFGKVLLAEYKNTNEMFAIKALKKGDIVARDEVDSLMCEKRIFETVNSVRHPFLVNLFACFQTKEHVCFVMEYAAGGDLMMHIHTDVFSEPRAVFYAACVVLGLQYLHEHKIVYRDLKLDNLLLDTEGFVKIADFGLCKEGMGYGDRTSTFCGTPEFLAPEVLTETSYTRAVDWWGLGVLIYEMLVGESPFPGDDEEEVFDSIVNDEVRYPRFLSTEAISIMRRLLRRNPERRLGASEKDAEDVKKHPFFRLIDWSALMDKKVKPPFIPTIRGREDVSNFDDEFTSEAPILTPPREPRILSEEEQEMFRDFDYIADWC

SEQ ID NO: 3506 - protein, 412 aa, unidentified
MGLHLRPYRVGLLPDGLLFLLLLLMLLADPALPAGRHPPVVLVPGDLGNQLEAKLDKPTVVHYLCSKKTESYFTIWLNLELLLPVIIDCWIDNIRLVYNKTSRATQFPDGVDVRVPGFGKTFSLEFLDPSKSSVGSYFHTMVESLVGWGYTRGEDVRGAPYDWRRAPNENGPYFLALREMIEEMYQLYGGPVVLVAHSMGNMYTLYFLQRQPQAWKDKYIRAFVSLGAPWGGVAKTLRVLASGDNNRIPVIGPLKIREQQRSAVSTSWLLPYNYTWSPEKVFVQTPTINYTLRDYRKFFQDIGFEDGWLMRQDTEGLVEATMPPGVQLHCLYGTGVPTPDSFYYESFPDRDPKICFGDGDGTVNLKSALQCQAWQSRQEHQVLLQELPGSEHIEMLANATTLAYLKRVLLGP

SEQ ID NO: 3507 - protein, 162 aa, unidentified
MRAPIPEPKPGDLIEIFRPFYRHWAIYVGDGYVVHLAPPSEVAGAGAASVMSALTDKAIVKKELLYDVAGSDKYQVNNKHDDKYSPLPCSKIIQRAEELVGQEVLYKLTSENCEHFVNELRYGVARSDQVRDVIIAASVAGMGLAAMSLIGVMFSRNKRQKQ

SEQ ID NO: 3508 - protein, 168 aa, unidentified
MKKFFTVAILAGSVLSTAHGSLLNLKAMVEAVTGRSAILSFVGYGCYCGLGGRGQPKDEVDWCCHAHDCCYQELFDQGCHPYVDHYDHTIENNTEIVCSDLNKTECDKQTCMCDKNMVLCLMNQTYREEYRGFLNVYCQGPTPNCSIYEPPPEEVTCSHQSPAPPAPP

SEQ ID NO: 3509 - protein, 806 aa, unidentified
MQFFGRLVNTFSGVTNLFSNPFRVKEVAVADYTSSDRVREEGQLILFQNTPNRTWDCVLVNPRNSQSGFRLFQLELEADALVNFHQYSSQLLPFYESSPQVLHTEVLQHLTDLIRNHPSWSVAHLAVELGIRECFHHSRIISCANCAENEEGCTPLHLACRKGDGEILVELVQYCHTQMDVTDYKGETVFHYAVQGDNSQVLQLLGRNAVAGLNQVNNQGLTPLHLACQLGKQEMVRVLLLCNARCNIMGPNGYPIHSAMKFSQKGCAEMIISMDSSQIHSKDPRYGASPLHWAKNAEMARMLLKRGCNVNSTSSAGNTALHVAVMRNRFDCAIVLLTHGANADARGEHGNTPLHLAMSKDNVEMIKALIVFGAEVDTPNDFGETPTFLASKIGRLVTRKAILTLLRTVGAEYCFPPIHGVPAEQGSAAPHHPFSLERAQPPPISLNNLELQDLMHISRARKPAFILGSMRDEKRTHDHLLCLDGGGVKGLIIIQLLIAIEKASGVATKDLFDWVAGTSTGGILALAILHSKSMAYMRGMYFRMKDEVFRGSRPYESGPLEEFLKREFGEHTKMTDVRKPKVMLTGTLSDRQPAELHLFRNYDAPETVREPRFNQNVNLRPPAQPSDQLVWRAARSSGAAPTYFRPNGRFLDGGLLANNPTLDAMTEIHEYNQDLIRKGQANKVKKLSIVVSLGTGRSPQVPVTCVDVFRPSNPWELAKTVFGAKELGKMVVDCCTDPDGRAVDRARAWCEMVGIQYFRLNPQLGTDIMLDEVSDTVLVNALWETEVYIYEHREEFQKLIQLLLSP

SEQ ID NO: 3510 - protein, 1463 aa, unidentified
MLLSPSLLLLLLLGAPRGCAEGVAAALTPERLLEWQDKGIFVIQSESLKKCIQAGKSVLTLENCKQANKHMLWKWVSNHGLFNIGGSGCLGLNFSAPEQPLSLYECDSTLVSLRWRCNRKMITGPLQYSVQVAHDNTVVASRKYIHKWISYGSGGGDICEYLHKDLHTIKGNTHGMPCMFPFQYNHQWHHECTREGREDDLLWCATTSRYERDEKWGFCPDPTSAEVGCDTIWEKDLNSHICYQFNLLSSLSWSEAHSSCQMQGGTLLSITDETEENFIREHMSSKTVEVWMGLNQLDEHAGWQWSDGTPLNYLNWSPEVNFEPFVEDHCGTFSSFMPSAWRSRDCESTLPYICKKYLNHIDHEIVEKDAWKYYATHCEPGWNPYNRNCYKLQKEEKTWHEALRSCQADNSALIDITSLAEVEFLVTLLGDENASETWIGLSSNKIPVSFEWSNDSSVIFTNWHTLEPHIFPNRSQLCVSAEQSEGHWKVKNCEERLFYICKKAGHVLSDAESGCQEGWERHGGFCYKIDTVLRSFDQASSGYYCPPALVTITNRFEQAFITSLISSVVKMKDSYFWIALQDQNDTGEYTWKPVGQKPEPVQYTHWNTHQPRYSGGCVAMRGRHPLGRWEVKHCRHFKAMSLCKQPVENQEKAEYEERWPFHPCYLDWESEPGLASCFKVFHSEKVLMKRTWREAEAFCEEFGAHLASFAHIEEENFVNELLHSKFNWTEERQFWIGFNKRNPLNAGSWEWSDRTPVVSSFLDNTYFGEDARNCAVYKANKTLLPLHCGSKREWICKIPRDVKPKIPFWYQYDVPWLFYQDAEYLFHTFASEWLNFEFVCSWLHSDLLTIHSAHEQEFIHSKIKALSKYGASWWIGLQEERANDEFRWRDGTPVIYQNWDTGRERTVNNQSQRCGFISSITGLWGSEECSVSMPSICKRKKVWLIEKKKDTPKQHGTCPKGWLYFNYKCLLLNIPKDPSSWKNWTHAQHFCAEEGGTLVAIESEVEQAFITMNLFGQTTSVWIGLQNDDYETWLNGKPVVYSNWSPFDIINIPSHNTTEVQKHIPLCALLSSNPNFHFTGKWYFEDCGKEGYGFVCEKMQDTSGHGVNTSDMYPMPNTLEYGNRTYKIINANMTWYAAIKTCLMHKAQLVSITDQYHQSFLTVVLNRLGYAHWIGLFTTDNGLNFDWSDGTKSSFTFWKDEESSLLGDCVFADSNGRWHSTACESFLQGAICHVPPETRQSEHPELCSETSIPWIKFKSNCYSFSTVLDSMSFEAAHEFCKKEGSNLLTIKDEAENAFLLEELFAFGSSVQMVWLNAQFDGNNETIKWFDGTPTDQSNWGIRKPDTDYFKPHHCVALRIPEGLWQLSPCQEKKGFICKMEADIHTAEALPEKGPSHSIIPLAVVLTLIVIVAICTLSFCIYKHNGGFFRRLAGFRNPYYPATNFSTVYLEENILISDLEKSDQ

SEQ ID NO: 3511 - protein, 335 aa, unidentified
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTHEPKNQSYMVRGCATASMCQHAHLGDAFSMNHIDVSCCTKSGCNHPDLDVQYRSGAAPQPGPAHLSLTITLLMTARLWGGTLLWT

SEQ ID NO: 3512 - protein, 1458 aa, unidentified
MGLRPGIFLLELLLLLGQGTPQIHTSPRKSTLEGQLWPETLKNSPFPCNPNKLGVNMPSKSVHSLKPSDIKFVAAIGNLEIPPDPGTGDLEKQDWTERPQQVCMGVMTVLSDIIRYFSPSVPMPVCHTGKRVIPHDGAEDLWIQAQELVRNMKENLQLDFQFDWKLINVFFSNASQCYLCPSAQQNGLAAGGVDELMGVLDYLQQEVPRAFVNLVDLSEVAEVSRQYHGTWLSPAPEPCNCSEETTRLAKVVMQWSYQEAWNSLLASSRYSEQESFTVVFQPFFYETTPSLHSEDPRLQDSTTLAWHLWNRMMEPAGEKDEPLSVKHGRPMKCPSQESPYLFSYRNSNYLTRLQKPQDKLEVREGAEIRCPDKDPSDTVPTSVHRLKPADINVIGALGDSLTAGNGAGSTPGNVLDVLTQYRGLSWSVGGDENIGTVTTLANILREFNPSLKGFSVGTGKETSPNAFLNQAVAGGRAEDLPVQARRLVDLMKNDTRIHFQEDWKIITLFIGGNDLCDFCNDLVHYSPQNFTDNIGKALDILHAEVPRAFVNLVTVLEIVNLRELYQEKKVYCPRMILRSLCPCVLKFDDNSTELATLIEFNKKFQEKTHQLIESGRYDTREDFTVVVQPFFENVDMPKTSEGLPDNSFFAPDCFHFSSKSHSRAASALWNNMLEPVGQKTTRHKFENKINITCPNQVQPFLRTYKNSMQGHGTWLPCRDRAPSALHPTSVHALRPADIQVVAALGDSLTAGNGIGSKPDDLPDVTTQYRGLSYSAGGDGSLENVTTLPNILREFNRNLTGYAVGTGDANDTNAFLNQAVPGAKAEDLMSQVQTLMQKMKDDHRVNFHEDWKVITVLIGGSDLCDYCTDSNLYSAANFVHHLRNALDVLHREVPRVLVNLVDFLNPTIMRQVFLGNPDKCPVQQASVLCNCVLTLRENSQELARLEAFSRAYRSSMRELVGSGRYDTQEDFSVVLQPFFQNIQLPVLADGLPDTSFFAPDCIHPNQKFHSQLARALWTNMLEPLGSKTETLDLRAEMPITCPTQNEPFLRTPRNSNYTYPIKPAIENWGSDFLCTEWKASNSVPTSVHQLRPADIKVVAALGDSLTTAVGARPNNSSDLPTSWRGLSWSIGGDGNLETHTTLPNILKKFNPYLLGFSTSTWEGTAGLNVAAEGARARDMPAQAWDLVERMKNSPDINLEKDWKLVTLFIGVNDLCHYCENPEAHLATEYVQHIQQALDILSEELPRAFVNVVEVMELASLYQGQGGKCAMLAAQNNCTCLRHSQSSLEKQELKKVNWNLQHGISSFSYWHQYTQREDFAVVVQPFFQNTLTPLNERGDTDLTFFSEDCFHFSDRGHAEMAIALWNNMLEPVGRKTTSNNFTHSRAKLKCPSPESPYLYTLRNSRLLPDQAEEAPEVLYWAVPVAAGVGLVVGIIGTVVWRCRRGGRREDPPMSLRTVAL

SEQ ID NO: 3513 - protein, 490 aa, unidentified
MKPKLMYQELKVPAEEPANELPMNEIEAWKAAEKKARWVLLVLILAVVGFGALMTQLFLWEYGDLHLFGPNQRPAPCYDPCEAVLVESIPEGLDFPNASTGNPSTSQAWLGLLAGAHSSLDIASFYWTLTNNDTHTQEPSAQQGEEVLRQLQTLAPKGVNVRIAVSKPSGPQPQADLQALLQSGAQVRMVDMQKLTHGVLHTKFWVVDQTHFYLGSANMDWRSLTQVKELGVVMYNCSCLARDLTKIFEAYWFLGQAGSSIPSTWPRFYDTRYNQETPMEICLNGTPALAYLASAPPPLCPSGRTPDLKALLNVVDNARSFIYVAVMNYLPTLEFSHPHRFWPAIDDGLRRATYERGVKVRLLISCWGHSEPSMRAFLLSLAALRDNHTHSDIQVKLFVVPADEAQARIPYARVNHNKYMVTERATYIGTSNWSGNYFTETAGTSLLVTQNGRGGLRSQLEAIFLRDWDSPYSHDLDTSADSVGNACRLL

SEQ ID NO: 3514 - protein, 506 aa, unidentified
MLKPLWKAAVAPTWPCSMPPRRPWDREAGTLQVLGALAVLWLGSVALICLLWQVPRPPTWGQVQPKDVPRSWEHGSSPAWEPLEAEARQQRDSCQLVLVESIPQDLPSAAGSPSAQPLGQAWLQLLDTAQESVHVASYYWSLTGPDIGVNDSSSQLGEALLQKLQQLLGRNISLAVATSSPTLARTSTDLQVLAARGAHVRQVPMGRLTRGVLHSKFWVVDGRHIYMGSANMDWRSLTQVKELGAVIYNCSHLAQDLEKTFQTYWVLGVPKAVLPKTWPQNFSSHFNRFQPFHGLFDGVPTTAYFSASPPALCPQGRTRDLEALLAVMGSAQEFIYASVMEYFPTTRFSHPPRYWPVLDNALRAAAFGKGVRVRLLVGCGLNTDPTMFPYLRSLQALSNPAANVSVDVKVFIVPVGNHSNIPFSRVNHSKFMVTEKAAYIGTSNWSEDYFSSTAGVGLVVTQSPGAQPAGATVQEQLRQLFERDWSSRYAVGLDGQAPGQDCVWQG

SEQ ID NO: 3515 - protein, 536 aa, unidentified
MEIRQHEWLSASPHEGFEQMRLKSRPKEPSPSLTRVGANFYSSVKQQDYSASVWLRRKDKLEHSQQKCIVIFALVCCFAILVALIFSAVDIMGEDEDGLSEKNCQNKCRIALVENIPEGLNYSENAPFHLSLFQGWMNLLNMAKKSVDIVSSHWDLNHTHPSACQGQRLFEKLLQLTSQNIEIKLVSDVTADSKVLEALKLKGAEVTYMNMTAYNKGRLQSSFWIVDKQHVYIGSAGLDWQSLGQMKELGVIFYNCSCLVLDLQRIFALYSSLKFKSRVPQTWSKRLYGVYDNEKKLQLQLNETKSQAFVSNSPKLFCPKNRSFDIDAIYSVIDDAKQYVYIAVMDYLPISSTSTKRTYWPDLDAKIREALVLRSVRVRLLLSFWKETDPLTFNFISSLKAICTEIANCSLKVKFFDLERENACATKEQKNHTFPRLNRNKYMVTDGAAYIGNFDWVGNDFTQNAGTGLVINQADVRNNRSIIKQLKDVFERDWYSPYAKTLQPTKQPNCSSLFKLKPLSNKTATDDTGGKDPRNV

SEQ ID NO: 3516 - protein, 252 aa, unidentified
MGRLSWQVAAAAAVGLALTLEALPWVLRWLRSRRRRPRREALFFPSQVTCTEALLRAPGAELAELPEGCPCGLPHGESALSRLLRALLAARASLDLCLFAFSSPQLGRAVQLLHQRGVRVRVVTDCDYMALNGSQIGLLRKAGIQVRHDQDPGYMHHKFAIVDKRVLITGSLNWTTQAIQNNRENVLITEDDEYVRLFLEEFERIWEQFNPTKYTFFPPKKSHGSCAPPVSRAGGRLLSWHRTCGTSSESQT

SEQ ID NO: 3517 - protein, 207 aa, unidentified
MAVFHDMLLQPLGMFLCLSLQLSSATFIRYSSTCFTFDEYYTITLDIKASSHIYESNAVYSVFVPVNDSVYAVVMKTLDENSDSAGLWQRADKNCYSNSTYYVKDQYMTVLEAQWQAPEPENITEVEIQAFTVQIRALPILSTLKLREKLSTLALAAKIPQSSAFKPFFMITPKSIRLEGLANQVFSSPITEAIYILLAFLTSTLLF

SEQ ID NO: 3518 - protein, 522 aa, unidentified
MAVNKGLTLLDGDLPEQENVLQRVLQLPVVSGTCECFQKTYTSTKEAHPLVASVCNAYEKGVQSASSLAAWSMEPVVRRLSTQFTAANELACRGLDHLEEKIPALQYPPEKIASELKDTISTRLRSARNSISVPIASTSDKVLGAALAGCELAWGVARDTAEFAANTRAGRLASGGADLALGSIEKVVEYLLPPDKEESAPAPGHQQAQKSPKAKPSLLSRVGALTNTLSRYTVQTMARALEQGHTVAMWIPGVVPLSSLAQWGASVAMQAVSRRRSEVRVPWLHSLAAAQEEDHEDQTDTEGEDTEEEEELETEENKFSEVAALPGPRGLLGGVAHTLQKTLQTTISAVTWAPAAVLGMAGRVLHLTPAPAVSSTKGRAMSLSDALKGVTDNVVDTVVHYVPLPRLSLMEPESEFRDIDNPPAEVERREAERRASGAPSAGPEPAPRLAQPRRSLRSAQSPGAPPGPGLEDEVATPAAPRPGFPAVPREKPKRRVSDSFFRPSVMEPILGRTHYSQLRKKS

SEQ ID NO: 3519 - protein, 182 aa, unidentified
MAEFPSKVSTRTSSPAQGAEASVSALRPDLGFVRSRLGALMLLQLVLGLLVWALIADTPYHLYPAYGWVMFVAVFLWLVTIVLFNLYLFQLHMKLYMVPWPLVLMIFNISATVLYITAFIACSAAVDLTSLRGTRPYNQRAAASFFACLVMIAYGVSAFFSYQAWRGVGSNAATSQMAGGYA

SEQ ID NO: 3520 - protein, 52 aa, unidentified
MEKVQYLTRSAIRRASTIEMPQQARQKLQNLFINFCLILICLLLICIIVMLL

SEQ ID NO: 3521 - protein, 737 aa, unidentified
MGGCTVKPQLLLLALVLHPWNPCLGADSEKPSSIPTDKLLVITVATKESDGFHRFMQSAKYFNYTVKVLGQGEEWRGGDGINSIGGGQKVRLMKEVMEHYADQDDLVVMFTECFDVIFAGGPEEVLKKFQKANHKVVFAADGILWPDKRLADKYPVVHIGKRYLNSGGFIGYAPYVNRIVQQWNLQDNDDDQLFYTKVYIDPLKREAINITLDHKCKIFQTLNGAVDEVVLKFENGKARAKNTFYETLPVAINGNGPTKILLNYFGNYVPNSWTQDNGCTLCEFDTVDLSAVDVHPNVSIGVFIEQPTPFLPRFLDILLTLDYPKEALKLFIHNKEVYHEKDIKVFFDKAKHEIKTIKIVGPEENLSQAEARNMGMDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALCRNAREMGVFMYISNRHEFGRLLSTANYNTSHYNNDLWQIFENPVDWKEKYINRDYSKIFTENIVEQPCPDVFWFPIFSEKACDELVEEMEHYGKWSGGKHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 3522 - protein, 277 aa, unidentified
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGKGLSATVTGGQKGRGSRGQHQAHSLERVCHCLGKWLGHPDKFVGITYALTVVWLLVFACSAVPVYIYFNTWTTCQSIAFPSKTSASIGSLCADARMYGVLPWNAFPGKVCGSNLLSICKTAEFQMTFHLFIAAFVGAAATLVSLLTFMIAATYNFAVLKLMGRGTKF

SEQ ID NO: 3523 - protein, 152 aa, unidentified
MADSERLSAPGCWAACTNFSRTRKGILLFAEIILCLVILICFSASTPGYSSLSVIEMILAAIFFVVYMCDLHTKIPFINWPWSDFFRTLIAAILYLITSIVVLVERGNHSKIVAGVLGLIATCLFGYDAYVTFPVRQPRHTAAPTDPADGPV

SEQ ID NO: 3524 - protein, 284 aa, unidentified
MFDKTRLPYVALDVLCVLLAGLPFAILTSRHTPFQRGVFCNDESIKYPYKEDTIPYALLGGIIIPFSIIVIILGETLSVYCNLLHSNSFIRNNYIATIYKAIGTFLFGAAASQSLTDIAKYSIGRLRPHFLDVCDPDWSKINCSDGYIEYYICRGNAERVKEGRLSFYSGHSSFSMYCMLFVALYLQARMKGDWARLLRPTLQFGLVAVSIYVGLSRVSDYKHHWSDVLTGLIQGALVAILVAVYVSDFFKERTSFKERKEEDSHTTLHETPTTGNHYPSNHQP

SEQ ID NO: 3525 - protein, 288 aa, unidentified
MQRRWVFVLLDVLCLLVASLPFAILTLVNAPYKRGFYCGDDSIRYPYRPDTITHGLMAGVTITATVILVSAGEAYLVYTDRLYSRSDFNNYVAAVYKVLGTFLFGAAVSQSLTDLAKYMIGRLRPNFLAVCDPDWSRVNCSVYVQLEKVCRGNPADVTEARLSFYSGHSSFGMYCMVFLALYVQARLCWKWARLLRPTVQFFLVAFALYVGYTRVSDYKHHWSDVLVGLLQGALVAALTVCYISDFFKARPPQHCLKEEELERKPSLSLTLTLGEADHNHYGYPHSSS

SEQ ID NO: 3526 - protein, 311 aa, unidentified
MQNYKYDKAIVPESKNGGSPALNNNPRRSGSKRVLLICLDLFCLFMAGLPFLIIETSTIKPYHRGFYCNDESIKYPLKTGETINDAVLCAVGIVIAILAIITGEFYRIYYLKKSRSTIQNPYVAALYKQVGCFLFGCAISQSFTDIAKVSIGRLRPHFLSVCNPDFSQINCSEGYIQNYRCRGDDSKVQEARKSFFSGHASFSMYTMLYLVLYLQARFTWRGARLLRPLLQFTLIMMAFYTGLSRVSDHKHHPSDVLAGFAQGALVACCIVFFVSDLFKTKTTLSLPAPAIRKEILSPVDIIDRNNHHNMM

SEQ ID NO: 3527 - protein, 271 aa, unidentified
MRELAIEIGVRALLFGVFVFTEFLDPFQRVIQPEEIWLYKNPLVQSDNIPTRLMFAISFLTPLAVICVVKIIRRTDKTEIKEAFLAVSLALALNGVCTNTIKLIVGRPRPDFFYRCFPDGVMNSEMHCTGDPDLVSEGRKSFPSIHSSFAFSGLGFTTFYLAGKLHCFTESGRGKSWRLCAAILPLYCAMMIALSRMCDYKHHWQDSFVGGVIGLIFAYICYRQHYPPLANTACHKPYVSLRVPASLKKEERPTADSAPSLPLEGITEGPV

SEQ ID NO: 3528 - protein, 264 aa, unidentified [sequence omitted]

SEQ ID NO: 3529 - protein, 295 aa, unidentified
MPSPRRSMEGRPLGVSASSSSSSPGSPAHGGGGGGSRFEFQSLLSSRATAVDPTCARLRASESPVHRRGSFPLAAAGPSQSPAPPLPEEDRMDLNPSFLGIALRSLLAIDLWLSKKLGVCAGESSSWGSVRPLMKLLEISGHGIPWLLGTLYCLCRSDSWAGREVLMNLLFALLLDLLLVALIKGLVRRRRPAHNQMDMFVTLSVDKYSFPSGHATRAALMSRFILNHLVLAIPLRVLVVLWAFVLGLSRVMLGRHNVTDVAFGFFLGYMQYSIVDYCWLSPHNAPVLFLLWSQR

SEQ ID NO: 3530 - protein, 271 aa, unidentified
MPASQSRARARDRNNVLNRAEFLSLNQPPKGGPEPRSSGRKASGPSAQPPPAGDGARERRQSQQLPEEDCMQLNPSFKGIAFNSLLAIDICMSKRLGVCAGRAASWASARSMVKLIGITGHGIPWIGGTILCLVKSSTLAGQEVLMNLLLALLLDIMTVAGVQKLIKRRGPYETSPSLLDYLTMDIYAFPAGHASRAAMVSKFFLSHLVLAVPLRVLLVLWALCVGLSRVMIGRHHVTDVLSGFVIGYLQFRLVELVWMPSSTCQMLISAW

SEQ ID NO: 3531 - protein, 329 aa, unidentified
MSGVVPTAPEQPAGEMENQTKPPDPRPDAPPEYNSHFLPGPPGTAVPPPTGYPGGLPMGYYSPQQPSTFPLYQPVGGIHPVRYQPGKYPMPNQSVPITWMPGPTPMANCPPGLEYLVQLDNIHVLQHFEPLEMMTCFETNNRYDIKNNSDQMVYIVTEDTDDFTRNAYRTLRPFVLRVTDCMGREIMTMQRPFRCTCCCFCCPSARQELEVQCPPGVTIGFVAEHWNLCRAVYSIQNEKKENVMRVRGPCSTYGCGSDSVFEVKSLDGISNIGSIIRKWNGLLSAMADADHFDIHFPLDLDVKMKAMIFGACFLIDFMYFERSPPQRSR

SEQ ID NO: 3532 - protein, 271 aa, unidentified
MASKDAQNQRRGLPGFLPGAPDPDQSLPASSNPGNQAWQLSLPLPSSFLPTVSLPPGLEYLSQLDLIIIHQQVELLGMILGTETSNKYEIKNSLGQRIYFAVEESICFNRTFCSTLRSCTLRITDNSGREVITVNRPLRCNSCWCPCYLQELEIQAPPGTIVGYVTQKWDPFLPKFTIQNANKEDILKIVGPCVTCGCFGDVDFEVKTINEKLTIGKISKYWSGFVNDVFTNADNFGIHVPADLDVTVKAAMIGACFLFDFMFFEHSLAGL

SEQ ID NO: 3533 - protein, 442 aa, unidentified
MGLAMEHGGSYARAGGSSRGCWYYLRYFFLFVSLIQFLIILGLVLFMVYGNVHVSTESNLQATERRAEGLYSQLLGLTASQSNLTKELNFTTRAKDAIMQMWLNARRDLDRINASFRQCQGDRVIYTNNQRYMAAIILSEKQCRDQFKDMNKSCDALLFMLNQKVKTLEVEIAKEKTICTKDKESVLLNKRVAEEQLVECVKTRELQHQERQLAKEQLQKVQALCLPLDKDKFEMDLRNLWRDSIIPRSLDNLGYNLYHPLGSELASIRRACDHMPSLMSSKVEELARSLRADIERVARENSDLQRQKLEAQQGLRASQEAKQKVEKEAQAREAKLQAECSRQTQLALEEKAVLRKERDNLAKELEEKKREAEQLRMELAIRNSALDTCIKTKSQPMMPVSRPMGPVPNPQPIDPASLEEFKRKILESQRPPAGIPVAPSSG

SEQ ID NO: 3534 - protein, 500 aa, unidentified
MRGELWLLVLVLREAARALSPQPGAGHDEGPGSGWAAKGTVRGWNRRARESPGHVSEPDRTQLSQDLGGGTLAMDTLPDNRTRVVEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDNGTVFVVQWDHVYLQGWEDKGSFTFQAALHHDGRIVFAYKEIPMSVPEISSSQHPVKTGLSDAFMILNPSPDVPESRRRSIFEYHRIELDPSKVTSMSAVEFTPLPTCLQHRSCDACMSSDLTFNCSWCHVLQRCSSGFDRYRQEWMDYGCAQEAEGRMCEDFQDEDHDSASPDTSFSPYDGDLTTTSSSLFIDSLTTEDDTKLNPYAGGDGLQNNLSPKTKGTPVHLGTIVGIVLAVLLVAAIILAGIYINGHPTSNAALFFIERRPHHWPAMKFRSHPDHSTYAEVEPSGHEKEGFMEAEQC

SEQ ID NO: 3535 - protein, 529 aa, unidentified
MARFPKADLAAAGVMLLCHFFTDQFQFADGKPGDQILDWQYGVTQAFPHTEEEVEVDSHAYSHRWKRNLDFLKAVDTNRASVGQDSPEPRSFTDLLLDDGQDNNTQIEEDTDHNYYISRIYGPSDSASRDLWVNIDQMEKDKVKIHGILSNTHRQAARVNLSFDFPFYGHFLREITVATGGFIYTGEVVHRMLTATQYIAPLMANFDPSVSRNSTVRYFDNGTALVVQWDHVHLQDNYNLGSFTFQATLLMDGRIIFGYKEIPVLVTQISSTNHPVKVGLSDAFVVVHRIQQIPNVRRRTIYEYHRVELQMSKITNISAVEMTPLPTCLQFNRCGPCVSSQIGFNCSWCSKLQRCSSGFDRHRQDWVDSGCPEESKEKMCENTEPVETSSRTTTTVGATTTQFRVLTTTRRAVTSQFPTSLPTEDDTKIALHLKDNGASTDDSAAEKKGGTLHAGLIIGILILVLIVATAILVTVYMYHHPTSAASIFFIERRPSRWPAMKFRRGSGHPAYAEVEPVGEKEGFIVSEQC

SEQ ID NO: 3536 - protein, 1896 aa, unidentified
MPLPPRSLQVLLLLLLLLLLLPGMWAEAGLPRAGGGSQPPFRTFSASDWGLTHLVVHEQTGEVYVGAVNRIYKLSGNLTLLRAHVTGPVEDNEKCYPPPSVQSCPHGLGSTDNVNKLLLLDYAANRLLACGSASQGICQFLRLDDLFKLGEPHHRKEHYLSSVQEAGSMAGVLIAGPPGQGQAKLFVGTPIDGKSEYFPTLSSRRLMANEEDADMFGFVYQDEFVSSQLKIPSDTLSKFPAFDIYYVYSFRSEQFVYYLTLQLDTQLTSPDAAGEHFFTSKIVRLCVDDPKFYSYVEFPIGCEQAGVEYRLVQDAYLSRPGRALAHQLGLAEDEDVLFTVFAQGQKNRVKPPKESALCLFTLRAIKEKIKERIQSCYRGEGKLSLPWLLNKELGCINSPLQIDDDFCGQDFNQPLGGTVTIEGTPLFVDKDDGLTAVAAYDYRGRTVVFAGTRSGRIRKILVDLSNPGGRPALAYESVVAQEGSPILRDLVLSPNHQYLYAMTEKQVTRVPVESCVQYTSCELCLGSRDPHCGWCVLHSICSRRDACERADEPQRFAADLLQCVQLTVQPRNVSVTMSQVPLVLQAWNVPDLSAGVNCSFEDFTESESVLEDGRIHCRSPSAREVAPITRGQGDQRVVKLYLKSKETGKKFASVDFVFYNCSVHQSCLSCVNGSFPCHWCKYRHVCTHNVADCAFLEGRVNVSEDCPQILPSTQIYVPVGVVKPITLAARNLPQPQSGQRGYECLFHIPGSPARVTALRFNSSSLQCQNSSYSYEGNDVSDLPVNLSVVWNGNFVIDNPQNIQAHLYKCPALRESCGLCLKADPRFECGWCVAERRCSLRHHCAADTPASWMHARHGSSRCTDPKILKLSPETGPRQGGTRLTITGENLGLRFEDVRLGVRVGKVLCSPVESEYISAEQIVCEIGDASSVRAHDALVEVCVRDCSPHYRALSPKRFTFVTPTFYRVSPSRGPLSGGTWIGIEGSHLNAGSDVAVSVGGRPCSFSWRNSREIRCLTPPGQSPGSAPIIININRAQLTNPEVKYNYTEDPTILRIDPEWSINSGGTLLTVTGTNLATVREPRIRAKYGGIERENGCLVYNDTTMVCRAPSVANPVRSPPELGERPDELGFVMDNVRSLLVLNSTSFLYYPDPVLEPLSPTGLLELKPSSPLILKGRNLLPPAPGNSRLNYTVLIGSTPCTLTVSETQLLCEAPNLTGQHKVTVRAGGFEFSPGTLQVYSDSLLTLPAIVGIGGGGGLLLLVIVAVLIAYKRKSRDADRTLKRLQLQMDNLESRVALECKEAFAELQTDIHELTNDLDGAGIPFLDYRTYAMRVLFPGIEDHPVLKEMEVQANVEKSLTLFGQLLTKKHFLLTFIRTLEAQRSFSMRDRGNVASLIMTALQGEMEYATGVLKQLLSDLIEKNLESKNHPKLLLRRTESVAEKMLTNWFTFLLYKFLKECAGEPLFMLYCAIKQQMEKGPIDAITGEARYSLSEDKLIRQQIDYKTLTLNCVNPENENAPEVPVKGLDCDTVTQAKEKLLDAAYKGVPYSQRPKAADMDLEWRQGRMARIILQDEDVTTKIDNDWKRLNTLAHYQVTDGSSVALVPKQTSAYNISNSSTFTKSLSRYESMLRTASSPDSLRSRTPMITPDLESGTKLWHLVKNHDHLDQREGDRGSKMVSEIYLTRLLATKGTLQKFVDDLFETIFSTAHRGSALPLAIKYMFDFLDEQADKHQIHDADVRHTWKSNCLPLRFWVNVIKNPQFVFDIHKNSITDACLSVVAQTFMDSCSTSEHKLGKDSPSNKLLYAKDIPNYKSWVERYYADIAKMPAISDQDMSAYLAEQSRLHLSQFNSMSALHEIYSYITKYKDEILAALEKDEQARRQRLRSKLEQVVDTMALSS

SEQ ID NO: 3537 - protein, 1894 aa, unidentified
MEQRRPWPRALEVDSRSVVLLSVVWVLLAPPAAGMPQFSTFHSENRDWTFNHLTVHQGTGAVYVGAINRVYKLTGNLTIQVAHKTGPEEDNKSCYPPLIVQPCSEVLTLTNNVNKLLIIDYSENRLLACGSLYQGVCKLLRLDDLFILVEPSHKKEHYLSSVNKTGTMYGVIVRSEGEDGKLFIGTAVDGKQDYFPTLSSRKLPRDPESSAMLDYELHSDFVSSLIKIPSDTLALVSHFDIFYIYGFASGGFVYFLTVQPETPEGVAINSAGDLFYTSRIVRLCKDDPKFHSYVSLPFGCTRAGVEYRLLQAAYLAKPGDSLAQAFNITSQDDVLFAIFSKGQKQYHHPPDDSALCAFPIRAINLQIKERLQSCYQGEGNLELNWLLGKDVQCTKAPVPIDDNFCGLDINQPLGGSTPVEGLTLYTTSRDRMTSVASYVYNGYSVVFVGTKSGKLKKIRADGPPHGGVQYEMVSVLKDGSPILRDMAFSIDQRYLYVMSERQVTRVPVESCEQYTTCGECLSSGDPHCGWCALHNMCSRRDKCQQAWEPNRFAASISQCVSLAVHPSSISVSEHSRLLSLVVSDAPDLSAGIACAFGNLTEVEGQVSGSQVICISPGPKDVPVIPLDQDWFGLELQLRSKETGKIFVSTEFKFYNCSAHQLCLSCVNSAFRCHWCKYRNLCTHDPTTCSFQEGRINISEDCPQLVPTEEILIPVGEVKPITLKARNLPQPQSGQRGYECVLNIQGAIHRVPALRFNSSSVQCQNSSYQYDGMDISNLAVDFAVVWNGNFIIDNPQDLKVHLYKCAAQRESCGLCLKADRKFECGWCSGERRCTLHQHCTSPSSPWLDWSSHNVKCSNPQITEILTVSGPPEGGTRVTIHGVNLGLDFSEIAHHVQVAGVPCTPLPGEYIIAEQIVCEMGHALVGTTSGPVRLCIGECKPEFMTKSHQQYTFVNPSVLSLNPIRGPESGGTMVTITGHYLGAGSSVAVYLGNQTCEFYGRSMSEIVCVSPPSSNGLGPVPVSVSVDRAHVDSNLQFEYIDDPRVQRIEPEWSIASGHTPLTITGFNLDVIQEPRIRVKFNGKESVNVCKVVNTTTLTCLAPSLTTDYRPGLDTVERPDEFGFVFNNVQSLLIYNDTKFIYYPNPTFELLSPTGVLDQKPGSPIILKGKNLCPPASGGAKLNYTVLIGETPCAVTVSETQLLCEPPNLTGQHKVMVHVGGMVFSPGSVSVISDSLLTLPAIVSIAAGGSLLLIIVIIVLIAYKRKSRENDLTLKRLQMQMDNLESRVALECKEAFAELQTDINELTSDLDRSGIPYLDYRTYAMRVLFPGIEDHPVLRELEVQGNGQQHVEKALKLFAQLINNKVFLLTFIRTLELQRSFSMRDRGNVASLIMTGLQGRLEYATDVLKQLLSDLIDKNLENKNHPKLLLRRTESVAEKMLTNWFAFLLHKFLKECAGEPLFMLYCAIKQQMEKGPIDAITGEARYSLSEDKLIRQQIEYKTLILNCVNPDNENSPEIPVKVLNCDTITQVKEKILDAVYKNVPYSQRPRAVDMDLEWRQGRIARVVLQDEDITTKIEGDWKRLNTLMHYQVSDRSVVALVPKQTSSYNIPASASISRTSISRYDSSFRYTGSPDSLRSRAPMITPDLESGVKVWHLVKNHDHGDQKEGDRGSKMVSEIYLTRLLATKGTLQKFVDDLFETLFSTVHRGSALPLAIKYMFDFLDEQADRHSIHDTDVRHTWKSNCLPLRFWVNVIKNPQFVFDIHKGSITDACLSVVAQTFMDSCSTSEHRLGKDSPSNKLLYAKDIPSYKSWVERYYADIAKLPAISDQDMNAYLAEQSRLHAVEFNMLSALNEIYSYVSKYSEELIGALEQDEQARRQRLAYKVEQLINAMSIES

SEQ ID NO: 3538 - protein, 1871 aa, unidentified
MPSVCLLLLLFLAVGGALGNRPFRAFVVTDTTLTHLAVHRVTGEVFVGAVNRVFKLAPNLTELRAHVTGPVEDNARCYPPPSMRVCAHRLAPVDNINKLLLIDYAARRLVACGSIWQGICQFLRLDDLFKLGEPHHRKEHYLSGAQEPDSMAGVIVEQGQGPSKLFVGTAVDGKSEYFPTLSSRKLISDEDSADMFSLVYQDEFVSSQIKIPSDTLSLYPAFDIYYIYGFVSASFVYFLTLQLDTQQTLLDTAGEKFFTSKIVRMCAGDSEFYSYVEFPIGCSWRGVEYRLVQSAHLAKPGLLLAQALGVPADEDVLFTIFSQGQKNRASPPRQTILCLFTLSNINAHIRRRIQSCYRGEGTLALPWLLNKELPCINTPMQINGNFCGLVLNQPLGGLHVIEGLPLLADSTDGMASVAAYTYRQHSVVFIGTRSGSLKKVRVDGFQDAHLYETVPVVDGSPILRDLLFSPDHRHIYLLSEKQVSQLPVETCEQYQSCAACLGSGDPHCGWCVLRHRCCREGACLGASAPHGFAEELSKCVQVRVRPNNVSVTSPGVQLTVTLHNVPDLSAGVSCAFEAAAENEAVLLPSGELLCPSPSLQELRALTRGHGATRTVRLQLLSKETGVRFAGADFVFYNCSVLQSCMSCVGSPYPCHWCKYRHTCTSRPHECSFQEGRVHSPEGCPEILPSGDLLIPVGVMQPLTLRAKNLPQPQSGQKNYECVVRVQGRQQRVPAVRFNSSSVQCQNASYSYEGDEHGDTELDFSVVWDGDFPIDKPPSFRALLYKCWAQRPSCGLCLKADPRFNCGWCISEHRCQLRTHCPAPKTNWMHLSQKGTRCSHPRITQIHPLVGPKEGGTRVTIVGDNLGLLSREVGLRVAGVRCNSIPAEYISAERIVCEMEESLVPSPPPGPVELCVGDCSADFRTQSEQVYSFVTPTFDQVSPSRGPASGGTRLTISGSSLDAGSRVTVTVRDSECQFVRRDAKAIVCISPLSTLGPSQAPITLAIDRANISSPGLIYTYTQDPTVTRLEPTWSIINGSTAITVSGTHLLTVQEPRVRAKYRGIETTNTCQVINDTAMLCKAPGIFLGRPQPRAQGEHPDEFGFLLDHVQTARSLNRSSFTYYPDPSFEPLGPSGVLDVKPGSHVVLKGKNLIPAAAGSSRLNYTVLIGGQPCSLTVSDTQLLCDSPSQTGRQPVMVLVGGLEFWLGTLHISAERALTLPAMMGLAAGGGLLLLAITAVLVAYKRKTQDADRTLKRLQLQMDNLESRVALECKEAFAELQTDINELTNHMDEVQIPFLDYRTYAVRVLFPGIEAHPVLKELDTPPNVEKALRLFGQLLHSRAFVLTFIHTLEAQSSFSMRDRGTVASLTMVALQSRLDYATGLLKQLLADLIEKNLESKNHPKLLLRRTESVAEKMLTNWFTFLLHKFLKECAGEPLFLLYCAIKQQMEKGPIDAITGEARYSLSEDKLIRQQIDYKTLTLHCVCPENEGSAQVPVKVLNCDSITQAKDKLLDTVYKGIPYSQRPKAEDMDLEWRQGRMTRIILQDEDVTTKIECDWKRLNSLAHYQVTDGSLVALVPKQVSAYNMANSFTFTRSLSRYESLLRTASSPDSLRSRAPMITPDQETGTKLWHLVKNHDHADHREGDRGSKMVSEIYLTRLLATKGTLQKFVDDLFETVFSTAHRGSALPLAIKYMFDFLDEQADQRQISDPDVRHTWKSNCLPLRFWVNVIKNPQFVFDIHKNSITDACLSVVAQTFMDSCSTSEHRLGKDSPSNKLLYAKDIPNYKSWVERYYRDIAKMASISDQDMDAYLVEQSRLHASDFSVLSALNELYFYVTKYRQEILTALDRDASCRKHKLRQKLEQIISLVSSDS

SEQ ID NO: 3539 - protein, 1894 aa, unidentified
MKAMPWNWTCLLSHLLMVGMGSSTLLTRQPAPLSQKQRSFVTFRGEPAEGFNHLVVDERTGHIYLGAVNRIYKLSSDLKVLVTHETGPDEDNPKCYPPRIVQTCNEPLTTTNNVNKMLLIDYKENRLIACGSLYQGICKLLRLEDLFKLGEPYHKKEHYLSGVNESGSVFGVIVSYSNLDDKLFIATAVDGKPEYFPTISSRKLTKNSEADGMFAYVFHDEFVASMIKIPSDTFTIIPDFDIYYVYGFSSGNFVYFLTLQPEMVSPPGSTTKEQVYTSKLVRLCKEDTAFNSYVEVPIGCERSGVEYRLLQAAYLSKAGAVLGRTLGVHPDDDLLFTVFSKGQKRKMKSLDESALCIFILKQINDRIKERLQSCYRGEGTLDLAWLKVKDIPCSSALLTIDDNFCGLDMNAPLGVSDMVRGIPVFTEDRDRMTSVIAYVYKNHSLAFVGTKSGKLKKIRVDGPRGNALQYETVQVVDPGPVLRDMAFSKDHEQLYIMSERQLTRVPVESCGQYQSCGECLGSGDPHCGWCVLHNTCTRKERCERSKEPRRFASEMKQCVRLTVHPNNISVSQYNVLLVLETYNVPELSAGVNCTFEDLSEMDGLVVGNQIQCYSPAAKEVPRIITENGDHHVVQLQLKSKETGMTFASTSFVFYNCSVHNSCLSCVESPYRCHWCKYRHVCTHDPKTCSFQEGRVKLPEDCPQLLRVDKILVPVEVIKPITLKAKNLPQPQSGQRGYECILNIQGSEQRVPALRFNSSSVQCQNTSYSYEGMEINNLPVELTVVWNGHFNIDNPAQNKVHLYKCGAMRESCGLCLKADPDFACGWCQGPGQCTLRQHCPAQESQWLELSGAKSKCTNPRITEIIPVTGPREGGTKVTIRGENLGLEFRDIASHVKVAGVECSPLVDGYIPAEQIVCEMGEAKPSQHAGFVEICVAVCRPEFMARSSQLYYFMTLTLSDLKPSRGPMSGGTQVTITGTNLNAGSNVVVMFGKQPCLFHRRSPSYIVCNTTSSDEVLEMKVSVQVDRAKIHQDLVFQYVEDPTIVRIEPEWSIVSGNTPIAVWGTHLDLIQNPQIRAKHGGKEHINICEVLNATEMTCQAPALALGPDHQSDLTERPEEFGFILDNVQSLLILNKTNFTYYPNPVFEAFGPSGILELKPGTPIILKGKNLIPPVAGGNVKLNYTVLVGEKPCTVTVSDVQLLCESPNLIGRHKVMARVGGMEYSPGMVYIAPDSPLSLPAIVSIAVAGGLLIIFIVAVLIAYKRKSRESDLTLKRLQMQMDNLESRVALECKEAFAELQTDIHELTSDLDGAGIPFLDYRTYTMRVLFPGIEDHPVLRDLEVPGYRQERVEKGLKLFAQLINNKVFLLSFIRTLESQRSFSMRDRGNVASLIMTVLQSKLEYATDVLKQLLADLIDKNLESKNHPKLLLRRTESVAEKMLTNWFTFLLYKFLKECAGEPLFSLFCAIKQQMEKGPIDAITGEARYSLSEDKLIRQQIDYKTLVLSCVSPDNANSPEVPVKILNCDTITQVKEKILDAIFKNVPCSHRPKAADMDLEWRQGSGARMILQDEDITTKIENDWKRLNTLAHYQVPDGSVVALVSKQVTAYNAVNNSTVSRTSASKYENMIRYTGSPDSLRSRTPMITPDLESGVKMWHLVKNHEHGDQKEGDRGSKMVSEIYLTRLLATKGTLQKFVDDLFETIFSTAHRGSALPLAIKYMFDFLDEQADKHGIHDPHVRHTWKSNCLPLRFWVNMIKNPQFVFDIHKNSITDACLSVVAQTFMDSCSTSEHRLGKDSPSNKLLYAKDIPSYKNWVERYYSDIGKMPAISDQDMNAYLAEQSRMHMNEFNTMSALSEIFSYVGKYSEEILGPLDHDDQCGKQKLAYKLEQVITLMSLDS

SEQ ID NO: 3540 - protein, 2135 aa, unidentified
MPALGPALLQALWAGWVLTLQPLPPTAFTPNGTYLQHLARDPTSGTLYLGATNFLFQLSPGLQLEATVSTGPVLDSRDCLPPVMPDECPQAQPTNNPNQLLLVSPGALVVCGSVHQGVCEQRRLGQLEQLLLRPERPGDTQYVAANDPAVSTVGLVAQGLAGEPLLFVGRGYTSRGVGGGIPPITTRALWPPDPQAAFSYEETAKLAVGRLSEYSHHFVSAFARGASAYFLFLRRDLQAQSRAFRAYVSRVCLRDQHYYSYVELPLACEGGRYGLIQAAAVATSREVAHGEVLFAAFSSAAPPTVGRPPSAAAGASGASALCAFPLDEVDRLANRTRDACYTREGRAEDGTEVAYIEYDVNSDCAQLPVDTLDAYPCGSDHTPSPMASRVPLEATPILEWPGIQLTAVAVTMEDGHTIAFLGDSQGQLHRVYLGPGSDGHPYSTQSIQQGSAVSRDLTFDGTFEHLYVMTQSTLLKVPVASCAQHLDCASCLAHRDPYCGWCVLLGRCSRRSECSRGQGPEQWLWSFQPELGCLQVAAMSPANISREETREVFLSVPDLPPLWPGESYSCHFGEHQSPALLTGSGVMCPSPDPSEAPVLPRGADYVSVSVELRFGAVVIAKTSLSFYDCVAVTELRPSAQCQACVSSRWGCNWCVWQHLCTHKASCDAGPMVASHQSPLVSPDPPARGGPSPSPPTAPKALATPAPDTLPVEPGAPSTATASDISPGASPSLLSPWGPWAGSGSISSPGSTGSPLHEEPSPPSPQNGPGTAVPAPTDFRPSATPEDLLASPLSPSEVAAVPPADPGPEALHPTVPLDLPPATVPATTFPGAMGSVKPALDWLTREGGELPEADEWTGGDAPAFSTSTLLSGDGDSAELEGPPAPLILPSSLDYQYDTPGLWELEEATLGASSCPCVESVQGSTLMPVHVEREIRLLGRNLHLFQDGPGDNECVMELEGLEVVVEARVECEPPPDTQCHVTCQQHQLSYEALQPELRVGLFLRRAGRLRVDSAEGLHVVLYDCSVGHGDCSRCQTAMPQYGCVWCEGERPRCVTREACGEAEAVATQCPAPLIHSVEPLTGPVDGGTRVTIRGSNLGQHVQDVLGMVTVAGVPCAVDAQEYEVSSSLVCITGASGEEVAGATAVEVPGRGRGVSEHDFAYQDPKVHSIFPARGPRAGGTRLTLNGSKLLTGRLEDIRVVVGDQPCHLLPEQQSEQLRCETSPRPTPATLPVAVWFGATERRLQRGQFKYTLDPNITSAGPTKSFLSGGREICVRGQNLDVVQTPRIRVTVVSRMLQPSQGLGRRRRVVPETACSLGPSCSSQQFEEPCHVNSSQLITCRTPALPGLPEDPWVRVEFILDNLVFDFATLNPTPFSYEADPTLQPLNPEDPTMPFRHKPGSVFSVEGENLDLAMSKEEVVAMIGDGPCVVKTLTRHHLYCEPPVEQPLPRHHALREAPDSLPEFTVQMGNLRFSLGHVQYDGESPGAFPVAAQVGLGVGTSLLALGVIIIVLMYRRKSKQALRDYKKVQIQLENLESSVRDRCKKEFTDLMTEMTDLTSDLLGSGIPFLDYKVYAERIFFPGHRESPLHRDLGVPESRRPTVEQGLGQLSNLLNSKLFLTKFIHTLESQRTFSARDRAYVASLLTVALHGKLEYFTDILRTLLSDLVAQYVAKNPKLMLRRTETVVEKLLTNWMSICLYTFVRDSVGEPLYMLFRGIKHQVDKGPVDSVTGKAKYTLNDNRLLREDVEYRPLTLNALLAVGPGAGEAQGVPVKVLDCDTISQAKEKMLDQLYKGVPLTQRPDPRTLDVEWRSGVAGHLILSDEDVTSEVQGLWRRLNTLQHYKVPDGATVALVPCLTKHVLRENQDYVPGERTPMLEDVDEGGIRPWHLVKPSDEPEPPRPRRGSLRGGERERAKAIPEIYLTRLLSMKGTLQKFVDDLFQVILSTSRPVPLAVKYFFDLLDEQAQQHGISDQDTIHIWKTNSLPLRFWINIIKNPQFVFDVQTSDNMDAVLLVIAQTFMDACTLADHKLGRDSPINKLLYARDIPRYKRMVERYYADIRQTVPASDQEMNSVLAELSWNYSGDLGARVALHELYKYINKYYDQIITALEEDGTAQKMQLGYRLQQIAAAVENKVTDL

SEQ ID NO: 3541 - protein, 1838 aa, unidentified
MALQLWALTLLGLLGAGASLRPRKLDFFRSEKELNHLAVDEASGVVYLGAVNALYQLDAKLQLEQQVATGPALDNKKCTPPIEASQCHEAEMTDNVNQLLLLDPPRKRLVECGSLFKGICALRALSNISLRLFYEDGSGEKSFVASNDEGVATVGLVSSTGPGGDRVLFVGKGNGPHDNGIIVSTRLLDRTDSREAFEAYTDHATYKAGYLSTNTQQFVAAFEDGPYVFFVFNQQDKHPARNRTLLARMCREDPNYYSYLEMDLQCRDPDIHAAAFGTCLAASVAAPGSGRVLYAVFSRDSRSSGGPGAGLCLFPLDKVHAKMEANRNACYTGTREARDIFYKPFHGDIQCGGHAPGSSKSFPCGSEHLPYPLGSRDGLRGTAVLQRGGLNLTAVTVAAENNHTVAFLGTSDGRILKVYLTPDGTSSEYDSILVEINKRVKRDLVLSGDLGSLYAMTQDKVFRLPVQECLSYPTCTQCRDSQDPYCGWCVVEGRCTRKAECPRAEEASHWLWSRSKSCVAVTSAQPQNMSRRAQGEVQLTVSPLPALSEEDELLCLFGESPPHPARVEGEAVICNSPSSIPVTPPGQDHVAVTIQLLLRRGNIFLTSYQYPFYDCRQAMSLEENLPCISCVSNRWTCQWDLRYHECREASPNPEDGIVRAHMEDSCPQFLGPSPLVIPMNHETDVNFQGKNLDTVKGSSLHVGSDLLKFMEPVTMQESGTFAFRTPKLSHDANETLPLHLYVKSYGKNIDSKLHVTLYNCSFGRSDCSLCRAANPDYRCAWCGGQSRCVYEALCNTTSECPPPVITRIQPETGPLGGGIRITILGSNLGVQAGDIQRISVAGRNCSFQPERYSVSTRIVCVIEAAETPFTGGVEVDVFGKLGRSPPNVQFTFQQPKPLSVEPQQGPQAGGTTLTIHGTHLDTGSQEDVRVTLNGVPCKVTKFGAQLQCVTGPQATRGQMLLEVSYGGSPVPNPGIFFTYRENPVLRAFEPLRSFASGGRSINVTGQGFSLIQRFAMVVIAEPLQSWQPPREAESLQPMTVVGTDYVFHNDTKVVFLSPAVPEEPEAYNLTVLIEMDGHRALLRTEAGAFEYVPDPTFENFTGGVKKQVNKLIHARGTNLNKAMTLQEAEAFVGAERCTMKTLTETDLYCEPPEVQPPPKRRQKRDTTHNLPEFIVKFGSREWVLGRVEYDTRVSDVPLSLILPLVIVPMVVVIAVSVYCYWRKSQQAEREYEKIKSQLEGLEESVRDRCKKEFTDLMIEMEDQTNDVHEAGIPVLDYKTYTDRVFFLPSKDGDKDVMITGKLDIPEPRRPVVEQALYQFSNLLNSKSFLINFIHTLENQREFSARAKVYFASLLTVALHGKLEYYTDIMHTLFLELLEQYVVAKNPKLMLRRSETVVERMLSNWMSICLYQYLKDSAGEPLYKLFKAIKHQVEKGPVDAVQKKAKYTLNDTGLLGDDVEYAPLTVSVIVQDEGVDAIPVKVLNCDTISQVKEKIIDQVYRGQPCSCWPRPDSVVLEWRPGSTAQILSDLDLTSQREGRWKRVNTLMHYNVRDGATLILSKVGVSQQPEDSQQDLPGERHALLEEENRVWHLVRPTDEVDEGKSKRGSVKEKERTKAITEIYLTRLLSVKGTLQQFVDNFFQSVLAPGHAVPPAVKYFFDFLDEQAEKHNIQDEDTIHIWKTNSLPLRFWVNILKNPHFIFDVHVHEVVDASLSVIAQTFMDACTRTEHKLSRDSPSNKLLYAKEISTYKKMVEDYYKGIRQMVQVSDQDMNTHLAEISRAHTDSLNTLVALHQLYQYTQKYYDEIINALEEDPAAQKMQLAFRLQQIAAALENKVTDL

SEQ ID NO: 3542 - protein, 1909 aa, unidentified
MCHAAQETPLLHHFMAPVMARWPPFGLCLLLLLLSPPPLPLTGAHRFSAPNTTLNHLALAPGRGTLYVGAVNRLFQLSPELQLEAVAVTGPVIDSPDCVPFRDPAECPQAQLTDNANQLLLVSSRAQELVACGQVRQGVCETRRLGDVAEVLYQAEDPGDGQFVAANTPGVATVGLVVPLPGRDLLLVARGLAGKLSAGVPPLAIRQLAGSQPFSSEGLGRLVVGDFSDYNNSYVGAFADARSAYFVFRRRGARAQAEYRSYVARVCLGDTNLYSYVEVPLACQGQGLIQAAFLAPGTLLGVFAAGPRGTQAALCAFPMVELGASMEQARRLCYTAGGRGPSGAEEATVEYGVTSRCVTLPLDSPESYPCGDEHTPSPIAGRQPLEVQPLLKLGQPVSAVAALQADGHMIAFLGDTQGQLYKVFLHGSQGQVYHSQQVGPPGSAISPDLLLDSSGSHLYVLTAHQVDRIPVAACPQFPDCASCLQAQDPLCGWCVLQGRCTRKGQCGRAGQLNQWLWSYEEDSHCLHIQSLLPGHHPRQEQGQVTLSVPRLPILDADEYFHCAFGDYDSLAHVEGPHVACVTPPQDQVPLNPPGTDHVTVPLALMFEDVTVAATNFSFYDCSAVQALEAAAPCRACVGSIWRCHWCPQSSHCVYGEHCPEGERTIYSAQEVDIQVRGPGACPQVEGLAGPHLVPVGWESHLALRVRNLQHFRGLPASFHCWLELPGELRGLPATLEETAGDSGLIHCQAHQFYPSMSQRELPVPIYVTQGEAQRLDNTHALYVILYDCAMGHPDCSHCQAANRSLGCLWCADGQPACRYGPLCPPGAVELLCPAPSIDAVEPLTGPPEGGLALTILGSNLGRAFADVQYAVSVASRPCNPEPSLYRTSARIVCVTSPAPNGTTGPVRVAIKSQPPGISSQHFTYQDPVLLSLSPRWGPQAGGTQLTIRGQHLQTGGNTSAFVGGQPCPILEPVCPEAIVCRTRPQAAPGEAAVLVVFGHAQRTLLASPFRYTANPQLVAAEPSASFRGGGRLIRVRGTGLDVVQRPLLSVWLEADAEVQASRAQPQDPQPRRSCGAPAADPQACIQLGGGLLQCSTVCSVNSSSLLLCRSPAVPDRAHPQRVFFTLDNVQVDFASASGGQGFLYQPNPRLAPLSREGPARPYRLKPGHVLDVEGEGLNLGISKEEVRVHIGRGECLVKTLTRTHLYCEPPAHAPQPANGSGLPQFVVQMGNVQLALGPVQYEAEPPLSAFPVEAQAGVGMGAAVLIAAVLLLTLMYRHKSKQALRDYQKVLVQLESLETGVGDQCRKEFTDLMTEMTDLSSDLEGSGIPFLDYRTYAERAFFPGHGGCPLQPKPEGPGEDGHCATVRQGLTQLSNLLNSKLFLLTLIHTLEEQPSFSQRDRCHVASLLSLALHGKLEYLTDIMRTLLGDLAAHYVHRNPKLMLRRTETMVEKLLTNWLSICLYAFLREVAGEPLYMLFRAIQYQVDKGPVDAVTGKAKRTLNDSRLLREDVEFQPLTLMVLVGPGAGGAAGSSEMQRVPARVLDTDTITQVKEKVLDQVYKGTPFSQRPSVHALDLEWRSGLAGHLTLSDEDLTSVTQNHWKRLNTLQHYKVPDGATVGLVPQLHRGSTISQSLAQRCPLGENIPTLEDGEEGGVCLWHLVKATEEPEGAKVRCSSLREREPARAKAIPEIYLTRLLSMKGTLQKFVDDTFQAILSVNRPIPIAVKYLFDLLDELAEKHGIEDPGTLHIWKTNSLLLRFWVNALKNPQLIFDVRVSDNVDAILAVIAQTFIDSCTTSEHKVGRDSPVNKLLYAREIPRYKQMVERYYADIRQSSPASYQEMNSALAELSGNYTSAPHCLEALQELYNHIHRYYDQIISALEEDPVGQKLQLACRLQQVAALVENKVTDL

SEQ ID NO: 3543 - protein, 1568 aa, unidentified
MEVSRRKAPPRPPRPAAPLPLLAYLLALAAPGRGADEPVWRSEQAIGAIAASQEDGVFVASGSCLDQLDYSLEHSLSRLYRDQAGNCTEPVSLAPPARPRPGSSFSKLLLPYREGAAGLGGLLLTGWTFDRGACEVRPLGNLSRNSLRNGTEVVSCHPQGSTAGVVYRAGRNNRWYLAVAATYVLPEPETASRCNPAASDHDTAIALKDTEGRSLATQELGRLKLCEGAGSLHFVDAFLWNGSIYFPYYPYNYTSGAATGWPSMARIAQSTEVLFQGQASLDCGHGHPDGRRLLLSSSLVEALDVWAGVFSAAAGEGQERRSPTTTALCLFRMSEIQARAKRVSWDFKTAESHCKEGDQPERVQPIASSTLIHSDLTSVYGTVVMNRTVLFLGTGDGQLLKVILGENLTSNCPEVIYEIKEETPVFYKLVPDPVKNIYIYLTAGKEVRRIRVANCNKHKSCSECLTATDPHCGWCHSLQRCTFQGDCVHSENLENWLDISSGAKKCPKIQIIRSSKEKTTVTMVGSFSPRHSKCMVKNVDSSRELCQNKSQPNRTCTCSIPTRATYKDVSVVNVMFSFGSWNLSDRFNFTNCSSLKECPACVETGCAWCKSARRCIHPFTACDPSDYERNQEQCPVAVEKTSGGGRPKENKGNRTNQALQVFYIKSIEPQKVSTLGKSNVIVTGANFTRASNITMILKGTSTCDKDVIQVSHVLNDTHMKFSLPSSRKEMKDVCIQFDGGNCSSVGSLSYIALPHCSLIFPATTWISGGQNITMMGRNFDVIDNLIISHELKGNINVSEYCVATYCGFLAPSLKSSKVRTNVTVKLRVQDTYLDCGTLQYREDPRFTGYRVESEVDTELEVKIQKENDNFNISKKDIEITLFHGENGQLNCSFENITRNQDLTTILCKIKGIKTASTIANSSKKVRVKLGNLELYVEQESVPSTWYFLIVLPVLLVIVIFAAVGVTRHKSKELSRKQSQQLELLESELRKEIRDGFAELQMDKLDVVDSFGTVPFLDYKHFALRTFFPESGGFTHIFTEDMHNRDANDKNESLTALDALICNKSFLVTVIHTLEKQKNFSVKDRCLFASFLTIALQTKLVYLTSILEVLTRDLMEQCSNMQPKLMLRRTESVVEKLLTNWMSVCLSGFLRETVGEPFYLLVTTLNQKINKGPVDVITCKALYTLNEDWLLWQVPEFSTVALNVVFEKIPENESADVCRNISVNVLDCDTIGQAKEKIFQAFLSKNGSPYGLQLNEIGLELQMGTRQKELLDIDSSSVILEDGITKLNTIGHYEISNGSTIKVFKKIANFTSDVEYSDDHCHLILPDSEAFQDVQGKRHRGKHKFKVKEMYLTKLLSTKVAIHSVLEKLFRSIWSLPNSRAPFAIKYFFDFLDAQAENKKITDPDVVHIWKTNSLPLRFWVNILKNPQFVFDIKKTPHIDGCLSVIAQAFMDAFSLTEQQLGKEAPTNKLLYAKDIPTYKEEVKSYYKAIRDLPPLSSSEMEEFLTQESKKHENEFNEEVALTEIYKYIVKYFDEILNKLERERGLEEAQKQLLHVKVLFDEKKKCKWM

SEQ ID NO: 3544 - protein, 1925 aa, unidentified
MAPRAAGGAPLSARAAAASPPPFQTPPRCPVPLLLLLLLGAARAGALEIQRRFPSPTPTNNFALDGAAGTVYLAAVNRLYQLSGANLSLEAEAAVGPVPDSPLCHAPQLPQASCEHPRRLTDNYNKILQLDPGQGLVVVCGSIYQGFCQLRRRGNISAVAVRFPPAAPPAEPVTVFPSMLNVAANHPNASTVGLVLPPAAGAGGSRLLVGATYTGYGSSFFPRNRSLEDHRFENTPEIAIRSLDTRGDLAKLFTFDLNPSDDNILKIKQGAKEQHKLGFVSAFLHPSDPPPGAQSYAYLALNSEARAGDKESQARSLLARICLPHGAGGDAKKLTESYIQLGLQCAGGAGRGDLYSRLVSVFPARERLFAVFERPQGSPAARAAPAALCAFRFADVRAAIRAARTACFVEPAPDVVAVLDSVVQGTGPACERKLNIQLQPEQLDCGAAHLQHPLSILQPLKATPVFRAPGLTSVAVASVNNYTAVFLGTVNGRLLKINLNESMQVVSRRVVTVAYGEPVHHVMQFDPADSGYLYLMTSHQMARVKVAACNVHSTCGDCVGAADAYCGWCALETRCTLQQDCTNSSQQHFWTSASEGPSRCPAMTVLPSEIDVRQEYPGMILQISGSLPSLSGMEMACDYGNNIRTVARVPGPAFGHQIAYCNLLPRDQFPPFPPNQDHVTVEMSVRVNGRNIVKANFTIYDCSRTAQVYPHTACTSCLSAQWPCFWCSQQHSCVSNQSRCEASPNPTSPQDCPRTLLSPLAPVPTGGSQNILVPLANTAFFQGAALECSFGLEEIFEAVWVNESVVRCDQVVLHTTRKSQVFPLSLQLKGRPARFLDSPEPMTVMVYNCAMGSPDCSQCLGREDLGHLCMWSDGCRLRGPLQPMAGTCPAPEIHAIEPLSGPLDGGTLLTIRGRNLGRRLSDVAHGVWIGGVACEPLPDRYTVSEEIVCVTGPAPGPLSGVVTVNASKEGKSRDRFSYVLPLVHSLEPTMGPKAGGTRITIHGNDLHVGSELQVLVNDTDPCTELMRTDTSIACTMPEGALPAPVPVCVRFERRGCVHGNLTFWYMQNPVITAISPRRSPVSGGRTITVAGERFHMVQNVSMAVHHIGREPTLCKVLNSTLITCPSPGALSNASAPVDFFINGRAYADEVAVAEELLDPEEAQRGSRFRLDYLPNPQFSTAKREKWIKHHPGEPLTLVIHKEQDSLGLQSHEYRVKIGQVSCDIQIVSDRIIHCSVNESLGAAVGQLPITIQVGNFNQTIATLQLGGSETAIIVSIVICSVLLLLSVVALFVFCTKSRRAERYWQKTLLQMEEMESQIREEIRKGFAELQTDMTDLTKELNRSQGIPFLEYKHFVTRTFFPKCSSLYEERYVLPSQTLNSQGSSQAQETHPLLGEWKIPESCRPNMEEGISLFSSLLNNKHFLIVFVHALEQQKDFAVRDRCSLASLLTIALHGKLEYYTSIMKELLVDLIDASAAKNPKLMLRRTESVVEKMLTNWMSICMYSCLRETVGEPFFLLLCAIKQQINKGSIDAITGKARYTLSEEWLLRENIEAKPRNLNVSFQGCGMDSLSVRAMDTDTLTQVKEKILEAFCKNVPYSQWPRAEDVDLEWFASSTQSYILRDLDDTSVVEDGRKKLNTLAHYKIPEGASLAMSLIDKKDNTLGRVKDLDTEKYFHLVLPTDELAEPKKSHRQSHRKKVLPEIYLTRLLSTKGTLQKFLDDLFKAILSIREDKPPLAVKYFFDFLEEQAEKRGISDPDTLHIWKTNSLPLRFWVNILKNPQFVFDIDKTDHIDACLSVIAQAFIDACSISDLQLGKDSPTNKLLYAKEIPEYRKIVQRYYKQIQDMTPLSEQEMNAHLAEESRKYQNEFNTNVAMAEIYKYAKRYRPQIMAALEANPTARRTQLQHKFEQVVALMEDNIYECYSEA

SEQ ID NO: 3545 - protein, 661 aa, unidentified
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 3546 - protein, 287 aa, unidentified
MHRLMGVNSTAAAAAGQPNVSCTCNCKRSLFQSMEITELEFVQIIIIVVVMMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLRDPEQQLELNRESVRAPPNRTIFDSDLMDSARLGGPCPPSSNSGISATCYGSGGRMEGPPPTYSEVIGHYPGSSFQHQQSSGPPSLLEGTRLHHTHIAPLESAAIWSKEKDKQKGHPL

SEQ ID NO: 3547 - protein, 160 aa, unidentified
MLLLLLSIIVLHVAVLVLLFVSTIVSQWIVGNGHATDLWQNCSTSSSGNVHHCFSSSPNEWLQSVQATMILSIIFSILSLFLFFCQLFTLTKGGRFYITGIFQILAGLCVMSAAAIYTVRHPEWHLNSDYSYGFAYILAWVAFPLALLSGVIYVILRKRE

SEQ ID NO: 3548 - protein, 385 aa, unidentified
MAAVVAATALKGRGARNARVLRGILAGATANKASHNRTRALQSHSSPEGKEEPEPLSPELEYIPRKRGKNPMKAVGLAWYSLYTRTWLGYLFYRQQLRRARNRYPKGHSKTQPRLFNGVKVLPIPVLSDNYSYLIIDTQAQLAVAVDPSDPRAVQASIEKEGVTLVAILCTHKHWDHSGGNRDLSRRHRDCRVYGSPQDGIPYLTHPLCHQDVVSVGRLQIRALATPGHTQGHLVYLLDGEPYKGPSCLFSGDLLFLSGCGRTFEGNAETMLSSLDTVLGLGDDTLLWPGHEYAEENLGFAGVVEPENLARERKMQWVQRQRLERKGTCPSTLGEERSYNPFLRTHCLALQEALGPGPGPTGDDDYSRAQLLEELRRLKDMHKSK

SEQ ID NO: 3549 - protein, 520 aa, unidentified
MFCTRGLLFFAFLAGLDIEFTGLRSNLSGPQQISLFDLPSEWYLKTRQSVQQFTVCQIGLSVFSAIEGEANKYIAHSCNFYLFPTTFGILDSEFSFQASSVQFLNQYGFNYNKFLKNGIPYMNEEQEKKIRHDILTGNWRVRSSPDKDQIKVVIDEVTRWLELAKEGDWMTLPGITGFQAFEVQLVLRQALPNIWTVLKDEGVVVKKVSKQHRWYLQNTSCDRESCWKENILLSARGFSVFFQMLVKAQKPLVGHNMMMDLLHLHEKFFRPLPESYDQFKQNIHSLFPVLIDTKSVTKDIWKEMNFPRVSNLSEVYEVLNSDLNPTKNSGPEIVHASRCEKYVETKCPHEAAYDAFLCGSVLLKVAHLLLQKIYHIDPVPESSFPQYLDVLAPYVNQVNLIRAGVPKINFSGPDYPSIRPPILILSVKRWPGVSEQQVYHKFQNLCKFDVRRLTRSQFLLLTNKFKDARNILKEYRDHPTLCISLYRYWRHSPNVNCLLQVCGIVTAWALLAFILGRSGT

SEQ ID NO: 3550 - protein, 1375 aa, unidentified
MEAPLQTGMMGTSSHGLATNSSGAKVAERDGFQDVLAPGEGSAGRICGAQPVPFVPQVLGVMIGAGVAVVVTAVLILLVVRRLRVPKTPAPDGPRYRFRKRDKVLFYGRKIMRKVSQSTSSLVDTSVSATSRPRMRKKLKMLNIAKKILRIQKETPTLQRKEPPPAVLEADLTEGDLANSHLPSEVLYMLKNVRVLGHFEKPLFLELCRHMVFQRLGQGDYVFRPGQPDASIYVVQDGLLELCLPGPDGKECVVKEVVPGDSVNSLLSILDVITGHQHPQRTVSARAARDSTVLRLPVEAFSAVFTKYPESLVRVVQIIMVRLQRVTFLALHNYLGLTNELFSHEIQPLRLFPSPGLPTRTSPVRGSKRMVSTSATDEPRETPGRPPDPTGAPLPGPTGDPVKPTSLETPSAPLLSRCVSMPGDISGLQGGPRSDFDMAYERGRISVSLQEEASGGSLAAPARTPTQEPREQPAGACEYSYCEDESATGGCPFGPYQGRQTSSIFEAAKQELAKLMRIEDPSLLNSRVLLHHAKAGTIIARQGDQDVSLHFVLWGCLHVYQRMIDKAEDVCLFVAQPGELVGQLAVLTGEPLIFTLRAQRDCTFLRISKSDFYEIMRAQPSVVLSAAHTVAARMSPFVRQMDFAIDWTAVEAGRALYRQGDRSDCTYIVLNGRLRSVIQRGSGKKELVGEYGRGDLIGVVEALTRQPRATTVHAVRDTELAKLPEGTLGHIKRRYPQVVTRLIHLLSQKILGNLQQLQGPFPAGSGLGVPPHSELTNPASNLATVAILPVCAEVPMVAFTLELQHALQAIGPTLLLNSDIIRARLGASALDSIQEFRLSGWLAQQEDAHRIVLYQTDASLTPWTVRCLRQADCILIVGLGDQEPTLGQLEQMLENTAVRALKQLVLLHREEGAGPTRTVEWLNMRSWCSGHLHLRCPRRLFSRRSPAKLHELYEKVFSRRADRHSDFSRLARVLTGNTIALVLGGGGARGCSHIGVLKALEEAGVPVDLVGGTSIGSFIGALYAEERSASRTKQRAREWAKSMTSVLEPVLDLTYPVTSMFTGSAFNRSIHRVFQDKQIEDLWLPYFNVTTDITASAMRVHKDGSLWRYVRASMTLSGYLPPLCDPKDGHLLMDGGYINNLPADIARSMGAKTVIAIDVGSQDETDLSTYGDSLSGWWLLWKRLNPWADKVKVPDMAEIQSRLAYVSCVRQLEVVKSSSYCEYLRPPIDCFKTMDFGKFDQIYDVGYQYGKAVFGGWSRGNVIEKMLTDRRSTDLNESRRADVLAFPSSGFTDLAEIVSRIEPPTSYVSDGCADGEESDCLTEYEEDAGPDCSRDEGGSPEGASPSTASEMEEEKSILRQRRCLPQEPPGSATDA

SEQ ID NO: 3551 - protein, 1317 aa, unidentified
MEEEKDDSPQLTGIAVGALLALALVGVLILFMFRRLRQFRQAQPTPQYRFRKRDKVMFYGRKIMRKVTTLPNTLVENTALPRQRARKRTKVLSLAKRILRFKKEYPALQPKEPPPSLLEADLTEFDVKNSHLPSEVLYMLKNVRVLGHFEKPLFLELCKHIVFVQLQEGEHVFQPREPDPSICVVQDGRLEVCIQDTDGTEVVVKEVLAGDSVHSLLSILDIITGHAAPYKTVSVRAAIPSTILRLPAAAFHGVFEKYPETLVRVVQIIMVRLQRVTFLALHNYLGLTTELFNAESQAIPLVSVASVAAGKAKKQVFYGEEERLKKPPRLQESCDSDHGGGRPAAAGPLLKRSHSVPAPSIRKQILEELEKPGAGDPDPSAPQGGPGSATSDLGMACDRARVFLHSDEHPGSSVASKSRKSVMVAEIPSTVSQHSESHTDETLASRKSDAIFRAAKKDLLTLMKLEDSSLLDGRVALLHVPAGTVVSRQGDQDASILFVVSGLLHVYQRKIGSQEDTCLFLTRPGEMVGQLAVLTGEPLIFTVKANRDCSFLSISKAHFYEIMRKQPTVVLGVAHTVVKRMSSFVRQIDFALDWVEVEAGRAIYRQGDKSDCTYIMLSGRLRSVIRKDDGKKRLAGEYGRGDLVGVVETLTHQARATTVHAVRDSELAKLPAGALTSIKRRYPQVVTRLIHLLGEKILGSLQQGPVTGHQLGLPTEGSKWDLGNPAVNLSTVAVMPVSEEVPLTAFALELEHALSAIGPTLLLTSDNIKRRLGSAALDSVHEYRLSSWLGQQEDTHRIVLYQADGTLTPWTQRCVRQADCILIVGLGDQEPTVGELERMLESTAVRAQKQLILLHREEGPAPARTVEWLNMRSWCSGHLHLCCPRRVFSRRSLPKLVEMYKHVFQRPPDRHSDFSRLARVLTGNAIALVLGGGGARGCAQVGVLKALAECGIPVDMVGGTSIGAFVGALYSEERNYSQMRIRAKQWAEGMTSLMKAALDLTYPITSMFSGAGFNSSIFSVFKDQQIEDLWIPYFAITTDITASAMRVHTDGSLWWYVRASMSLSGYMPPLCDPKDGHLLMDGGYINNLPADVARSMGAKVVIAIDVGSRDETDLTNYGDALSGWWLLWKRWNPLATKVKVLNMAEIQTRLAYVCCVRQLEVVKSSDYCEYLRPPIDSYSTLDFGKFNEICEVGYQHGRTVFDIWGRSGVLEKMLRDQQGPSKKPASAVLTCPNASFTDLAEIVSRIEPAKPAMVDDESDYQTEYEEELLDVPRDAYADFQSTSAQQGSDLEDESSLRHRHPSLAFPKLSEGSSDQDG

SEQ ID NO: 3552 - protein, 782 aa, unidentified
MSINLTVDIYIYLLSNARSVCGKQRSKQLYFLFSPKHYWRISHISLQRGFHTNIIRCKWTKSEAHSCSKHCYSPSNHGLHIGILKLSTSAPKGLTKVNICMSRIKSTLNSVSKAVFGNQNEMISRLAQFKPSSQILRKVSDSGWLKQKNIKQAIKSLKKYSDKSAEKSPFPEEKSHIIDKEEDIGKRSLFHYTSSITTKFGDSFYFLSNHINSYFKRKEKMSQQKENEHFRDKSELEDKKVEEGKLRSPDPGILAYKPGSESVHTVDKPTSPSAIPDVLQVSTKQSIANFLSRPTEGVQALVGGYIGGLVPKLKYDSKSQSEEQEEPAKTDQAVSKDRNAEEKKRLSLQREKIIARVSIDNRTRALVQALRRTTDPKLCITRVEELTFHLLEFPEGKGVAVKERIIPYLLRLRQIKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSALMIETARNPTCPKVAAVSTIVNRGITPKAFVFRNYGHFPGINSHYLGGCQYKMWQAIRASSAAPGYFAEYALGNDLHQDGGLLLNNPSALAMHECKCLWPDVPLECIVSLGTGRYESDVRNTVTYTSLKTKLSNVINSATDTEEVHIMLDGLLPPDTYFRFNPVMCENIPLDESRNEKLDQLQLEGLKYIERNEQKMKKVAKILSQEKTTLQKINDWIKLKTDMYEGLPFFSKL

SEQ ID NO: 3553 - protein, 558 aa, unidentified
MRCALALSALLLLLSTPPLLPSSPSPSPSPSQNATQTTTDSSNKTAPTPASSVTIMATDTAQQSTVPTSKANEILASVKATTLGVSSDSPGTTTLAQQVSGPVNTTVARGGGSGNPTTTIESPKSTKSADTTTVATSTATAKPNTTSSQNGAEDTTNSGGKSSHSVTTDLTSTKAEHLTTPHPTSPLSPRQPTSTHPVATPTSSGHDHLMKISSSSSTVAIPGYTFTSPGMTTTLLETVFHHVSQAGLELLTSGDLPTLASQSAGITASSVISQRTQQTSSQMPASSTAPSSQETVQPTSPATALRTPTLPETMSSSPTAASTTHRYPKTPSPTVAHESNWAKCEDLETQTQSEKQLVLNLTGNTLCAGGASDEKLISLICRAVKATFNPAQDKCGIRLASVPGSQTVVVKEITIHTKLPAKDVYERLKDKWDELKEAGVSDMKLGDQGPPEEAEDRFSMPLIITIVCMASFLLLVAALYGCCHQRLSQRKDQQRLTEELQTVENGYHDNPTLEVMETSSEMQEKKVVSLNGELGDSWIVPLDNLTKDDLDEEEDTHL

SEQ ID NO: 3554 - protein, 605 aa, unidentified
MGRLLRAARLPPLLSPLLLLLVGGAFLGACVAGSDEPGPEGLTSTSLLDLLLPTGLEPLDSEEPSETMGLGAGLGAPGSGFPSEENEESRILQPPQYFWEEEEELNDSSLDLGPTADYVFPDLTEKAGSIEDTSQAQELPNLPSPLPKMNLVEPPWHMPPREEEEEEEEEEEREKEEVEKQEEEEEEELLPVNGSQEEAKPQVRDFSLTSSSQTPGATKSRHEDSGDQASSGVEVESSMGPSLLLPSVTPTTVTPGDQDSTSQEAEATVLPAAGLGVEFEAPQEASEEATAGAAGLSGQHEEVPALPSFPQTTAPSGAEHPDEDPLGSRTSASSPLAPGDMELTPSSATLGQEDLNQQLLEGQAAEAQSRIPWDSTQVICKDWSNLAGKNYIILNMTENIDCEVFRQHRGPQLLALVEEVLPRHGSGHHGAWHISLSKPSEKEQHLLMTLVGEQGVVPTQDVLSMLGDIRRSLEEIGIQNYSTTSSCQARASQVRSDYGTLFVVLVVIGAICIIIIALGLLYNCWQRRLPKLKHVSHGEELRFVENGCHDNPTLDVASDSQSEMQEKHPSLNGGGALNGPGSWGALMGGKRDPEDSDVFEEDTHL

SEQ ID NO: 3555 - protein, 419 aa, unidentified
MAAEVLPSARWQYCGAPDGSQRAVLVQFSNGKLQSPGNMRFTLYENKDSTNPRKRNQRILAAETDRLSYVGNNFGTGALKCNTLCRHFVGILNKTSGQMEVYDAELFNMQPLFSDVSVESELALESQTKTYREKMDSCIEAFGTTKQKRALNTRRMNRVGNESLNRAVAKAAETIIDTKGVTALVSDAIHNDLQDDSLYLPPCYDDAAKPEDVYKFEDLLSPAEYEALQSPSEAFRNVTSEEILKMIEENSHCTFVIEALKSLPSDVESRDRQARCIWFLDTLIKFRAHRVVKRKSALGPGVPHIINTKLLKHFTCLTYNNGRLRNLISDSMKAKITAYVIILALHIHDFQIDLTVLQRDLKLSEKRMMEIAKAMRLKISKRRVSVAAGSEEDHKLGTLSLPLPPAQTSDRLAKRRKIT

SEQ ID NO: 3556 - protein, 660 aa, unidentified
MDDWKPSPLIKPFGARKKRSWYLTWKYKLTNQRALRRFCQTGAVLFLLVTVIVNIKLILDTRRAISEANEDPEPEQDYDEALGRLEPPRRRGSGPRRVLDVEVYSSRSKVYVAVDGTTVLEDEAREQGRGIHVIVLNQATGHVMAKRVFDTYSPHEDEAMVLFLNMVAPGRVLICTVKDEGSFHLKDTAKALLRSLGSQAGPALGWRDTWAFVGRKGGPVFGEKHSKSPALSSWGDPVLLKTDVPLSSAEEAECHWADTELNRRRRRFCSKVEGYGSVCSCKDPTPIEFSPDPLPDNKVLNVPVAVIAGNRPNYLYRMLRSLLSAQGVSPQMITVFIDGYYEEPMDVVALFGLRGIQHTPISIKNARVSQHYKASLTATFNLFPEAKFAVVLEEDLDIAVDFFSFLSQSIHLLEEDDSLYCISAWNDQGYEHTAEDPALLYRVETMPGLGWVLRRSLYKEELEPKWPTPEKLWDWDMWMRMPEQRRGRECIIPDVSRSYHFGIVGLNMNGYFHEAYFKKHKFNTVPGVQLRNVDSLKKEAYEVEVHRLLSEAEVLDHSKNPCEDSFLPDTEGHTYVAFIRMEKDDDFTTWTQLAKCLHIWDLDVRGNHRGLWRLFRKKNHFLMVGVPASPYSVKKPPSVTPIFLEPPPKEEGAPGAPEQT

SEQ ID NO: 3557 - protein, 350 aa, unidentified
MEKQPQNSRRGLAPREVPPAVGLLLIMALMNTLLYLCLDHFFIAPRQSTVDPTHCPYGHFRIGQMKNCSPWLSCEELRTEVRQLKRVGEGAVKRVFLSEWKEHKVALSQLTSLEMKDDFLHGLQMLKSLQGTHVVTLLGYCEDDNTMLTEYHPLGSLSNLEETLNLSKYQNVNTWQHRLELAMDYVSIINYLHHSPVGTRVMCDSNDLPKTLSQYLLTSNFSILANDLDALPLVNHSSGMLVKCGHRELHGDFVAPEQLWPYGEDVPFHDDLMPSYDEKIDIWKIPDISSFLLGHIEGSDMVRFHLFDIHKACKSQTPSERPTAQDVLETYQKVLDTLRDAMMSQAREML

SEQ ID NO: 3558 - protein, 747 aa, unidentified
MWGFLKRPVVVTADINLSLVALTGMGLLSRLWRLTYPRAVVFDEVYYGQYISFYMKQIFFLDDSGPPFGHMVLALGGYLGGFDGNFLWNRIGAEYSSNVPVWSLRLLPALAGALSVPMAYQIVLELHFSHCAAMGAALLMLIENALITQSRLMLLESVLIFFNLLAVLSYLKFFNCQKHSPFSLSWWFWLTLTGVACSCAVGIKYMGVFTYVLVLGVAAVHAWHLLGDQTLSNVGADVQCCMRPACMGQMQMSQGVCVFCHLLARAVALLVIPVVLYLLFFYVHLILVFRSGPHDQIMSSAFQASLEGGLARITQGQPLEVAFGSQVTLRNVFGKPVPCWLHSHQDTYPMIYENGRGSSHQQQVTCYPFKDVNNWWIVKDPRRHQLVVSSPPRPVRHGDMVQLVHGMTTRSLNTHDVAAPLSPHSQEVSCYIDYNISMPAQNLWRLEIVNRGSDTDVWKTILSEVRFVHVNTSAVLKLSGAHLPDWGYRQLEIVGEKLSRGYHGSTVWNVEEHRYGASQEQRERERELHSPAQVDVSRNLSFMARFSELQWRMLALRSDDSEHKYSSSPLEWVTLDTNIAYWLHPRTSAQIHLLGNIVIWVSGSLALAIYALLSLWYLLRRRRNVHDLPQDAWLRWVLAGALCAGGWAVNYLPFFLMEKTLFLYHYLPALTFQILLLPVVLQHISDHLCRSQLQRSIFSALVVAWYSSACHVSNTLRPLTYGDKSLSPHELKALRWKDSWDILIRKH

SEQ ID NO: 3559 - protein, 750 aa, unidentified
MPPATGGGLAESELRPRRGRCGPQAARAAGRDVAAEAVARSPKRPAWGSRRFEAVGWWALLALVTLLSFATRFHRLDEPPHICWDETHFGKMGSYYINRTFFFDVHPPLGKMLIGLAGYLSGYDGTFLFQKPGDKYEHHSYMGMRGFCAFLGSWLVPFAYLTVLDLSKSLSAALLTAALLTFDTGCLTLSQYILLDPILMFFIMAAMLSMVKYNSCADRPFSAPWWFWLSLTGVSLAGALGVKFVGLFIILQVGLNTIADLWYLFGDLSLSLVTVGKHLTARVLCLIVLPLALYTATFAVHFMVLSKSGPGDGFFSSAFQARLSGNNLHNASIPEHLAYGSVITVKNLRMAIGYLHSHRHLYPEGIGARQQQVTTYLHKDYNNLWIIKKHNTNSDPLDPSFPVEFVRHGDIIRLEHKETSRNLHSHYHEAPMTRKHYQVTGYGINGTGDSNDFWRIEVVNRKFGNRIKVLRSRIRFIHLVTGCVLGSSGKVLPKWGWEQLEVTCTPYLKETLNSIWNVEDHINPKLPNISLDVLQPSFPEILLESHMVMIRGNSGLKPKDNEFTSKPWHWPINYQGLRFSGVNDTDFRVYLLGNPVVWWLNLLSIALYLLSGSIIAVAMQRGARLPAEVAGLSQVLLRGGGQVLLGWTLHYFPFFLMGRVLYFHHYFPAMLFSSMLTGILWDTLLRLCAWGLASWPLARGIHVAGILSLLLGTAYSFYLFHPLAYGMVGPLAQDPQSPMAGLRWLDSWDF

SEQ ID NO: 3560 - protein, 364 aa, unidentified
MSANSSRVGQLLLQGSACIRWKQDVEGAVYHLANCLLLLGFMGGSGVYGCFYLFGFLSAGYLCCVLWGWFSACGLDIVLWSFLLAVVCLLQLAHLVYRLREDTLPEEFDLLYKTLCLPLQVPLQTYKEIVHCCEEQVLTLATEQTYAVEGETPINRLSLLLSGRVRVSQDGQFLHYIFPYQFMDSPEWESLQPSEEGVFQVTLTAETSCSYISWPRKSLHLLLTKERYISCLFSALLGYDISEKLYTLNDKLFAKFGLRFDIRLPSLYHVLGPTAADAGPESEKGDEEVCEPAVSPPQATPTSLQQTPPCSTPPATTNFPAPPTRARLSRPDSGILASRIPLQSYSQVISRGQAPLAPTHTPEL

SEQ ID NO: 3561 - protein, 291 aa, unidentified
MERNSSLWKNLIDEHPVCTTWKQEAEGAIYHLASILFVVGFMGGSGFFGLLYVFSLLGLGFLCSAVWAWVDVCAADIFSWNFVLFVICFMQFVHIAYQVRSITFAREFQVLYSSLFQPLGISLPVFRTIALSSEVVTLEKEHCYAMQGKTSIDKLSLLVSGRIRVTVDGEFLHYIFPLQFLDSPEWDSLRPTEEGIFQVTLTAETDCRYVSWRRKKLYLLFAQHRYISRLFSVLIGSDIADKLYALNDRVYIGKRYHYDIRLPNFYQMSTPEIRRSPLTQHFQNSRRYCDK

SEQ ID NO: 3562 - protein, 677 aa, unidentified
MGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFAVFGLGNKTYEHFNAMGKYVDKRLEQLGAQRIFELGLGDDDGNLEEDFITWREQFWPAVCEHFGVEATGEESSIRQYELVVHTDIDAAKVYMGEMGRLKSYENQKPPFDAKNPFLAAVTTNRKLNQGTERHLMHLELDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALVPMFVRKSQFRLPFKATTPVIMVGPGTGVAPFIGFIQERAWLRQQGKEVGETLLYYGCRRSDEDYLYREELAQFHRDGALTQLNVAFSREQSHKVYVQHLLKQDREHLWKLIEGGAHIYVCGDARNMARDVQNTFYDIVAELGAMEHAQAVDYIKKLMTKGRYSLDVWS

SEQ ID NO: 3563 - protein, 461 aa, unidentified
MATFSRQEFFQQLLQGCLLPTAQQGLDQIWLLLAICLACRLLWRLGLPSYLKHASTVAGGFFSLYHFFQLHMVWVVLLSLLCYLVLFLCRHSSHRGVFLSVTILIYLLMGEMHMVDTVTWHKMRGAQMIVAMKAVSLGFDLDRGEVGTVPSPVEFMGYLYFVGTIVFGPWISFHSYLQAVQGRPLSCRWLQKVARSLALALLCLVLSTCVGPYLFPYFIPLNGDRLLRNKKRKARGTMVRWLRAYESAVSFHFSNYFVGFLSEATATLAGAGFTEEKDHLEWDLTVSKPLNVELPRSMVEVVTSWNLPMSYWLNNYVFKNALRLGTFSAVLVTYAASALLHGFSFHLAAVLLSLAFITYVEHVLRKRLARILSACVLSKRCPPDCSHQHRLGLGVRALNLLFGALAIFHLAYLGSLFDVDVDDTTEEQGYGMAYTVHKWSELSWASHWVTFGCWIFYRLIG

SEQ ID NO: 3564 - protein, 1202 aa, unidentified
MMCEVMPTISEAEGPPGGGGGHGSGSPSQPDADSHFEQLMVSMLEERDRLLDTLRETQETLALTQGKLHEVGHERDSLQRQLNTALPQEFAALTKELNVCREQLLEREEEIAELKAERNNTRLLLEHLECLVSRHERSLRMTVVKRQAQSPAGVSSEVEVLKALKSLFEHHKALDEKVRERLRVALERCSLLEEELGATHKELMILKEQNNQKKTLTDGVLDINHEQENTPSTSGKRSSDGSLSHEEDLAKVIELQEIISKQSREQSQMKERLASLSSHVTELEEDLDTARKDLIKSEEMNTKLQRDVREAMAQKEDMEERITTLEKRYLAAQREATSVHDLNDKLENEIANKDSMHRQTEDKNRQLQERLELAEQKLQQTLRKAETLPEVEAELAQRVAALSKAEERHGNIEERLRQMEAQLEEKNQELQRARQREKMNEEHNKRLSDTVDKLLSESNERLQLHLKERMAALEDKNSLLREVESAKKQLEETQHDKDQLVLNIEALRAELDHMRLRGASLHHGRPHLGSVPDFRFPMADGHTDSYSTSAVLRRPQKGRLAALRDEPSKVQTLNEQDWERAQQASVLANVAQAFESDADVSDGEDDRDTLLSSVDLLSPSGQADAHTLAMMLQEQLDAINKEIRLIQEEKENTEQRAEEIESRVGSGSLDNLGRFRSMSSIPPYPASSLASSSPPGSGRSTPRRIPHSPAREVDRLGVMTLLPPSREEVRDDKTTIKCETSPPSSPRALRLDRLHKGALHTVSHEDIRDIRNSTGSQDGPVSNPSSSNSSQDSLHKAPKKKGIKSSIGRLFGKKEKGRPGQTGKEALGQAGVSETDNSSQDALGLSKLGGQAEKNRKLQKKHELLEEARRQGLPFAQWDGPTVVVWLELWVGMPAWYVAACRANVKSGAIMSALSDTEIQREIGISNPLHRLKLRLAIQEIMSLTSPSAPPTSRTTLAYGDMNHEWIGNEWLPSLGLPQYRSYFMECLVDARMLDHLTKKDLRGQLKMVDSFHRNSFQCGIMCLRRLNYDRKELERKREESQSEIKDVLVWSNDRVIRWILSIGLKEYANNLIESGVHGALLALDETFDFSALALLLQIPTQNTQARAVLEREFNNLLVMGTDRRFDEDDDKSFRRAPSWRKKFRPKDIRGLAAGSAETLPANFRVTSSMSSPSMQPKKMQMDGNVSGTQRLDSATVRTYSC

SEQ ID NO: 3565 - protein, 161 aa, unidentified
MSVTLHTDVGDIKIEVFCERTPKTCENFLALCASNYYNGCIFHRNIKGFMVQTGDPTGTGRGGNSIWGKKFEDEYSEYLKHNVRGVVSMANNGPNTNGSQFFITYGKQPHLDMKYTVFGKVIDGLETLDELEKLPVNEKTYRPLNDVHIKDITIHANPFAQ

SEQ ID NO: 3566 - protein, 360 aa, unidentified
MIEDTMTLLSLLGRIMRYFLLRPETLFLLCISLALWSYFFHTDEVKTIVKSSRDAVKMVKGKVAEIMQNDRLGGLDVLEAEFSKTWEFKNHNVAVYSIQGRRDHMEDRFEVLTDLANKTHPSIFGIFDGHGGETAAEYVKSRLPEALKQHLQDYEKDKENSVLSYQTILEQQILSIDREMLEKLTVSYDEAGTTCLIALLSDKDLTVANVGDSRGVLCDKDGNAIPLSHDHKPYQLKERKRIKRAGGFISFNGSWRVQGILAMSRSLGDYPLKNLNVVIPDPDILTFDLDKLQPEFMILASDGLWDAFSNEEAVRFIKERLDEPHFGAKSIVLQSFYRGCPDNITVMVVKFRNSSKTEEQ

SEQ ID NO: 3567 - protein, 1122 aa, unidentified
MEPSEVPSQISKDNFLEVPNLSDSLCEDEEVTFQPGFSPQPSRRGSDSSEDIYLDTPSSGTRRVSFADSFGFNLVSVKEFDCWELPSASTTFDLGTDIFHTEEYVLAPLFDLPSSKEDLMQQLQIQKAILESTESLLGSTSIKGIIRVLNVSFEKLVYVRMSLDDWQTHYDILAEYVPNSCDGETDQFSFKIVLVPPYQKDGSKVEFCIRYETSVGTFWSNNNGTNYTFICQKKEQEPEPVKPWKEVPNRQIKGCLKVKSSKEESSVTSEENNFENPKNTDTYIPTIICSHEDKEDLEASNRNVKDVNREHDEHNEKELELMINQHLIRTRSTASRDERNTFSTDPVNFPNKAEGLEKKQIHGEICTDLFQRSLSPSSSAESSVKGDFYCNEKYSSGDDCTHQPSEETTSNMGEIKPSLGDTSSDELVQLHTGSKEVLDDNANPAHGNGTVQIPCPSSDQLMAGNLNKKHEGGAKNIEVKDLGCLRRDFHSDTSACLKESTEEGSSKEDYYGNGKDDEEQRIYLGVNEKQRKNFQTILHDQERKMGNPKISVAGIGASNRDLATLLSEHTAIPTRAITADVSHSPRTNLSWEEAVLTPEHHHLTSEGSALGGITGQVCSSRTGNVLRNDYLFQVEEKSGGINSEDQDNSPQHKQSWNVLESQGKSRENKTNITEHIKGQTDCEDVWGKRDNTRSLKATTEELFTCQETVCCELSSLADHGITEKAEAGTAYIIKTTSESTPESMSAREKAIIAKLPQETARSDRPIEVKETAFDPHEGRNDDSHYTLCQRDTVGVIYDNDFEKESRLGICNVRVDEMEKEETMSMYNPRKTHDREKCGTGNITSVEESSWVITEYQKATSKLDLQLGMLPTDKTVFSENRDLRQVQELSKKTDSDAIVHSAFNSDTNRAPQNSSPFSKHHTEISVSTNEQAIAVENAVTTMASQPISTKSENICNSTREIQGIEKHPYPESKPEEVSRSSGIVTSGSRKERCIGQIFQTEEYSVEKSLGPMILINKPLENMEEARHENEGLVSSGQSLYTSGEKESDSSASTSLPVEESQAQGNESLFSKYTNSKIPYFLLFLIFLITVYHYDLMIGLTFYVLSLSWLSWEEGRQKESVKKK

SEQ ID NO: 3568 - protein, 799 aa, unidentified
MARTAPVEPPLRHSAPPSPAAGEPRTSVEAAVAPRRVLFADEALGLPLAQLRRYRPWGGPGAGKMAAAAGQDGGGGGGADEDDDGEDGDEGEEEEEACPEPSPLCPVPAGGGFYLVPTFSLPPAPGRLERLGRVMVELEALLPPPGAVPGGAGVWVPGGRPPVLRGLVRVLNRSFEKAVHVRASHDGWASFCDHPARYVPRSPPWAGAGGTGAGDPILDPGLGLGPGQASASSPDDGGRTDRFAFQLPFAEGAGDGARLDFVVRYETPEGTFWANNHGRNYTVLLRIAPAPTPTDAEGLPQQQQLPQLEPQPECQGPVEAEARQLKSCMKPVRRRPAEEELKTKNMDDNTFAMAEHPDVQESVGPLVAPTPLRPWPQMTLQVSDVPMTGNPAEEGDVPRSSPPVAFTEVLQAPAIRIPPSSPLCGLGGSPRDQASGPDASEGATGPFLEPSQQQAEATWGVSSENGGGLEAVSGSEELLGEDTIDQELEQLYLSHLSRLRAAVAAGGAGGGGEGSTDGGMSPSHPLGILTDRDLILKWPGPERALNSALAEEITLHYARLGRGVELIKDTEDPDDEGEGEEGLSVTPSSPEGDSPKESPPEILSGARSVVATMGDVWLPWAEGSGCDGPVVLGTEGQFIGDPEKGMGKDTSSLHMNRVIAGVTESLGEAGTEAQIEVTSEWAGSLDPISGKEPASPVLLQGQNPTLLSPLGAEVCLSSVARPHVSSQDEKDAGPSLEPPKKSPTLAVPAECVCALPPQLRGPLTQTLGVLAGLVVVPVALNSGVSLLVLALCLSLAWFS

SEQ ID NO: 3569 - protein, 291 aa, unidentified
MVWKKLGSRNFSSCPSGSIQWIWDVLGECAQDGWDEASVGLGLISILCFAASTFPQFIKAYKTGNMDQALSLWFLLGWIGGDSCNLIGSFLADQLPLQTYTAVYYVLADLVMLTLYFYYKFRTRPSLLSAPINSVLLFLMGMACATPLLSAAGPVAAPREAFRGRALLSVESGSKPFTRQEVIGFVIGSISSVLYLLSRLPQIRTNFLRKSTQGISYSLFALVMLGNTLYGLSVLLKNPEEGQSEGSYLLHHLPWLVGSLGVLLLDTIISIQFLVYRRSTAASELEPLLPS

SEQ ID NO: 3570 - protein, 135 aa, unidentified
MKVVGNYRVNTANSSTDTSGEHLTCLRSQLFVAYRNGRVDEAVSLGFLDCWIGGDLTNFKGCYLTNQLPIQIFTAIFDMNTDVIILSQFMYYRLKNQKKKMIFQPQLFKDSITREKVRLSLWGVLCPVYIPYSFR

SEQ ID NO: 3571 - protein, 202 aa, unidentified
MEAALLGLCNWSTLGVCAALKLPQISAVLAARSARGLSLPSLLLELAGFLVFLRYQCYYGYPPLTYLEYPILIAQDVILLLCIFHFNGNVKQATPYIAVLVSSWFILALQKWIIDLAMNLCTFISAASKFAQLQCLWKTRDSGTVSALTWSLSSYTCATRIITTLMTTNDFTILLRFVIMLALNIWVTVTVLRYRKTAIKAE

SEQ ID NO: 3572 - protein, 178 aa, unidentified
MSEVRLPPLRALDDFVLGSARLAAPDPCDPQRWCHRVINNLLYYQTNYLLCFGIGLALAGYVRPLHTLLSALVVAVALGVLVWAAETRAAVRRCRRSHPAACLAAVLAVGLLVLWVAGGACTFLFSIAGPVLLILVHASLRLRNLKNKIENKIESIGLKRTPMGLLLEALGQEQEAGS

SEQ ID NO: 3573 - protein, 417 aa, unidentified
MGRRRAPELYRAPFPLYALQVDPSTGLLIAAGGGGAAKTGIKNGVHFLQLELINGRLSASLLHSHDTETRATMNLALAGDILAAGQDAHCQLLRFQAHQQQGNKAEKAGSKEQGPRQRKGAAPAEKKCGAETQHEGLELRVENLQAVQTDFSSDPLQKVVCFNHDNTLLATGGTDGYVRVWKVPSLEKVLEFKAHEGEIEDLALGPDGKLVTVGRDLKASVWQKDQLVTQLHWQENGPTFSSTPYRYQACRFGQVPDQPAGLRLFTVQIPHKRLRQPPPCYLTAWDGSNFLPLRTKSCGHEVVSCLDVSESGTFLGLGTVTGSVAIYIAFSLQCLYYVREAHGIVVTDVAFLPEKGRGPELLGSHETALFSVAVDSRCQLHLLPSRRSVPVWLLLLLCVGLIIVTILLLQSAFPGFL

SEQ ID NO: 3574 - protein, 153 aa, unidentified
MLLRDLVLRRGCCWSSLLLHCALHPLWGFVQVTHGEPQKSCSKVTDSCRHVCQCRPPPPLPPPPPPPPPPRLLSAPAPNSTSCPTEESWWSGLVIIIAVCCASLVFLTVLVIICYKAIKRKPLRKDENGTSVAEYPMSASQSNKGVDVNNAVV

SEQ ID NO: 3575 - protein, 552 aa, unidentified
MAEKQKHDGRVKIGHYVLGDTLGVGTFGKVKIGEHQLTGHKVAVKILNRQKIRSLDVVGKIKREIQNLKLFRHPHIIKLYQVISTPTDFFMVMEYVSGGELFDYICKHGRVEEMEARRLFQQILSAVDYCHRHMVVHRDLKPENVLLDAHMNAKIADFGLSNMMSDGEFLRTSCGSPNYAAPEVISGRLYAGPEVDIWSCGVILYALLCGTLPFDDEHVPTLFKKIRGGVFYIPEYLNRSVATLLMHMLQVDPLKRATIKDIREHEWFKQDLPSYLFPEDPSYDANVIDDEAVKEVCEKFECTESEVMNSLYSGDPQDQLAVAYHLIIDNRRIMNQASEFYLASSPPSGSFMDDSAMHIPPGLKPHPERMPPLIADSPKARCPLDALNTTKPKSLAVKKAKWHLGIRSQSKPYDIMAEVYRAMKQLDFEWKVVNAYHLRVRRKNPVTGNYVKMSLQLYLVDNRSYLLDFKSIDDEVVEQRSGSSTPQRSCSAAGLHRPRSSFDSTTAESHSLSGSLTGSLTGSTLSSVSPRLGSHTMDFFEMCASLITTLAR

SEQ ID NO: 3576 - protein, 370 aa, unidentified
MASSTTRGPRVSDLFSGLPPAVTTPANQSAEASAGNGSVAGADAPAVTPFQSLQLVHQLKGLIVLLYSVVVVVGLVGNCLLVLVIARVRRLHNVTNFLIGNLALSDVLMCTACVPLTLAYAFEPRGWVFGGGLCHLVFFLQPVTVYVSVFTLTTIAVDRYVVLVHPLRRRISLRLSAYAVLAIWALSAVLALPAAVHTYHVELKPHDVRLCEEFWGSQERQRQLYAWGLLLVTYLLPLLVILLSYVRVSVKLRNRVVPGCVTQSQADWDRARRRRTFCLLVVIVVVFAVCWLPLHVFNLLRDLDPHAIDPYAFGLVQLLCHWLAMSSACYNPFIYAWLHDSFREELRKLLVAWPRKIAPHGQNMTVSVVI

SEQ ID NO: 3577 - protein, 622 aa, unidentified
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEKGKSEELLSALGCQDFPPTSDYEDLLVEYLEVDDSEDQHLMSVHSKEHPSQGMKPTYLDPDTDSGRGSCDSPSLLSEKCEEPQANPSTFYDPEVIEKPENPETTHTWDPQCISMEGKIPYFHAGGSKCSTWPLPQPSQHNPRSSYHNITDVCELAVGPAGAPATLLNEAGKDALKSSQTIKSREEGKATQQREVESFHSETDQDTPWLLPQEKTPFGSAKPLDYVEIHKVNKDGALSLLPKQRENSGKPKKPGTPENNKEYAKVSGVMDNNILVLVPDPHAKNVACFEESAKEAPPSLEQNQAEKALANFTATSSKCRLQLGGLDYLDPACFTHSFH

SEQ ID NO: 3578 - protein, 176 aa, unidentified
MRKHLSWWWLATVCMLLFSHLSAVQTRGIKHRIKWNRKALPSTAQITEAQVAENRPGAFIKQGRKLDIDFGAEGNRYYEANYWQFPDGIHYNGCSEANVTKEAFVTGCINATQAANQGEFQKPDNKLHQQVLWRLVQELCSLKHCEFWLERGAGLRVTMHQPVLLCLLALIWLTVK

SEQ ID NO: 3579 - protein, 253 aa, unidentified
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPVILLISFLIFLIVG

SEQ ID NO: 3580 - protein, 238 aa, unidentified
MLTTLLPILLLSGWAFCSQDASDGLQRLHMLQISYFRDPYHVWYQGNASLGGHLTHVLEGPDTNTTIIQLQPLQEPESWARTQSGLQSYLLQFHGLVRLVHQERTLAFPLTIRCFLGCELPPEGSRAHVFFEVAVNGSSFVSFRPERALWQADTQVTSGVVTFTLQQLNAYNRTRYELREFLEDTCVQYVQKHISAENTKGSQTSRSYTSLVLGVLVGSFIIAGVAVGIFLCTGGRRC

SEQ ID NO: 3581 - protein, 393 aa, unidentified
METTMGFMDDNATNTSTSFLSVLNPHGAHATSFPFNFSYSDYDMPLDEDEDVTNSRTFFAAKIVIGMALVGIMLVCGIGNFIFIAALVRYKKLRNLTNLLIANLAISDFLVAIVCCPFEMDYYVVRQLSWEHGHVLCTSVNYLRTVSLYVSTNALLAIAIDRYLAIVHPLRPRMKCQTATGLIALVWTVSILIAIPSAYFTTETVLVIVKSQEKIFCGQIWPVDQQLYYKSYFLFIFGIEFVGPVVTMTLCYARISRELWFKAVPGFQTEQIRKRLRCRRKTVLVLMCILTAYVLCWAPFYGFTIVRDFFPTVFVKEKHYLTAFYIVECIAMSNSMINTLCFVTVKNDTVKYFKKIMLLHWKASYNGGKSSADLDLKTIGMPATEEVDCIRLK

SEQ ID NO: 3582 - protein, 384 aa, unidentified
MAAQNGNTSFTPNFNPPQDHASSLSFNFSYGDYDLPMDEDEDMTKTRTFFAAKIVIGIALAGIMLVCGIGNFVFIAALTRYKKLRNLTNLLIANLAISDFLVAIICCPFEMDYYVVRQLSWEHGHVLCASVNYLRTVSLYVSTNALLAIAIDRYLAIVHPLKPRMNYQTASFLIALVWMVSILIAIPSAYFATETVLFIVKSQEKIFCGQIWPVDQQLYYKSYFLFIFGVEFVGPVVTMTLCYARISRELWFKAVPGFQTEQIRKRLRCRRKTVLVLMCILTAYVLCWAPFYGFTIVRDFFPTVFVKEKHYLTAFYVVECIAMSNSMINTVCFVTVKNNTMKYFKKMMLLHWRPSQRGSKSSADLDLRTNGVPTTEEVDCIRLK

SEQ ID NO: 3583 - protein, 865 aa, unidentified
MALVLGSLLLLGLCGNSFSGGQPSSTDAPKAWNYELPATNYETQDSHKAGPIGILFELVHIFLYVVQPRDFPEDTLRKFLQKAYESKIDYDKPETVILGLKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNMENGNNGYHKDHVYGIHNPVMTSPSQH

SEQ ID NO: 3584 - protein, 834 aa, unidentified
MKHTLALLAPLLGLGLGLALSQLAAGATDCKFLGPAEHLTFTPAARARWLAPRVRAPGLLDSLYGTVRRFLSVVQLNPFPSELVKALLNELASVKVNEVVRYEAGYVVCAVIAGLYLLLVPTAGLCFCCCRCHRRCGGRVKTEHKALACERAALMVFLLLTTLLLLIGVVCAFVTNQRTHEQMGPSIEAMPETLLSLWGLVSDVPQELQAVAQQFSLPQEQVSEELDGVGVSIGSAIHTQLRSSVYPLLAAVGSLGQVLQVSVHHLQTLNATVVELQAGQQDLEPAIREHRDRLLELLQEARCQGDCAGALSWARTLELGADFSQVPSVDHVLHQLKGVPEANFSSMVQEENSTFNALPALAAMQTSSVVQELKKAVAQQPEGVRTLAEGFPGLEAASRWAQALQEVEESSRPYLQEVQRYETYRWIVGCVLCSVVLFVVLCNLLGLNLGIWGLSARDDPSHPEAKGEAGARFLMAGVGLSFLFAAPLILLVFATFLVGGNVQTLVCQSWENGELFEFADTPGNLPPSMNLSQLLGLRKNISIHQAYQQCKEGAALWTVLQLNDSYDLEEHLDINQYTNKLRQELQSLKVDTQSLDLLSSAARRDLEALQSSGLQRIHYPDFLVQIQRPVVKTSMEQLAQELQGLAQAQDNSVLGQRLQEEAQGLRNLHQEKVVPQQSLVAKLNLSVRALESSAPNLQLETSDVLANVTYLKGELPAWAARILRNVSECFLAREMGYFSQYVAWVREEVTQRIATCQPLSGALDNSRVILCDMMADPWNAFWFCLAWCTFFLIPSIIFAVKTSKYFRPIRKRLSSTSSEETQLFHIPRVTSLKL

SEQ ID NO: 3585 - protein, 676 aa, unidentified
MRVLGGRCGALLACLLLVLPVSEANFLSKQQASQVLVRKRRANSLLEETKQGNLERECIEELCNKEEAREVFENDPETDYFYPKYLVCLRSFQTGLFTAARQSTNAYPDLRSCVNAIPDQCSPLPCNEDGYMSCKDGKASFTCTCKPGWQGEKCEFDINECKDPSNINGGCSQICDNTPGSYHCSCKNGFVMLSNKKDCKDVDECSLKPSICGTAVCKNIPGDFECECPEGYRYNLKSKSCEDIDECSENMCAQLCVNYPGGYTCYCDGKKGFKLAQDQKSCEVVSVCLPLNLDTKYELLYLAEQFAGVVLYLKFRLPEISRFSAEFDFRTYDSEGVILYAESIDHSAWLLIALRGGKIEVQLKNEHTSKITTGGDVINNGLWNMVSVEELEHSISIKIAKEAVMDINKPGPLFKPENGLLETKVYFAGFPRKVESELIKPINPRLDGCIRSWNLMKQGASGIKEIIQEKQNKHCLVTVEKGSYYPGSGIAQFHIDYNNVSSAEGWHVNVTLNIRPSTGTGVMLALVSGNNTVPFAVSLVDSTSEKSQDILLSVENTVIYRIQALSLCSDQQSHLEFRVNRNNLELSTPLKIETISHEDLQRQLAVLDKAMKAKVATYLGGLPDVPFSATPVNAFYNGCMEVNINGVQLDLDEAISKHNDIRAHSCPSVWKKTKNS

SEQ ID NO: 3586 - protein, 346 aa, unidentified
MALLKVKFDQKKRVKLAQGLWLMNWFSVLAGIIIFSLGLFLKIELRKRSDVMNNSESHFVPNSLIGMGVLSCVFNSLAGKICYDALDPAKYARWKPWLKPYLAICVLFNIILFLVALCCFLLRGSLENTLGQGLKNGMKYYRDTDTPGRCFMKKTIDMLQIEFKCCGNNGFRDWFEIQWISNRYLDFSSKEVKDRIKSNVDGRYLVDGVPFSCCNPSSPRPCIQYQITNNSAHYSYDHQTEELNLWVRGCRAALLSYYSSLMNSMGVVTLLIWLFEVTITIGLRYLQTSLDGVSNPEESESESEGWLLEKSVPETWKAFLESVKKLGKGNQVEAEGAGAGQAPEAG

SEQ ID NO: 3587 - protein, 445 aa, unidentified
MMEESGIETTPPGTPPPNPAGLAATAMSSTPVPLAATSSFSSPNVSSMESFPPLAYSTPQPPLPPVRPSAPLPFVPPPAVPSVPPLVTSMPPPVSPSTAAAFGNPPVSHFPPSTSAPNTLLPAPPSGPPISGFSVGSTYDITRGHAGRAPQTPLMPSFSAPSGTGLLPTPITQQASLTSLAQGTGTTSAITFPEEQEDPRITRGQDEASAGGIWGFIKGVAGNPMVKSVLDKTKHSVESMITTLDPGMAPYIKSGGELDIVVTSNKEVKVAAVRDAFQEVFGLAVVVGEAGQSNIAPQPVGYAAGLKGAQERIDSLRRTGVIHEKQTAVSVENFIAELLPDKWFDIGCLVVEDPVHGIHLETFTQATPVPLEFVQQAQSLTPQDYNLRWSGLLVTVGEVLEKSLLNVSRTDWHMAFTGMSRRQMIYSAARAIAGMYKQRLPPRTV

SEQ ID NO: 3588 - protein, 218 aa, unidentified
MGRVFLTGEKANSILKRYPRANGFFEEIRQGNIERECKEEFCTFEEAREAFENNEKTKEFWSTYTKAQQGESNRGSDWFQFYLTFPLIFGLFIILLVIFLIWRCFLRNKTRRQTVTEGHIPFPQHLNIITPPPPPDEVFDSSGLSPGFLGYVVGRSDSVSTRLSNCDPPPTYEEATGQVNLQRSETEPHLDPPPEYEDIVNSNSASAIPMVPVVTTIK

SEQ ID NO: 3589 - protein, 202 aa, unidentified
MRGHPSLLLLYMALTTCLDTSPSEETDQEVFLGPPEAQSFLSSHTRIPRANHWDLELLTPGNLERECLEERCSWEEAREYFEDNTLTERFWESYIYNGKGGRGRVDVASLAVGLTGGILLIVLAGLGAFWYLRWRQHRGQQPCPQEAGLISPLSPLNPLGPPTPLPPPPPPPPGLPTYEQALAASGVHDAPPPPYTSLRRPH

SEQ ID NO: 3590 - protein, 231 aa, unidentified
MAVFLEAKDAHSVLKRFPRANEFLEELRQGTIERECMEEICSYEEVKEVFENKEKTMEFWKGYPNAVYSVRDPSQSSDAMYVVVPLLGVALLIVIALFIIWRCQLQKATRHHPSYAQNRYLASRAGHTLPRVMVYRGTVHSQGEPSGHREAANSPQVVLGPSRGGRTTVRLESTLYLPELSLSRLSSTTPPPSYEEVTAPQESSSEEASVSYSDPPPKYEEIVAANPGADK

SEQ ID NO: 3591 - protein, 226 aa, unidentified
MFTLLVLLSQLPTVTLGFPHCARGPKASKHAGEEVFTSKEEANFFIHRRLLYNRFDLELFTPGNLERECNEELCNYEEAREIFVDEDKTIAFWQEYSAKGPTTKSDGNREKIDVMGLLTGLIAAGVFLVIFGLLGYYLCITKCNRLQHPCSSAVYERGRHTPSIIFRRPEEAALSPLPPSVEDAGLPSYEQAVALTRKHSVSPPPPYPGHTKGFRVFKKSMSLPSH

SEQ ID NO: 3592 - protein, 306 aa, unidentified
MSSEKSGLPDSVPHTSPPPYNAPQPPAEPPAPPPQAAPSSHHHHHHHYHQSGTATLPRLGAGGLASSAATAQRGPSSSATLPRPPHHAPPGPAAGAPPPGCATLPRMPPDPYLQETRFEGPLPPPPPAAAAPPPPAPAQTAQAPGFVVPTHAGTVGTLPLGGYVAPGYPLQLQPCTAYVPVYPVGTPYAGGTPGGTGVTSTLPPPPQGPGLALLEPRRPPHDYMPIAVLTTICCFWPTGIIAIFKAVQVRTALARGDMVSAEIASREARNFSFISLAVGIAAMVLCTILTVVIIIAAQHHENYWDP

SEQ ID NO: 3593 - protein, 340 aa, unidentified
MAASSSEISEMKGVEESPKVPGEGPGHSEAETGPPQVLAGVPDQPEAPQPGPNTTAAPVDSGPKAGLAPETTETPAGASETAQATDLSLSPGGESKANCSPEDPCQETVSKPEVSKEATADQGSRLESAAPPEPAPEPAPQPDPRPDSQPTPKPALQPELPTQEDPTPEILSESVGEKQENGAVVPLQAGDGEEGPAPEPHSPPSKKSPPANGAPPRVLQQLVEEDRMRRAHSGHPGSPRGSLSRHPSSQLAGPGVEGGEGTQKPRDYIILAILSCFCPMWPVNIVAFAYAVMSRNSLQQGDVDGAQRLGRVAKLLSIVALVGGVLIIIASCVINLGVYK

SEQ ID NO: 3594 - protein, 981 aa, unidentified
MASSPWGCVCGLLLLLLPLLGTGPALGRGFPRPLENSEIPMIPGAHPKGSVGSEPQAFDVFPENPRADSHRNSDVRHAPAEEMPEKPVASPLGPALYGPKAAQGAQRERLPVTDDLQMAQGPSSHGWTGPLDSQELLQQEAVAPHPVGHPHLTFIPTTPRRQLRVATVPPSLQHEGQEGQWPPRDEGLKAKTKSRVPPTSPSDHQGPPHTLVSHSGTVKRPVLEGQGGFEEHLQEAAQGPHFTQQDPAAPDVGSVPPVEVVYSQEPGAQPDLALARSLPPAEELPVETPKRAGAEVSWEVSSPGPPPKQADLPDAKDSPGPQPTDPPASEAPDRPSKPERAAMNGADPISPQRVRGAVEAPGTPKSLIPGPSDPGPAVNRTESPMGALQPDEAEEWPGRPQSHPPAPPVQAPSTSRRGLIRVTTQRALGQPPPPEPTASSMASAPASSPPANATAPPLRWGPLRRVLSFSWELHVYGVGVLFLLPALLALAALAAAPAGPRLALVAAVLVLVASALRSAYMLTDPYGSQARLGVRGGLVLYNLPFPLLLTALAALTLLGLGAGLPPPLQNPLLLGAVALVHGVGLLATDLLSTWSVLNLLTQGLSCAWGAAVALGTLCLCRRRLLDGPRGWDASPGPRLLAVAGALGLLASGLQLAAALWLYPGPGRVGRFSWAWWGVHFWLRLLELTWALALALAAVAAARPRPPTEHACWAKLMRLACPAPSGKSEVPERPNNCYAGPSNVGAGSLDISKSLIRNPAESGQLATPSSGAWGSAASLGRGPQGGPGLSRNGVGPAPSLSELDLRPPSPINLSRSIDAALFREHLVRDSVFQRCGLRGLASPPPGGALRPRRGSHPKAELDDAGSSLLRGRCRSLSDVRVRGPVPQHVVEAPDGAAAAASGSSLDSFSRGSLKISWNPWRHGLSSVDSLPLDELPSTVQLLPAPTPAPDSTAARQGDGQGEVQPRGKPGESRSASSDTIEL

SEQ ID NO: 3595 - protein, 899 aa, unidentified
MARHGCLGLGLFCCVLFAATVGPQPTPSIPGAPATTLTPVPQSEASMLSLNLGLNFKFHLRGPAAVWGSPVTETQPLSLGPGQEPGEEVASGLRTDPLWELLVGSSGNSLTEWGSTEGGSKPRASSLLPESTSRRSGPSDGPTAPYQPRRSTVTWDTALMVTALPSSAPRPHQSELELKFDMALRAGAAPTLGHRTLPLLPSLRASLAEIAGRLGPFGFFGTTLSPLRNFSGLSPPGETTSTSSASGVSGSLGFLGTTLSLPPYSLERKLSSPSPLDPAASLSFASIATTSLDPTVPISGPDDLSPPASLGNPSGQPECGPGSCSVGELPEREGQPPEAPRPLFFLTLEADWAEARARWGLAWEAHVYGVGALFGLVALLALLALALLPWRCPPGAPCLALLDLLLLSAGTTRAFPLFYDAYGHRDRLPALAWLLLQDLPLPCLAAGLGLACLLLARPRPPRCPTGLAALLLLGLGLAAAAALGSAAHRPLRPLRLASRGLHAFLAAFLSGLLLALSCWGGRRRRAGAPLGGSGFKGATPLPQGRSPFAPRESWRRAARTAPVAGTFGLLSGALQGYEVLHALGYGGQSGLEGPWPWWAFQLGLRLGEVGVALPLALLGLYPALCSPRVPPRCWAKLFRLSPGHAAPLLPGGWVTGPPDKEPLGSAIARGDAELLQLCALAGPGPDLLLQGGGCRGFEGAAANPAPSPASSPCSDYTVDFRPPSPINLRRSIEEALCSEALLAPGLFQGPAFEDALPGLGLYRTASLGTGGRASERSGEASGPAAPPELPSPGAWPAGSSVSSGSFCGLSRDSSSMLLCSSPDRPPRCPLVCVLSPPRPSGSSPSLPASGSYQALSPPSRDSPEPASELQAEEALLQEQFLDACRQIDELSVGSDTIDL

SEQ ID NO: 3596 - protein, 328 aa, unidentified
MGPAGCAFTLLLLLGISVCGQPVYSSRVVGGQDAAAGRWPWQVSLHFDHNFICGGSLVSERLILTAAHCIQPTWTTFSYTVWLGSITVGDSRKRVKYYVSKIVIHPKYQDTTADVALLKLSSQVTFTSAILPICLPSVTKQLAIPPFCWVTGWGKVKESSDRDYHSALQEAEVPIIDRQACEQLYNPIGIFLPALEPVIKEDKICAGDTQNMKDSCKGDSGGPLSCHIDGVWIQTGVVSWGLECGKSLPGVYTNVIYYQKWINATISRANNLDFSDFLFPIVLLSLALLRPSCAFGPNTIHRVGTVAEAVACIQGWEENAWRFSPRGR

SEQ ID NO: 3597 - protein, 343 aa, unidentified
MAQKGVLGPGQLGAVAILLYLGLLRSGTGAEGAEAPCGVAPQARITGGSSAVAGQWPWQVSITYEGVHVCGGSLVSEQWVLSAAHCFPSEHHKEAYEVKLGAHQLDSYSEDAKVSTLKDIIPHPSYLQEGSQGDIALLQLSRPITFSRYIRPICLPAANASFPNGLHCTVTGWGHVAPSVSLLTPKPLQQLEVPLISRETCNCLYNIDAKPEEPHFVQEDMVCAGYVEGGKDACQGDSGGPLSCPVEGLWYLTGIVSWGDACGARNRPGVYTLASSYASWIQSKVTELQPRVVPQTQESQPDSNLCGSHLAFSSAPAQGLLRPILFLPLGLALGLLSPWLSEH

SEQ ID NO: 3598 - protein, 1150 aa, unidentified
MAPPLRPLARLRPPGMLLRALLLLLLLSPLPGVWCFSELSFVKEPQDVTVTRKDPVVLDCQAHGEVPIKVTWLKNGAKMSENKRIEVLSNGSLYISEVEGRRGEQSDEGFYQCLAMNKYGAILSQKAHLALSTISAFEVQPISTEVHEGGVARFACKISSHPPAVITWEFNRTTLPMTMDRITALPTGVLQIYDVSQRDSGNYRCIAATVAHRRKSMEASLTVIPAKESKSFHTPTIIAGPQNITTSLHQTVVLECMATGNPKPIISWSRLDHKSIDVFNTRVLGNGNLMISDVRLQHAGVYVCRATTPGTRNFTVAMATLTVLAPPSFVEWPESLTRPRAGTARFVCQAEGIPSPKMSWLKNGRKIHSNGRIKMYNSKLVINQIIPEDDAIYQCMAENSQGSILSRARLTVVMSEDRPSAPYNVHAETMSSSAILLAWERPLYNSDKVIAYSVHYMKAEGLNNEEYQVVIGNDTTHYIIDDLEPASNYTFYIVAYMPMGASQMSDHVTQNTLEDVPLRPPEISLTSRSPTDILISWLPIPAKYRRGQVVLYRLSFRLSTENSIQVLELPGTTHEYLLEGLKPDSVYLVRITAATRVGLGESSVWTSHRTPKATSVKAPKSPELHLEPLNCTTISVRWQQDVEDTAAIQGYKLYYKEEGQQENGPIFLDTKDLLYTLSGLDPRRKYHVRLLAYNNIDDGYQADQTVSTPGCVSVRDRMVPPPPPPHHLYAKANTSSSIFLHWRRPAFTAAQIINYTIRCNPVGLQNASLVLYLQTSETHMLVQGLEPNTKYEFAVRLHVDQLSSPWSPVVYHSTLPEAPAGPPVGVKVTLIEDDTALVSWKPPDGPETVVTRYTILYASRKAWIAGEWQVLHREGAITMALLENLVAGNVYIVKISASNEVGEGPFSNSVELAVLPKETSESNQRPKRLDSADAKVYSGYYHLDQKSMTGIAVGVGIALTCILICVLILIYRSKARKSSASKTAQNGTQQLPRTSASLASGNEVGKNLEGAVGNEESLMPMIMPNSFIDAKGGTDLIINSYGPIIKNNSKKKWFFFQDSKKIQVEQPQRRFTPAVCFYQPGTTVLISDEDSPSSPGQTTSFSRPFGVAADTEHSANSEGSHETGDSGRFSHESNDEIHLSSVISTTPPNL

SEQ ID NO: 3599 - protein, 3088 aa, unidentified
MEEFLQRAKSKLNRSKRLEKVHVVIGPKSCDLDSLISTFTYAYFLDKVSPPGVLCLPVLNIPRTEFNYFTETRFILEELNISESFHIFRDEINLHQLNDEGKLSITLVGSSVLASEDKTLESAVVKVINPVEQSDANVEFRESSSSLVLKEILQEAPELITEQLAHRLRGSILFKWMTMESEKISEKQEEILSILEEKFPNLPPREDIINVLQETQFSAQGLSIEQTMLKDLKELSDGEIKVAISTVSMNLENCLFHSNITSDLKAFTDKFGFDVLILFSSYLSEEQQPRRQIAVYSENMELCSQICCELEECQNPCLELEPFDCGCDEILVYQQEDPSVTCDQVVLVVKEVINRRCPEMVSNSRTSSTEAVAGSAPLSQGSSGIMELYGSDIEPQPSSVNFIENPPDLNDSNQAQVDANVDLVSPDSGLATIRSSRSSKESSVFLSDDSPVGEGAGPHHTLLPGLDSYSPIPEGAVAEEHAWSGEHGEHFDLFNFDPAPMASGQSQQSSHSADYSPADDFFPNSDLSEGQLPAGPEGLDGMGTNMSNYSSSSLLSGAGKDSLVEHDEEFVQRQDSPRDNSERNLSLTDFVGDESPSPERLKNTGKRIPPTPMNSLVESSPSTEEPASLYTEDMTQKATDTGHMGPPQTHARCSSWWGGLEIDSKNIADAWSSSEQESVFQSPESWKEHKPSSIDRRASDSVFQPKSLEFTKSGPWESEFGQPELGSNDIQDKNEESLPFQNLPMEKSPLPNTSPQGTNHLIEDFASLWHSGRSPTAMPEPWGNPTDDGEPAAVAPFPAWSAFGKEDHDEALKNTWNLHPTSSKTPSVRDPNEWAMAKSGFAFSSSELLDNSPSEINNEAAPEIWGKKNNDSRDHIFAPGNPSSDLDHTWTNSKPPKEDQNGLVDPKTRGKVYEKVDSWNLFEENMKKGGSDVLVPWEDSFLSYKCSDYSASNLGEDSVPSPLDTNYSTSDSYTSPTFAGDEKETEHKPFAKEEGFESKDGNSTAEETDIPPQSLQQSSRNRISSGPGNLDMWASPHTDNSSEINTTHNLDENELKTEHTDGKNISMEDDVGESSQSSYDDPSMMQLYNETNRQLTLLHSSTNSRQTAPDSLDLWNRVILEDTQSTATISDMDNDLDWDDCSGGAAIPSDGQTEGYMAEGSEPETRFTVRQLEPWGLEYQEANQVDWELPASDEHTKDSAPSEHHTLNEKSGQLIANSIWDSVMRDKDMSSFMLPGSSHITDSEQRELPPEIPSHSANVKDTHSPDAPAASGTSESEALISHLDKQDTERETLQSDAASLATRLENPGYFPHPDPWKGHGDGQSESEKEAQGATDRGHLDEEEVIASGVENASGISEKGQSDQELSSLVASEHQEICIKSGKISSLAVTFSPQTEEPEEVLEYEEGSYNLDSRDVQTGMSADNLQPKDTHEKHLMSQRNSGETTETSDGMNFTKYVSVPEKDLEKTEECNFLEPENVGGGPPHRVPRSLDFGDVPIDSDVHVSSTCSEITKNLDVKGSENSLPGAGSSGNFDRDTISSEYTHSSASSPELNDSSVALSSWGQQPSSGYQEENQGNWSEQNHQESELITTDGQVEIVTKVKDLEKNRINEFEKSFDRKTPTFLEIWNDSVDGDSFSSLSSPETGKYSEHSGTHQESNLIASYQEKNEHDISATVQPEDARVISTSSGSDDDSVGGEESIEEEIQVANCHVAEDESRAWDSLNESNKFLVTADPKSENIYDYLDSSEPAENENKSNPFCDNQQSSPDPWTFSPLTETEMQITAVEKEKRSSPETGTTGDVAWQISPKASFPKNEDNSQLEMLGFSADSTEWWKASPQEGRLIESPFERELSDSSGVLEINSSVHQNASPWGVPVQGDIEPVETHYTNPFSDNHQSPFLEGNGKNSHEQLWNIQPRQPDPDADKFSQLVKLDQIKEKDSREQTFVSAAGDELTPETPTQEQCQDTMLPVCDHPDTAFTHAEENSCVTSNVSTNEGQETNQWEQEKSYLGEMTNSSIATENFPAVSSPTQLIMKPGSEWDGSTPSEDSRGTFVPDILHGNFQEGGQLASAAPDLWIDAKKPFSLKADGENPDILTHCEHDSNSQASDSPDICHDSEAKQETEKHLSACMGPEVESSELCLTEPEIDEEPIYEPGREFVPSNAELDSENATVLPPIGYQADIKGSSQPASHKGSPEPSEINGDNSTGLQVSEKGASPDMAPILEPVDRRIPRIENVATSIFVTHQEPTPEGDGSWISDSFSPESQPGARALFDGDPHLSTENPALVPDALLASDTCLDISEAAFDHSFSDASGLNTSTGTIDDMSKLTLSEGHPETPVDGDLGKQDICSSEASWGDFEYDVMGQNIDEDLLREPEHFLYGGDPPLEEDSLKQSLAPYTPPFDLSYLTEPAQSAETIEEAGSPEDESLGCRAAEIVLSALPDRRSEGNQAETKNRLPGSQLAVLHIREDPESVYLPVGAGSNILSPSNVDWEVETDNSDLPAGGDIGPPNGASKEISELEEEKTIPTKEPEQIKSEYKEERCTEKNEDRHALHMDYILVNREENSHSKPETCEERESIAELELYVGSKETGLQGTQLASFPDTCQPASLNERKGLSAEKMSSKSDTRSSFESPAQDQSWMFLGHSEVGDPSLDARDSGPGWSGKTVEPFSELGLGEGPQLQILEEMKPLESLALEEASGPVSQSQKSKSRGRAGPDAVTLQAVTHDNEWEMLSPQPVQKNMIPDTEMEEETEFLELGTRISRPNGLLSEDVGMDIPFEEGVLSPSAADMRPEPPNSLDLNDTHPRRIKLTAPNINLSLDQSEGSILSDDNLDSPDEIDINVDELDTPDEADSFEYTGHDPTANKDSGQESESIPEYTAEEEREDNRLWRTVVIGEQEQRIDMKVIEPYRRVISHGGYYGDGLNAIIVFAACFLPDSSRADYHYVMENLFLYVISTLELMVAEDYMIVYLNGATPRRRMPGLGWMKKCYQMIDRRLRKNLKSFIIVHPSWFIRTILAVTRPFISSKFSSKIKYVNSLSELSGLIPMDCIHIPESIIKLDEELREASEAAKTSCLYNDPEMSSMEKDIDLKLKEKP

SEQ ID NO: 3600 - protein, 467 aa, unidentified
MTELPAPLSYFQNAQMSEDNHLSNTVRSQNDNRERQEHNDRRSLGHPEPLSNGRPQGNSRQVVEQDEEEDEELTLKYGAKHVIMLFVPVTLCMVVVVATIKSVSFYTRKDGQLIYTPFTEDTETVGQRALHSILNAAIMISVIVVMTILLVVLYKYRCYKVIHAWLIISSLLLLFFFSFIYLGEVFKTYNVAVDYITVALLIWNFGVVGMISIHWKGPLRLQQAYLIMISALMALVFIKYLPEWTAWLILAVISVYDLVAVLCPKGPLRMLVETAQERNETLFPALIYSSTMVWLVNMAEGDPEAQRRVSKNSKYNAESTERESQDTVAENDDGGFSEEWEAQRDSHLGPHRSTPESRAAVQELSSSILAGEDPEERGVKLGLGDFIFYSVLVGKASATASGDWNTTIACFVAILIGLCLTLLLLAIFKKALPALPISITFGLVFYFATDYLVQPFMDQLAFHQFYI

SEQ ID NO: 3601 - protein, 448 aa, unidentified
MLTFMASDSEEEVCDERTSLMSAESPTPRSCQEGRQGPEDGENTAQWRSQENEEDGEEDPDRYVCSGVPGRPPGLEEELTLKYGAKHVIMLFVPVTLCMIVVVATIKSVRFYTEKNGQLIYTPFTEDTPSVGQRLLNSVLNTLIMISVIVVMTIFLVVLYKYRCYKFIHGWLIMSSLMLLFLFTYIYLGEVLKTYNVAMDYPTLLLTVWNFGAVGMVCIHWKGPLVLQQAYLIMISALMALVFIKYLPEWSAWVILGAISVYDLVAVLCPKGPLRMLVETAQERNEPIFPALIYSSAMVWTVGMAKLDPSSQGALQLPYDPEMEEDSYDSFGEPSYPEVFEPPLTGYPGEELEEEEERGVKLGLGDFIFYSVLVGKAAATGSGDWNTTLACFVAILIGLCLTLLLLAVFKKALPALPISITFGLIFYFSTDNLVRPFMDTLASHQLYI

SEQ ID NO: 3602 - protein, 101 aa, unidentified
MNLERVSNEEKLNLCRKYYLGGFAFLPFLWLVNIFWFFREAFLVPAYTEQSQIKGYVWRSAVGFLFWVIVLTSWITIFQIYRPRWGALGDYLSFTIPLGTP

SEQ ID NO: 3603 - protein, 426 aa, unidentified
MGPLPAPSCTQRITWKGLLLTASLLNFWNPPTTAEVTIEAQPPKVSEGKDVLLLVHNLPQNLPGYFWYKGEMTDLYHYIISYIVDGKIIIYGPAYSGRETVYSNASLLIQNVTRKDAGTYTLHIIKRGDETREEIRHFTFTLYLETPKPYISSSNLNPREAMEAVRLICDPETLDASYLWWMNGQSLPVTHRLQLSKTNRTLYLFGVTKYIAGPYECEIRNPVSASRSDPVTLNLLPKLPIPYITINNLNPRENKDVLAFTCEPKSENYTYIWWLNGQSLPVSPGVKRPIENRILILPSVTRNETGPYQCEIRDRYGGLRSNPVILNVLYGPDLPRIYPSFTYYRSGENLDLSCFTESNPPAEYFWTINGKFQQSGQKLFIPQITRNHSGLYACSVHNSATGKEISKSMTVKVSGPCHGDLTESQS

SEQ ID NO: 3604 - protein, 424 aa, unidentified
MGCGTSKVLPEPPKDVQLDLVKKVEPFSGTKSDVYKHFITEVDSVGPVKAGFPAASQYAHPCPGPPTAGHTEPPSEPPRRARVAKYRAKFDPRVTAKYDIKALIGRGSFSRVVRVEHRATRQPYAIKMIETKYREGREVCESELRVLRRVRHANIIQLVEVFETQERVYMVMELATGGELFDRIIAKGSFTERDATRVLQMVLDGVRYLHALGITHRDLKPENLLYYHPGTDSKIIITDFGLASARKKGDDCLMKTTCGTPEYIAPEVLVRKPYTNSVDMWALGVIAYILLSGTMPFEDDNRTRLYRQILRGKYSYSGEPWPSVSNLAKDFIDRLLTVDPGARMTALQALRHPWVVSMAASSSMKNLHRSISQNLLKRASSRCQSTKSAQSTRSSRSTRSNKSRRVRERELRELNLRYQQQYNG

SEQ ID NO: 3605 - protein, 385 aa, unidentified
MGCGASRKVVPGPPALAWAKHEGQNQAGVGGAGPGPEAAAQAAQRIQVARFRAKFDPRVLARYDIKALIGTGSFSRVVRVEQKTTKKPFAIKVMETREREGREACVSELSVLRRVSHRYIVQLMEIFETEDQVYMVMELATGGELFDRLIAQGSFTERDAVRILQMVADGIRYLHALQITHRNLKPENLLYYHPGEESKILITDFGLAYSGKKSGDWTMKTLCGTPEYIAPEVLLRKPYTSAVDMWALGVITYALLSGFLPFDDESQTRLYRKILKGKYNYTGEPWPSISHLAKDFIDKLLILEAGHRMSAGQALDHPWVITMAAGSSMKNLQRAISRNLMQRASPHSQSPGSAQSSKSHYSHKSRHMWSKRNLRIVESPLSALL

SEQ ID NO: 3606 - protein, 953 aa, unidentified
MITSAAGIISLLDEDEPQLKEFALHKLNAVVNDFWAEISESVDKIEVLYEDEGFRSRQFAALVASKVFYHLGAFEESLNYALGAGDLFNVNDNSEYVETIIAKCIDHYTKQCVENADLPEGEKKPIDQRLEGIVNKMFQRCLDDHKYKQAIGIALETRRLDVFEKTILESNDVPGMLAYSLKLCMSLMQNKQFRNKVLRVLVKIYMNLEKPDFINVCQCLIFLDDPQAVSDILEKLVKEDNLLMAYQICFDLYESASQQFLSSVIQNLRTVGTPIASVPGSTNTGTVPGSEKDSDSMETEEKTSSAFVGKTPEASPEPKDQTLKMIKILSGEMAIELHLQFLIRNNNTDLMILKNTKDAVRNSVCHTATVIANSFMHCGTTSDQFLRDNLEWLARATNWAKFTATASLGVIHKGHEKEALQLMATYLPKDTSPGSAYQEGGGLYALGLIHANHGGDIIDYLLNQLKNASNDIVRHGGSLGLGLAAMGTARQDVYDLLKTNLYQDDAVTGEAAGLALGLVMLGSKNAQAIEDMVGYAQETQHEKILRGLAVGIALVMYGRMEEADALIESLCRDKDPILRRSGMYTVAMAYCGSGNNKAIRRLLHVAVSDVNDDVRRAAVESLGFILFRTPEQCPSVVSLLSESYNPHVRYGAAMALGICCAGTGNKEAINLLEPMTNDPVNYVRQGALIASALIMIQQTEITCPKVNQFRQLYSKVINDKHDDVMAKFGAILAQGILDAGGHNVTISLQSRTGHTHMPSVVGVLVFTQFWFWFPLSHFLSLAYTPTCVIGLNKDLKMPKVQYKSNCKPSTFAYPAPLEVPKEKEKEKVSTAVLSITAKAKKKEKEKEKKEEEKMEVDEAEKKEEKEKKKEPEPNFQLLDNPARVMPAQLKVLTMPETCRYQPFKPLSIGGIIILKDTSEDIEELVEPVAAHGPKIEEEEQEPEPPEPFEYIDD

SEQ ID NO: 3607 - protein, 908 aa, unidentified
MEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSCVNYVPEPENSALLRCALGVFRKFSRFPEALRLALMLNDMELVEDIFTSCKDVVVQKQMAFMLGRHGVFLELSEDVEEYEDLTEIMSNVQLNSNFLALARELDIMEPKVPDDIYKTHLENNRFGGSGSQVDSARMNLASSFVNGFVNAAFGQDKLLTDDGNKWLYKNKDHGMLSAAASLGMILLWDVDGGLTQIDKYLYSSEDYIKSGALLACGIVNSGVRNECDPALALLSDYVLHNSNTMRLGSIFGLGLAYAGSNREDVLTLLLPVMGDSKSSMEVAGVTALACGMIAVGSCNGDVTSTILQTIMEKSETELKDTYARWLPLGLGLNHLGKGEAIEAILAALEVVSEPFRSFANTLVDVCAYAGSGNVLKVQQLLHICSEHFDSKEKEEDKDKKEKKDKDKKEAPADMGAHQGVAVLGIALIAMGEEIGAEMALRTFGHLLRYGEPTLRRAVPLALALISVSNPRLNILDTLSKFSHDADPEVSYNSIFAMGMVGSGTNNARLAAMLRQLAQYHAKDPNNLFMVRLAQGLTHLGKGTLTLCPYHSDRQLMSQVAVAGLLTVLVSFLDVRNIILGKSHYVLYGLVAAMQPRMLVTFDEELRPLPVSVRVGQAVDVVGQAGKPKTITGFQTHTTPVLLAHGERAELATEEFLPVTPILEGFVILRKNPNYDL

SEQ ID NO: 3608 - protein, 342 aa, unidentified
MEPHDSSHMDSEFRYTLFPIVYSIIFVLGVIANGYVLWVFARLYPCKKFNEIKIFMVNLTMADMLFLITLPLWIVYYQNQGNWILPKFLCNVAGCLFFINTYCSVAFLGVITYNRFQAVTRPIKTAQANTRKRGISLSLVIWVAIVGAASYFLILDSTNTVPDSAGSGNVTRCFEHYEKGSVPVLIIHIFIVFSFFLVFLIILFCNLVIIRTLLMQPVQQQRNAEVKRRALWMVCTVLAVFIICFVPHHVVQLPWTLAELGFQDSKFHQAINDAHQVTLCLLSTNCVLDPVIYCFLTKKFRKHLTEKFYSMRSSRKCSRATTDTVTEVVVPFNQIPGNSLKN

SEQ ID NO: 3609 - protein, 1447 aa, unidentified
MASAGNAAEPQDRGGGGSGCIGAPGRPAGGGRRRRTGGLRRAAAPDRDYLHRPSYCDAAFALEQISKGKATGRKAPLWLRAKFQRLLFKLGCYIQKNCGKFLVVGLLIFGAFAVGLKAANLETNVEELWVEVGGRVSRELNYTRQKIGEEAMFNPQLMIQTPKEEGANVLTTEALLQHLDSALQASRVHVYMYNRQWKLEHLCYKSGELITETGYMDQIIEYLYPCLIITPLDCFWEGAKLQSGTAYLLGKPPLRWTNFDPLEFLEELKKINYQVDSWEEMLNKAEVGHGYMDRPCLNPADPDCPATAPNKNSTKPLDMALVLNGGCHGLSRKYMHWQEELIVGGTVKNSTGKLVSAHALQTMFQLMTPKQMYEHFKGYEYVSHINWNEDKAAAILEAWQRTYVEVVHQSVAQNSTQKVLSFTTTTLDDILKSFSDVSVIRVASGYLLMLAYACLTMLRWDCSKSQGAVGLAGVLLVALSVAAGLGLCSLIGISFNAATTQVLPFLALGVGVDDVFLLAHAFSETGQNKRIPFEDRTGECLKRTGASVALTSISNVTAFFMAALIPIPALRAFSLQAAVVVVFNFAMVLLIFPAILSMDLYRREDRRLDIFCCFTSPCVSRVIQVEPQAYTDTHDNTRYSPPPPYSSHSFAHETQITMQSTVQLRTEYDPHTHVYYTTAEPRSEISVQPVTVTQDTLSCQSPESTSSTRDLLSQFSDSSLHCLEPPCTKWTLSSFAEKHYAPFLLKPKAKVVVIFLFLGLLGVSLYGTTRVRDGLDLTDIVPRETREYDFIAAQFKYFSFYNMYIVTQKADYPNIQHLLYDLHRSFSNVKYVMLEENKQLPKMWLHYFRDWLQGLQDAFDSDWETGKIMPNNYKNGSDDGVLAYKLLVQTGSRDKPIDISQLTKQRLVDADGIINPSAFYIYLTAWVSNDPVAYAASQANIRPHRPEWVHDKADYMPETRLRIPAAEPIEYAQFPFYLNGLRDTSDFVEAIEKVRTICSNYTSLGLSSYPNGYPFLFWEQYIGLRHWLLLFISVVLACTFLVCAVFLLNPWTAGIIVMVLALMTVELFGMMGLIGIKLSAVPVVILIASVGIGVEFTVHVALAFLTAIGDKNRRAVLALEHMFAPVLDGAVSTLLGVLMLAGSEFDFIVRYFFAVLAILTILGVLNGLVLLPVLLSFFGPYPEVSPANGLNRLPTPSPEPPPSVVRFAMPPGHTHSGSDSSDSEYSSQTTVSGLSEELRHYEAQQGAGGPAHQVIVEATENPVFAHSTVVHPESRHHPPSNPRQQPHLDSGSLPPGRQGQQPRRDPPREGLWPPPYRPRRDAFEISTEGHSGPSNRARWGPRGARSHNPRNPASTAMGSSVPGYCQPITTVTASASVTVAVHPPPVPGPGRNPRGGLCPGYPETDHGLFEDPHVPFHVRCERRDSKVEVIELQDVECEERPRGSSSN

SEQ ID NO: 3610 - protein, 1203 aa, unidentified
MTRSPPLRELPPSYTPPARTAAPQILAGSLKAPLWLRAYFQGLLFSLGCGIQRHCGKVLFLGLLAFGALALGLRMAIIETNLEQLWVEVGSRVSQELHYTKEKLGEEAAYTSQMLIQTARQEGENILTPEALGLHLQAALTASKVQVSLYGKSWDLNKICYKSGVPLIENGMIERMIEKLFPCVILTPLDCFWEGAKLQGGSAYLPGRPDIQWTNLDPEQLLEELGPFASLEGFRELLDKAQVGQAYVGRPCLHPDDLHCPPSAPNHHSRQAPNVAHELSGGCHGFSHKFMHWQEELLLGGMARDPQGELLRAEALQSTFLLMSPRQLYEHFRGDYQTHDIGWSEEQASTVLQAWQRRFVQLAQEALPENASQQIHAFSSTTLDDILHAFSEVSAARVVGGYLLMLAYACVTMLRWDCAQSQGSVGLAGVLLVALAVASGLGLCALLGITFNAATTQVLPFLALGIGVDDVFLLAHAFTEALPGTPLQERMGECLQRTGTSVVLTSINNMAAFLMAALVPIPALRAFSLQAAIVVGCTFVAVMLVFPAILSLDLRRRHCQRLDVLCCFSSPCSAQVIQILPQELGDGTVPVGIAHLTATVQAFTHCEASSQHVVTILPPQAHLVPPPSDPLGSELFSPGGSTRDLLGQEEETRQKAACKSLPCARWNLAHFARYQFAPLLLQSHAKAIVLVLFGALLGLSLYGATLVQDGLALTDVVPRGTKEHAFLSAQLRYFSLYEVALVTQGGFDYAHSQRALFDLHQRFSSLKAVLPPPATQAPRTWLHYYRNWLQGIQAAFDQDWASGRITRHSYRNGSEDGALAYKLLIQTGDAQEPLDFSQLTTRKLVDREGLIPPELFYMGLTVWVSSDPLGLAASQANFYPPPPEWLHDKYDTTGENLRIPPAQPLEFAQFPFLLRGLQKTADFVEAIEGARAACAEAGQAGVHAYPSGSPFLFWEQYLGLRRCFLLAVCILLVCTFLVCALLLLNPWTAGLIVLVLAMMTVELFGIMGFLGIKLSAIPVVILVASVGIGVEFTVHVALGFLTTQGSRNLRAAHALEHTFAPVTDGAISTLLGLLMLAGSHFDFIVRYFFAALTVLTLLGLLHGLVLLPVLLSILGPPPEVIQMYKESPEILSPPAPQGGGLRWGASSSLPQSFARVTTSMTVAIHPPPLPGAYIHPAPDEPPWSPAATSSGNLSSRGPGPATG

SEQ ID NO: 3611 - protein, 888 aa, unidentified
MLRQVLHRGLRTCFSRLGHFIASHPVFFASAPVLISILLGASFSRYQVEESVEHLLAPQHSLAKIERNLVNSLFPVNRSKHRLYSDLQTPGRYGRVIVTSFQKANMLDQHHTDLILKLHAAVTKIQVPRPGFNYTFAHICILNNDKTCIVDDIVHVLEELKNARATNRTNFAITYPITHLKDGRAVYNGHQLGGVTVHSKDRVKSAEAIQLTYYLQSINSLNDMVAERWESSFCDTVRLFQKSNSKVKMYPYTSSSLREDFQKTSRVSERYLVTSLILVVTMAILCCSMQDCVRSKPWLGLLGLVTISLATLTAAGIINLTGGKYNSTFLGVPFVMLGHGLYGTFEMLSSWRKTREDQHVKERTAAVYADSMLSFSLTTAMYLVTFGIGASPFTNIEAARIFCCNSCIAIFFNYLYVLSFYGSSLVFTGYIENNYQHSIFCRKVPKPEALQEKPAWYRFLLTARFSEDTAEGEEANTYESHLLVCFLKRYYCDWITNTYVKPFVVLFYLIYISFALMGYLQVSEGSDLSNIVATATQTIEYTTAQQKYFSNYSPVIGFYIYESIEYWNTSVQEDVLEYTKGFVRISWFESYLNYLRKLNVSTGLPKKNFTDMLRNSFLKAPQFSHFQEDIIFSKKYNDEVDVVASRMFLVAKTMETNREELYDLLETLRRLSVTSKVKFIVFNPSFVYMDRYASSLGAPLHNSCISALFLLFFSAFLVADSLINVWITLTVVSVEFGVIGFMTLWKVELDCISVLCLIYGINYTIDNCAPMLSTFVLGKDFTRTKWVKNALEVHGVAILQSYLCYIVGLIPLAAVPSNLTCTLFRCLFLIAFVTFFHCFAILPVILTFLPPSKKKRKEKKNPENREEIECVEMVDIDSTRVVDQITTV

SEQ ID NO: 3612 - protein, 767 aa, unidentified
MPWVEPKPRPGPEQKPKLTKPDSATGPQWYQESQESESEGKQPPPGPLAPPKSPEPSGPLASEQDAPLPEGDDAPPRPSMLDDAPRLPLELDDAPLPEEETPEPTAICRHRHRCHTDCLEGLLSRTFQWLGWQVGAHPWIFLLAPLMLTAALGTGFLYLPKDEEEDLEEHYTPVGSPAKAERRFVQGHFTTNDSYRFSASRRSTEANFVSLLVVSYSDSLLDPATFAEVSKLDGAVQDLRVAREKGSQIQYQQVCARYRALCVPPNPILYAWQVNKTLNLSSISFPAYNHGRHPLYLTGFFGGYILGGSLGMGQLLLRAKAMRLLYYLKTEDPEYDVQSKQWLTHLLDQFTNIKNILALKKIEVVHFTSLSRQLEFEATSVTVIPVFHLAYILIILFAVTSCFRFDCIRNKMCVAAFGVISAFLAVVSGFGLLLHIGVPFVIIVANSPFLILGVGVDDMFIMISAWHKTNLADDIRERMSNVYSKAAVSITITTITNILALYTGIMSSFRSVQCFCIYTGMTLLFCYFYNITCFGAFMALDGKREVVCLCWLKKADPKWPSFKKFCCFPFGSVPDEHGTDIHPISLFFRDYFGPFLTRSESKYFVVFIYVLYIISSIYGCFHVQEGLDLRNLASDDSYITPYFNVEENYFSDYGPRVMVIVTKKVDYWDKDVRQKLENCTKIFEKNVYVDKNLTEFWLDAYVQYLKGNSQDPNEKNTFMNNIPDFLSNFPNFQHDINISSSNEIISSRGFIQTTDVSSSAKKKILLF

SEQ ID NO: 3613 - protein, 846 aa, unidentified
MCFLRRPGAPASWIWWRMLRQVLRRGLQSFCHRLGLCVSRHPVFFLTVPAVLTITFGLSALNRFQPEGDLERLVAPSHSLAKIERSLASSLFPLDQSKSQLYSDLHTPGRYGRVILLSPTGDNILLQAEGILQTHRAVLEMKDGRNSFIGHQLGGVVEVPNSKDQRVKSARAIQITYYLQTYGSATQDLIGEKWENEFCKLIRKLQEEHQELQLYSLASFSLWRDFHKTSILARSKVLVSLVLILTTATLSSSMKDCLRSKPFLGLLGVLTVCISIITAAGIFFITDGKYNSTLLGIPFFAMGHGTKGVFELLSGWRRTKENLPFKDRIADAYSDVMVTYTMTSSLYFITFGMGASPFTNIEAVKVFCQNMCVSILLNYFYIFSFFGSCLVFAGQLEQNRYHSIFCCKIPSAEYLDRKPVWFQTVMSDGHQQTSHHETNPYQHHFIQHFLREHYNEWITNIYVKPFVVILYLIYASFSFMGCLQISDGANIINLLASDSPSVSYAMVQQKYFSNYSPVIGFYVYEPLEYWNSSVQDDLRRLCSGFTAVSWVEQYYQFLKVSNVSANNKSDFISVLQSSFLKKPEFQHFRNDIIFSKAGDESNIIASRLYLVARTSRDKQKEITEVLEKLRPLSLSKSIRFIVFNPSFVFMDHYSLSVTVPVLIAGFGVLLVLILTFFLVIHPLGNFWLILSVTSIELGVLGLMTLWNVDMDCISILCLIYTLNFAIDHCAPLLFTFVLATEHTRTQCIKSSLQDHGTAILQNVTSFLIGLVPLLFVPSNLTFTLFKCLLLTGGCTLLHCFVILPVFLTFFPPSKKHHKKKKRAKRKEREEIECIEIQENPDHVTTV

SEQ ID NO: 3614 - protein, 281 aa, unidentified
MAGTWLLLLLALGCPALPTGVGGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVWGEGSYLSSYPTCPAQAWCSRSALRAPSSSLGAFFAGDLPPPLQAGAA

SEQ ID NO: 3615 - protein, 473 aa, unidentified
MASCVGSRTLSKDDVNYKMHFRMINEQQVEDITIDFFYRPHTITLLSFTIVSLMYFAFTRDDSVPEDNIWRGILSVIFFFLIISVLAFPNGPFTRPHPALWRMVFGLSVLYFLFLVFLLFLNFEQVKSLMYWLDPNLRYATREADVMEYAVNCHVITWERIISHFDIFAFGHFWGWAMKALLIRSYGLCWTISITWELTELFFMHLLPNFAECWWDQVILDILLCNGGGIWLGMVVCRFLEMRTYHWASFKDIHTTTGKIKRAVLQFTPASWTYVRWFDPKSSFQRVAGVYLFMIIWQLTELNTFFLKHIFVFQASHPLSWGRILFIGGITAPTVRQYYAYLTDTQCKRVGTQCWVFGVIGFLEAIVCIKFGQDLFSKTQILYVVLWLLCVAFTTFLCLYGMIWYAEHYGHREKTYSECEDGTYSPEISWHHRKGTKGSEDSPPKHAGNNESHSSRRRNRHSKSKVTNGVGKK

SEQ ID NO: 3616 - protein, 487 aa, unidentified
MRRGERRDAGGPRPESPVPAGRASLEEPPDGPSAGQATGPGEGRRSTESEVYDDGTNTFFWRAHTLTVLFILTCTLGYVTLLEETPQDTAYNTKRGIVASILVFLCFGVTQAKDGPFSRPHPAYWRFWLCVSVVYELFLIFILFQTVQDGRQFLKYVDPKLGVPLPERDYGGNCLIYDPDNETDPFHNIWDKLDGFVPAHFLGWYLKTLMIRDWWMCMIISVMFEFLEYSLEHQLPNFSECWWDHWIMDVLVCNGLGIYCGMKTLEWLSLKTYKWQGLWNIPTYKGKMKRIAFQFTPYSWVRFEWKPASSLRRWLAVCGIILVFLLAELNTFYLKFVLWMPPEHYLVLLRLVFFVNVGGVAMREIYDFMDDPKPHKKLGPQAWLVAAITATELLIVVKYDPHTLTLSLPFYISQCWTLGSVLALTWTVWRFFLRDITLRYKETRWQKWQNKDDQGSTVGNGDQHPLGLDEDLLGPGVAEGEGAPTPN

SEQ ID NO: 3617 - protein, 359 aa, unidentified
MKSPFYRCQNTTSVEKGNSAVMGGVLFSTGLLGNLLALGLLARSGLGWCSRRPLRPLPSVFYMLVCGLTVTDLLGKCLLSPVVLAAYAQNRSLRVLAPALDNSLCQAFAFFMSFFGLSSTLQLLAMALECWLSLGHPFFYRRHITLRLGALVAPVVSAFSLAFCALPFMGFGKFVQYCPGTWCFIQMVHEEGSLSVLGYSVLYSSLMALLVLATVLCNLGAMRNLYAMHRRLQRHPRSCTRDCAEPRADGREASPQPLEELDHLLLLALMTVLFTMCSLPVIYRAYYGAFKDVKEKNRTSEEAEDLRALRFLSVISIVDPWIFIIFRSPVFRIFFHKIFIRPLRYRSRCSNSTNMESSL

SEQ ID NO: 3618 - protein, 395 aa, unidentified
MSANATLKPLCPILEQMSRLQSHSNTSIRYIDHAAVLLHGLASLLGLVENGVILFVVGCRMRQTVVTTWVLHLALSDLLASASLPFFTYFLAVGHSWELGTTFCKLHSSIFFLNMFASGFLLSAISLDRCLQVVRPVWAQNHRTVAAAHKVCLVLWALAVLNTVPYFVFRDTISRLDGRIMCYYNVLLLNPGPDRDATCNSRQVALAVSKFLLAFLVPLAIIASSHAAVSLRLQHRGRRRPGRFVRLVAAVVAAFALCWGPYHVFSLLEARAHANPGLRPLVWRGLPFVTSLAFFNSVANPVLYVLTCPDMLRKLRRSLRTVLESVLVDDSELGGAGSSRRRRTSSTARSASPLALCSRPEEPRGPARLLGWLLGSCAASPQTGPLNRALSSTSS

SEQ ID NO: 3619 - protein, 402 aa, unidentified
MSPCGPLNLSLAGEATTCAAPWVPNTSAVPPSGASPALPIFSMTLGAVSNLLALALLAQAAGRLRRRRSAATFLLFVASLLATDLAGHVIPGALVLRLYTAGRAPAGGACHFLGGCMVFFGLCPLLLGCGMAVERCVGVTRPLLHAARVSVARARLALAAVAAVALAVALLPLARVGRYELQYPGTWCFIGLGPPGGWRQALLAGLFASLGLVALLAALVCNTLSGLALLRARWRRRSRRPPPASGPDSRRRWGAHGPRSASASSASSIASASTFFGGSRSSGSARRARAHDVEMVGQLVGIMVVSCICWSPMLVLVALAVGGWSSTSLQRPLFLAVRLASWNQILDPWVYILLRQAVLRQLLRLLPPRAGAKGGPAGLGLTPSAWEASSLRSSRHSGLSHF

SEQ ID NO: 3620 - protein, 358 aa, unidentified
MGNASNDSQSEDCETRQWLPPGESPAISSVMFSAGVLGNLIALALLARRWRGDVGCSAGRRSSLSLFHVLVTELVFTDLLGTCLISPVVLASYARNQTLVALAPESRACTYFAFAMTFFSLATMLMLFAMALERYLSIGHPYFYQRRVSRSGGLAVLPVIYAVSLLFCSLPLLDYGQYVQYCPGTWCFIRHGRTAYLQLYATLLLLLIVSVLACNFSVILNLIRMHRRSRRSRCGPSLGSGRGGPGARRRGERVSMAEETDHLILLAIMTITFAVCSLPFTIFAYMNETSSRKEKWDLQALRFLSINSIIDPWVFAILRPPVLRLMRSVLCCRISLRTQDATQTSCSTQSDASKQADL

SEQ ID NO: 3621 - protein, 402 aa, unidentified
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQMRKRRLREQEMGPDGRCFCHAWRQVPRTWCSSHDREPCSVQLS

SEQ ID NO: 3622 - protein, 488 aa, unidentified
MSTPGVNSSASLSPDRLNSPVTIPAVMFIFGVVGNLVAIVVLCKSRKEQKETTFYTLVCGLAVTDLLGTLLVSPVTIATYMKGQWPGGQPLCEYSTFILLFFSLSGLSIICAMSVERYLAINHAYFYSHYVDKRLAGLTLFAVYASNVLFCALPNMGLGSSRLQYPDTWCFIDWTTNVTAHAAYSYMYAGFSSFLILATVLCNVLVCGALLRMHRQFMRRTSLGTEQHHAAAAASVASRGHPAASPALPRLSDFRRRRSFRRIAGAEIQMVILLIATSLVVLICSIPLVVRVFVNQLYQPSLEREVSKNPDLQAIRIASVNPILDPWIYILLRKTVLSKAIEKIKCLFCRIGGSRRERSGQHCSDSQRTSSAMSGHSRSFISRELKEISSTSQTLLPDLSLPDLSENGLGGRNLLPGVPGMGLAQEDTTSLRTLRISETSDSSQGQDSESVLLVDEAGGSGRAGPAPKGSSLQVTFPSETLNLSEKCI

SEQ ID NO: 3623 - protein, 152 aa, unidentified
MPAHSLVMSSPALPAFLLCSTLLVIKMYVVAIITGQVRLRKKAFANPEDALRHGGPQYCRSDPDVERCLRAHRNDMETIYPFLFLGFVYSFLGPNPFVAWMHFLVFLVGRVAHTVAYLGKLRAPIRSVTYTLAQLPCASMALQILWEAARHL

SEQ ID NO: 3624 - protein, 359 aa, unidentified
MSMNNSKQLVSPAAALLSNTTCQTENRLSVFFSVIFMTVGILSNSLAIAILMKAYQRFRQKSKASFLLLASGLVITDFFGHLINGAIAVFVYASDKEWIRFDQSNVLCSIFGICMVFSGLCPLLLGSVMAIERCIGVTKPIFHSTKITSKHVKMMLSGVCLFAVFIALLPILGHRDYKIQASRTWCFYNTEDIKDWEDRFYLLLFSFLGLLALGVSLLCNAITGITLLRVKFKSQQHRQGRSHHLEMVIQLLAIMCVSCICWSPFLVTMANIGINGNHSLETCETTLFALRMATWNQILDPWVYILLRKAVLKNLYKLASQCCGVHVISLHIWELSSIKNSLKVAAISESPVAEKSAST

SEQ ID NO: 3625 - protein, 879 aa, unidentified
MGRLASRPLLLALLSLALCRGRVVRVPTATLVRVVGTELVIPCNVSDYDGPSEQNFDWSFSSLGSSFVELASTWEVGFPAQLYQERLQRGEILLRRTANDAVELHIKNVQPSDQGHYKCSTPSTDATVQGNYEDTVQVKVLADSLHVGPSARPPPSLSLREGEPFELRCTAASASPLHTHLALLWEVHRGPARRSVLALTHEGRFHPGLGYEQRYHSGDVRLDTVGSDAYRLSVSRALSADQGSYRCIVSEWIAEQGNWQEIQEKAVEVATVVIQPSVLRAAVPKNVSVAEGKELDLTCNITTDRADDVRPEVTWSFSRMPDSTLPGSRVLARLDRDSLVHSSPHVALSHVDARSYHLLVRDVSKENSGYYYCHVSLWAPGHNRSWHKVAEAVSSPAGVGVTWLEPDYQVYLNASKVPGFADDPTELACRVVDTKSGEANVRFTVSWYYRMNRRSDNVVTSELLAVMDGDWTLKYGERSKQRAQDGDFIFSKEHTDTFNFRIQRTTEEDRGNYYCVVSAWTKQRNNSWVKSKDVFSKPVNIFWALEDSVLVVKARQPKPFFAAGNTFEMTCKVSSKNIKSPRYSVLIMAEKPVGDLSSPNETKYIISLDQDSVVKLENWTDASRVDGVVLEKVQEDEFRYRMYQTQVSDAGLYRCMVTAWSPVRGSLWREAATSLSNPIEIDFQTSGPIFNASVHSDTPSVIRGDLIKLFCIITVEGAALDPDDMAFDVSWFAVHSFGLDKAPVLLSSLDRKGIVTTSRRDWKSDLSLERVSVLEFLLQVHGSEDQDFGNYYCSVTPWVKSPTGSWQKEAEIHSKPVFITVKMDVLNAFKYPLLIGVGLSTVIGLLSCLIGYCSSHWCCKKEVQETRRERRRLMSMEMD

SEQ ID NO: 3626 - protein, 386 aa, unidentified [sequence omitted]

SEQ ID NO: 3627 - protein, 500 aa, unidentified
MAWAALLGLLAALLLLLLLSRRRTRRPGEPPLDLGSIPWLGYALDFGKDAASFLTRMKEKHGDIFTILVGGRYVTVLLDPHSYDAVVWEPRTRLDFHAYAIFLMERIFDVQLPHYSPSDEKARMKLTLLHRELQALTEAMYTNLHAVLLGDATEAGSGWHEMGLLDFSYSFLLRAGYLTLYGIEALPRTHESQAQDRVHSADVFHTFRQLDRLLPKLARGSLSVGDKDHMCSVKSRLWKLLSPARLARRAHRSKWLESYLLHLEEMGVSEEMQARALVLQLWATQGNMGPAAFWLLLFLLKNPEALAAVRGELESILWQAEQPVSQTTTLPQKVLDSTPVLDSVLSESLRLTAAPFITREVVVDLAMPMADGREFNLRRGDRLLLFPFLSPQRDPEIYTDPEVFKYNRFLNPDGSEKKDFYKDGKRLKNYNMPWGAGHNHCLGRSYAVNSIKQFVFLVLVHLDLELINADVEIPEFDLSRYGFGLMQPEHDVPVRYRIRP

SEQ ID NO: 3628 - protein, 593 aa, unidentified
MGTARIAPGLALLLCCPVLSSAYALVDADDVMTKEEQIFLLHRAQAQCEKRLKEVLQRPASIMESDKGWTSASTSGKPRKDKASGKLYPESEEDKEAPTGSRYRGRPCLPEWDHILCWPLGAPGEVVAVPCPDYIYDFNHKGHAYRRCDRNGSWELVPGHNRTWANYSECVKFLTNETREREVFDRLGMIYTVGYSVSLASLTVAVLILAYFRRLHCTRNYIHMHLFLSFMLRAVSIFVKDAVLYSGATLDEAERLTEEELRAIAQAPPPPATAAAGYAGCRVAVTFFLYFLATNYYWILVEGLYLHSLIFMAFFSEKKYLWGFTVFGWGLPAVFVAVWVSVRATLANTGCWDLSSGNKKWIIQVPILASIVLNFILFINIVRVLATKLRETNAGRCDTRQQYRKLLKSTLVLMPLFGVHYIVFMATPYTEVSGTLWQVQMHYEMLFNSFQGFFVAIIYCFCNGEVQAEIKKSWSRWTLALDFKRKARSGSSSYSYGPMVSHTSVTNVGPRVGLGLPLSPRLLPTATTNGHPQLPGHAKPGTPALETLETTPPAMAAPKDDGFLNGSCSGLDEEASGPERPPALLQEEWETVM

SEQ ID NO: 3629 - protein, 550 aa, unidentified
MAGLGASLHVWGWLMLGSCLLARAQLDSDGTITIEEQIVLVLKAKVQCELNITAQLQEGEGNCFPEWDGLICWPRGTVGKISAVPCPPYIYDFNHKGVAFRHCNPNGTWDFMHSLNKTWANYSDCLRFLQPDISIGKQEFFERLYVMYTVGYSISFGSLAVAILIIGYFRRLHCTRNYIHMHLFVSFMLRATSIFVKDRVVHAHIGVKELESLIMQDDPQNSIEATSVDKSQYIGCKIAVVMFIYFLATNYYWILVEGLYLHNLIFVAFFSDTKYLWGFILIGWGFPAAFVAAWAVARATLADARCWELSAGDIKWIYQAPILAAIGLNFILFLNTVRVLATKIWETNAVGHDTRKQYRKLAKSTLVLVLVFGVHYIVFVCLPHSFTGLGWEIRMHCELFFNSFQGFFVSIIYCYCNGEVQAEVKKMWSRWNLSVDWKRTPPCGSRRCGSVLTTVTHSTSSQSQVAASTRMVLISGKAAKIASRQPDSHITLPGYVWSNSEQDCLPHSFHEETKEDSGRQGDDILMEKPSRPMESNPDTEGCQGETEDVL

SEQ ID NO: 3630 - protein, 1070 aa, unidentified
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 3631 - protein, 201 aa, unidentified
MAATALLEAGLARVLFYPTLLYTLFRGKVPGRAHRDWYHRIDPTVLLGALPLRSLTRQLVQDENVRGVITMNEEYETRFLCNSSQEWKRLGVEQLRLSTVDMTGIPTLDNLQKGVQFALKYQSLGQCVYVHCKAGRSRSATMVAAYLIQVHKWSPEEAVRAIAKIRSYIHIRPGQLDVLKEFHKQITARATKDGTFVISKT

SEQ ID NO: 3632 - protein, 435 aa, unidentified
MEMEKEFEQIDKSGSWAAIYQDIRHEASDFPCRVAKLPKNKNRNRYRDVSPFDHSRIKLHQEDNDYINASLIKMEEAQRSYILTQGPLPNTCGHFWEMVWEQKSRGVVMLNRVMEKGSLKCAQYWPQKEEKEMIFEDTNLKLTLISEDIKSYYTVRQLELENLTTQETREILHFHYTTWPDFGVPESPASFLNFLFKVRESGSLSPEHGPVVVHCSAGIGRSGTFCLADTCLLLMDKRKDPSSVDIKKVLLEMRKFRMGLIQTADQLRFSYLAVIEGAKFIMGDSSVQDQWKELSHEDLEPPPEHIPPPPRPPKRILEPHNGKCREFFPNHQWVKEETQEDKDCPIKEEKGSPLNAAPYGIESMSQDTEVRSRVVGGSLRGAQAASPAKGEPSLPEKDEDHALSYWKPFLVNMCVATVLTAGAYLCYRFLFNSNT

SEQ ID NO: 3633 - protein, 415 aa, unidentified
MPTTIEREFEELDTQRRWQPLYLEIRNESHDYPHRVAKFPENRNRNRYRDVSPYDHSRVKLQNAENDYINASLVDIEEAQRSYILTQGPLPNTCCHFWLMVWQQKTKAVVMLNRIVEKESVKCAQYWPTDDQEMLFKETGFSVKLLSEDVKSYYTVHLLQLENINSGETRTISHFHYTTWPDFGVPESPASFLNFLFKVRESGSLNPDHGPAVIHCSAGIGRSGTFSLVDTCLVLMEKGDDINIKQVLLNMRKYRMGLIQTPDQLRFSYMAIIEGAKCIKGDSSIQKRWKELSKEDLSPAFDHSPNKIMTEKYNGNRIGLEEEKLTGDRCTGLSSKMQDTMEENSESALRKRIREDRKATTAQKVQQMKQRLNENERKRKRWLYWQPILTKMGFMSVILVGAFVGWTLFFQQNAL

SEQ ID NO: 3634 - protein, 802 aa, unidentified
MDSWFILVLLGSGLICVSANNATTVAPSVGITRLINSSTAEPVKEEAKTSNPTSSLTSLSVAPTFSPNITLGPTYLTTVNSSDSDNGTTRTASTNSIGITISPNGTWLPDNQFTDARTEPWEGNSSTAATTPETFPPSGNSDSKDRRDETPIIAVMVALSSLLVIVFIIIVLYMLRFKKYKQAGSHSNSFRLSNGRTEDVEPQSVPLLARSPSTNRKYPPLPVDKLEEEINRRMADDNKLFREEFNALPACPIQATCEAASKEENKEKNRYVNILPYDHSRVHLTPVEGVPDSDYINASFINGYQEKNKFIAAQGPKEETVNDFWRMIWEQNTATIVMVTNLKERKECKCAQYWPDQGCWTYGNIRVSVEDVTVLVDYTVRKFCIQQVGDMTNRKPQRLITQFHFTSWPDFGVPFTPIGMLKFLKKVKACNPQYAGAIVVHCSAGVGRTGTFVVIDAMLDMMHTERKVDVYGFVSRIRAQRCQMVQTDMQYVFIYQALLEHYLYGDTELEVTSLETHLQKIYNKIPGTSNNGLEEEFKKLTSIKIQNDKMRTGNLPANMKKNRVLQIIPYEFNRVIIPVKRGEENTDYVNASFIDGYRQKDSYIASQGPLLHTIEDFWRMIWEWKSCSIVMLTELEERGQEKCAQYWPSDGLVSYGDITVELKKEEECESYTVRDLLVTNTRENKSRQIRQFHFHGWPEVGIPSDGKGMISIIAAVQKQQQQSGNHPITVHCSAGAGRTGTFCALSTVLERVKAEGILDVFQTVKSLRLQRPHMVQTLEQYEFCYKVVQEYIDAFSDYANFK

SEQ ID NO: 3635 - protein, 1997 aa, unidentified
MLSHGAGLALWITLSLLQTGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGSDELKPEQQHPLPSYLEYRHNASIRVYQTNYFASKCAENPNSNSKSFNIKLGAEMESLGGKCDPTQQKFCDGPLKPHTAYRISIRAFTQLFDEDLKEFTKPLYSDTFFSLPITTESEPLFGAIEGVSAGLFLIGMLVAVVALLICRQKVSHGRERPSARLSIRRDRPLSVHLNLGQKGNRKTSCPIKINQFEGHFMKLQADSNYLLSKEYEELKDVGRNQSCDIALLPENRGKNRYNNILPYDATRVKLSNVDDDPCSDYINASYIPGNNFRREYIVTQGPLPGTKDDFWKMVWEQNVHNIVMVTQCVEKGRVKCDHYWPADQDSLYYGDLILQMLSESVLPEWTIREFKICGEEQLDAHRLIRHFHYTVWPDHGVPETTQSLIQFVRTVRDYINRSPGAGPTVVHCSAGVGRTGTFIALDRILQQLDSKDSVDIYGAVHDLRLHRVHMVQTECQYVYLHQCVRDVLRARKLRSEQENPLFPIYENVNPEYHRDPVYSRH

SEQ ID NO: 3636 - protein, 1306 aa, unidentified
MTMYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 3637 - protein, 1912 aa, unidentified
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSESIGGTPIRGALQIEQSEESDQGKYECVATNSAGTRYSAPANLYVRELREVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSKPSAPPQDISCTSPSSTSILVSWQPPPVEKQNGIITEYSIKYTAVDGEDDKPHEILGIPSDTTKYLLEQLEKWTEYRITVTAHTDVGPGPESLSVLIRTNEDVPSGPPRKVEVEAVNSTSVKVSWRSPVPNKQHGQIRGYQVHYVRMENGEPKGQPMLKDVMLADAQWEFDDTTEHDMIISGLQPETSYSLTVTAYTTKGDGARSKPKLVSTTGAVPGKPRLVINHTQMNTALIQWHPPVDTFGPLQGYRLKFGRKDMEPLTTLEFSEKEDHFTATDIHKGASYVFRLSARNKVGFGEEMVKEISIPEEVPTGFPQNLHSEGTTSTSVQLSWQPPVLAERNGIITKYTLLYRDINIPLLPMEQLIVPADTTMTLTGLKPDTTYDVKVRAHTSKGPGPYSPSVQFRTLPVDQVFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 3638 - protein, 700 aa, unidentified
MEPLCPLLLVGFSLPLARALRGNETTADSNETTTTSGPPDPGASQPLLAWLLLPLLLLLLVLLLAAYFFRFRKQRKAVVSTSDKKMPNGILEEQEQQRVMLLSRSPSGPKKYFPIPVEHLEEEIRIRSADDCKQFREEFNSLPSGHIQGTFELANKEENREKNRYPNILPNDHSRVILSQLDGIPCSDYINASYIDGYKEKNKFIAAQGPKQETVNDFWRMVWEQKSATIVMLTNLKERKEEKCHQYWPDQGCWTYGNIRVCVEDCVVLVDYTIRKFCIQPQLPDGCKAPRLVSQLHFTSWPDFGVPFTPIGMLKFLKKVKTLNPVHAGPIVVHCSAGVGRTGTFIVIDAMMAMMHAEQKVDVFEFVSRIRNQRPQMVQTDMQYTFIYQALLEYYLYGDTELDVSSLEKHLQTMHGTTTHFDKIGLEEEFRKLTNVRIMKENMRTGNLPANMKKARVIQIIPYDFNRVILSMKRGQEYTDYINASFIDGYRQKDYFIATQGPLAHTVEDFWRMIWEWKSHTIVMLTEVQEREQDKCYQYWPTEGSVTHGEITIEIKNDTLSEAISIRDFLVTLNQPQARQEEQVRVVRQFHFHGWPEIGIPAEGKGMIDLIAAVQKQQQQTGNHPITVHCSAGAGRTGTFIALSNILERVKAEGLLDVFQAVKSLRLQRPHMVQTLEQYEFCYKVVQDFIDIFSDYANFK

SEQ ID NO: 3639 - protein, 1907 aa, unidentified
MAPEPAPGRTMVPLVPALVMLGLVAGAHGDSKPVFIKVPEDQTGLSGGVASFVCQATGEPKPRITWMKKGKKVSSQRFEVIEFDDGAGSVLRIQPLRVQRDEAIYECTATNSLGEINTSAKLSVLEEEQLPPGFPSIDMGPQLKVVEKARTATMLCAAGGNPDPEISWFKDFLPVDPATSNGRIKQLRSGALQIESSEESDQGKYECVATNSAGTRYSAPANLYVRVRRVAPRFSIPPSSQEVMPGGSVNLTCVAVGAPMPYVKWMMGAEELTKEDEMPVGRNVLELSNVVRSANYTCVAISSLGMIEATAQVTVKALPKPPIDLVVTETTATSVTLTWDSGNSEPVTYYGIQYRAAGTEGPFQEVDGVATTRYSIGGLSPFSEYAFRVLAVNSIGRGPPSEAVRARTGEQAPSSPPRRVQARMLSASTMLVQWEPPEEPNGLVRGYRVYYTPDSRRPPNAWHKHNTDAGLLTTVGSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSTPSAPPQKVMCVSMGSTTVRVSWVPPPADSRNGVITQYSVAYEAVDGEDRGRHVVDGISREHSSWDLVGLEKWTEYRVWVRAHTDVGPGPESSPVLVRTDEDVPSGPPRKVEVEPLNSTAVHVYWKLPVPSKQHGQIRGYQVTYVRLENGEPRGLPIIQDVMLAEAQWRPEESEDYETTISGLTPETTYSVTVAAYTTKGDGARSKPKIVTTTGAVPGRPTMMISTTAMNTALLQWHPPKELPGELLGYRLQYCRADEARPNTIDFGKDDQHFTVTGLHKGTTYIFRLAAKNRAGLGEEFEKEIRTPEDLPSGFPQNLHVTGLTTSTTELAWDPPVLAERNGRIISYTVVFRDINSQQELQNITTDTRFTLTGLKPDTTYDIKVRAWTSKGSGPLSPSIQSRTMPVEQVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPARNLYAHIQKLGQVPPGESVTAMELEFKLLASSKAHTSRFISANLPCNKFKNRLVNIMPYELTRVCLQPIRGVEGSDYINASFLDGYRQQKAYIATQGPLAESTEDFWRMLWEHNSTIIVMLTKLREMGREKCHQYWPAERSARYQYFVVDPMAEYNMPQYILREFKVTDARDGQSRTIRQFQFTDWPEQGVPKTGEGFIDFIGQVHKTKEQFGQDGPITVHCSAGVGRTGVFITLSIVLERMRYEGVVDMFQTVKTLRTQRPAMVQTEDQYQLCYRAALEYLGSFDHYAT

SEQ ID NO: 3640 - protein, 1445 aa, unidentified
MRRLLEPCWWILFLKITSSVLHYVVCFPALTEGYVGALHENRHGSAVQIRRRKASGDPYWAYSGAYGPEHWVTSSVSCGGRHQSPIDILDQYARVGEEYQELQLDGFDNESSNKTWMKNTGKTVAILLKDDYFVSGAGLPGRFKAEKVEFHWGHSNGSAGSEHSINGRRFPVEMQIFFYNPDDFDSFQTAISENRIIGAMAIFFQVSPRDNSALDPIIHGLKGVVHHEKETFLDPFVLRDLLPASLGSYYRYTGSLTTPPCSEIVEWIVFRRPVPISYHQLEAFYSIFTTEQQDHVKSVEYLRNNFRPQQRLHDRVVSKSAVRDSWNHDMTDFLENPLGTEASKVCSSPPIHMKVQPLNQTALQVSWSQPETIYHPPIMNYMISYSWTKNEDEKEKTFTKDSDKDLKATISHVSPDSLYLFRVQAVCRNDMRSDFSQTMLFQANTTRIFQGTRIVKTGVPTASPASSADMAPISSGSSTWTSSGIPFSFVSMATGMGPSSSGSQATVASVVTSTLLAGLGFGGGGISSFPSTVWPTRLPTAASASKQAARPVLATTEALASPGPDGDSSPTKDGEGTEEGEKDEKSESEDGEREHEEDGEKDSEKKEKSGVTHAAEERNQTEPSPTPSSPNRTAEGGHQTIPGHEQDHTAVPTDQTGGRRDAGPGLDPDMVTSTQVPPTATEEQYAGSDPKRPEMPSKKPMSRGDRFSEDSRFITVNPAEKNTSGMISRPAPGRMEWIIPLIVVSALTFVCLILLIAVLVYWRGCNKIKSKGFPRRFREVPSSGERGEKGSRKCFQTAHFYVEDSSSPRVVPNESIPIIPIPDDMEAIPVKQFVKHIGELYSNNQHGFSEDFEEVQRCTADMNITAEHSNHPENKHKNRYINILAYDHSRVKLRPLPGKDSKHSDYINANYVDGYNKAKAYIATQGPLKSTFEDFWRMIWEQNTGIIVMITNLVEKGRRKCDQYWPTENSEEYGNIIVTLKSTKIHACYTVRRFSIRNTKVKKGQKGNPKGRQNERVVIQYHYTQWPDMGVPEYALPVLTFVRRSSAARMPETGPVLVHCSAGVGRTGTYIVIDSMLQQIKDKSTVNVLGFLKHIRTQRNYLVQTEEQYIFIHDALLEAILGKETEVSSNQLHSYVNSILIPGVGGKTRLEKQFKLVTQCNAKYVECFSAQKECNKEKNRNSSVVPSERARVGLAPLPGMKGTDYINASYIMGYYRSNEFIITQHPLPHTTKDFWRMIWDHNAQIIVMLPDNQSLAEDEFVYWPSREESMNCEAFTVTLISKDRLCLSNEEQIIIHDFILEATQDDYVLEVRHFQCPKWPNPDAPISSTFELINVIKEEALTRDGPTIVHDEYGAVSAGMLCALTTLSQQLENENAVDVFQVAKMINLMRPGVFTDIEQYQFIYKAMLSLVSTKENGNGPMTVDKNGAVLIADESDPAESMESLV

SEQ ID NO: 3641 - protein, 1115 aa, unidentified
MAGAGGGLGVWGNLVLLGLCSWTGARAPAPNPGRNLTVETQTTSSISLSWEVPDGLDSQNSNYWVQCTGDGGTTETRNTTATNVTVDGLGPGSLYTCSVWVEKDGVNSSVGTVTTATAPNPVRNLRVEAQTNSSIALTWEVPDGPDPQNSTYGVEYTGDGGRAGTRSTAHTNITVDGLEPGCLYAFSMWVGKNGINSSRETRNATTAHNPVRNLRVEAQTTSSISLSWEVPDGTDPQNSTYCVQCTGDGGRTETRNTTDTRVTVDGLGPGSLYTCSVWVEKDGVNSSVEIVTSATAPNPVRNLTVEAQTNSSIALTWEVPDGPDPQNSTYGVEYTGDGGRAGTRSTAHTNITVDRLEPGCLYVFSVWVGKNGINSSRETRNATTAPNPVRNLHMETQTNSSIALCWEVPDGPYPQDYTYWVEYTGDGGGTETRNTTNTSVTAERLEPGTLYTFSVWAEKNGARGSRQNVSISTVPNAVTSLSKQDWTNSTIALRWTAPQGPGQSSYSYWVSWVREGMTDPRTQSTSGTDITLKELEAGSLYHLTVWAERNEVRGYNSTLTAATAPNEVTDLQNETQTKNSVMLWWKAPGDPHSQLYVYWVQWASKGHPRRGQDPQANWVNQTSRTNETWYKVEALEPGTLYNFTVWAERNDVASSTQSLCASTYPDTVTITSCVSTSAGYGVNLIWSCPQGGYEAFELEVGGQRGSQDRSSCGEAVSVLGLGPARSYPATITTIWDGMKVVSHSVVCHTESAGVIAGAFVGILLFLILVGLLIFFLKRRNKKKQQKPELRDLVFSSPGDIPAEDFADHVRKNERDSNCGFADEYQQLSLVGHSQSQMVASASENNAKNRYRNVLPYDWSRVPLKPIHEEPGSDYINASFMPGLWSPQEFIATQGPLPQTVGDFWRLVWEQQSHTLVMLTNCMEAGRVKCEHYWPLDSQPCTHGHLRVTLVGEEVMENWTVRELLLLQVEEQKTLSVRQFHYQAWPDHGVPSSPDTLLAFWRMLRQWLDQTMEGGPPIVHCSAGVGRTGTLIALDVLLRQLQSEGLLGPFSFVRKMRESRPLMVQTEAQYVFLHQCILRFLQQSAQAPAEKEVPYEDVENLIYENVAAIQAHKLEV

SEQ ID NO: 3642 - protein, 1337 aa, unidentified
MKPAAREARLPPRSPGLRWALPLLLLLLRLGQILCAGGTPSPIPDPSVATVATGENGITQISSTAESFHKQNGTGTPQVETNTSEDGESSGANDSLRTPEQGSNGTDGASQKTPSSTGPSPVFDIKAVSISPTNVILTWKSNDTAASEYKYVVKHKMENEKTITVVHQPWCNITGLRPATSYVFSITPGIGNETWGDPRVIKVITEPIPVSDLRVALTGVRKAALSWSNGNGTASCRVLLESIGSHEELTQDSRLQVNISGLKPGVQYNINPYLLQSNKTKGDPLGTEGGLDASNTERSRAGSPTAPVHDESLVGPVDPSSGQQSRDTEVLLVGLEPGTRYNATVYSQAANGTEGQPQAIEFRTNAIQVFDVTAVNISATSLTLIWKVSDNESSSNYTYKIHVAGETDSSNLNVSEPRAVIPGLRSSTFYNITVCPVLGDIEGTPGFLQVHTPPVPVSDFRVTVVSTTEIGLAWSSHDAESFQMHITQEGAGNSRVEITTNQSIIIGGLFPGTKYCFEIVPKGPNGTEGASRTVCNRTVPSAVFDIHVVYVTTTEMWLDWKSPDGASEYVYHLVIESKHGSNHTSTYDKAITLQGLIPGTLYNITISPEVDHVWGDPNSTAQYTRPSNVSNIDVSTNTTAATLSWQNFDDASPTYSYCLLIEKAGNSSNATQVVTDIGITDATVTELIPGSSYTVEIFAQVGDGIKSLEPGRKSFCTDPASMASFDCEVVPKEPALVLKWTCPPGANAGFELEVSSGAWNNATHLESCSSENGTEYRTEVTYLNFSTSYNISITTVSCGKMAAPTRNTCTTGITDPPPPDGSPNITSVSHNSVKVKFSGFEASHGPIKAYAVILTTGEAGHPSADVLKYTYEDFKKGASDTYVTYLIRTEEKGRSQSLSEVLKYEIDVGNESTTLGYYNGKLEPLGSYRACVAGFTNITFHPQNKGLIDGAESYVSFSRYSDAVSLPQDPGVICGAVFGCIFGALVIVTVGGFIFWRKKRKDAKNNEVSFSQIKPKKSKLIRVENFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYWPSKQAQDYGDITVAMTSEIVLPEWTIRDFTVKNIQTSESHPLRQFHFTSWPDHGVPDTTDLLINFRYLVRDYMKQSPPESPILVHCSAGVGRTGTFIAIDRLIYQIENENTVDVYGIVYDLRMHRPLMVQTEDQYVFLNQCVLDIVRSQKDSKVDLIYQNTTAMTIYENLAPVTTFGKTNGYIA

SEQ ID NO: 3643 - protein, 1439 aa, unidentified
MDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAATEEPEVIPDPAKQTDRVVKIAGISAGILVFILLLLVVILIVKKSKLAKKRKDAMGNTRQEMTHMVNAMDRSYADQSTLHAEDPLSITFMDQHNFSPRYENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWPDHGVPYHATGLLSFIRRVKLSNPPSAGPIVVHCSAGAGRTGCYIVIDIMLDMAEREGVVDIYNCVKALRSRRINMVQTEEQYIFIHDAILEACLCGETAIPVCEFKAAYFDMIRIDSQTNSSHLKDEFQTLNSVTPRLQAEDCSIACLPRNHDKNRFMDMLPPDRCLPFLITIDGESSNYINAALMDSYRQPAAFIVTQYPLPNTVKDFWRLVYDYGCTSIVMLNEVDLSQGCPQYWPEEGMLRYGPIQVECMSCSMDCDVINRIFRICNLTRPQEGYLMVQQFQYLGWASHREVPGSKRSFLKLILQVEKWQEECEEGEGRTIIHCLNGGGRSGMFCAIGIVVEMVKRQNVVDVFHAVKTLRNSKPNMVEAPEQYRFCYDVALEYLESS

SEQ ID NO: 3644 - protein, 1452 aa, unidentified
MRGLGTCLATLAGLLLTAAGETFSGGCLFDEPYSTCGYSQSEGDDFNWEQVNTLTKPTSDPWMPSGSFMLVNASGRPEGQRAHLLLPQLKENDTHCIDFHYFVSSKSNSPPGLLNVYVKVNNGPLGNPIWNISGDPTRTWNRAELAISTFWPNFYQVIFEVITSGHQGYLAIDEVKVLGHPCTRTPHFLRIQNVEVNAGQFATFQCSAIGRTVAGDRLWLQGIDVRDAPLKEIKVTSSRRFIASFNVVNTTKRDAGKYRCMIRTEGGVGISNYAELVVKEPPVPIAPPQLASVGATYLWIQLNANSINGDGPIVAREVEYCTASGSWNDRQPVDSTSYKIGHLDPDTEYEISVLLTRPGEGGTGSPGPALRTRTKCADPMRGPRKLEVVEVKSRQITIRWEPFGYNVTRCHSYNLTVHYCYQVGGQEQVREEVSWDTENSHPQHTITNLSPYTNVSVKLILMNPEGRKESQELIVQTDEDLPGAVPTESIQGSTFEEKIFLQWREPTQTYGVITLYEITYKAVSSFDPEIDLSNQSGRVSKLGNETHFLFFGLYPGTTYSFTIRASTAKGFGPPATNQFTTKISAPSMPAYELETPLNQTDNTVTVMLKPAHSRGAPVSVYQIVVEEERPRRTKKTTEILKCYPVPIHFQNASLLNSQYYFAAEFPADSLQAAQPFTIGDNKTYNGYWNTPLLPYKSYRIYFQAASRANGETKIDCVQVATKGAATPKPVPEPEKQTDHTVKIAGVIAGILLFVIIFLGVVLVMKKRKLAKKRKETMSSTRQEMTVMVNSMDKSYAEQGTNCDEAFSFMDTHNLNGRSVSSPSSFTMKTNTLSTSVPNSYYPDETHTMASDTSSLVQSHTYKKREPADVPYQTGQLHPAIRVADLLQHITQMKCAEGYGFKEEYESFFEGQSAPWDSAKKDENRMKNRYGNIIAYDHSRVRLQTIEGDTNSDYINGNYIDGYHRPNHYIATQGPMQETIYDFWRMVWHENTASIIMVTNLVEVGRVKCCKYWPDDTEIYKDIKVTLIETELLAEYVIRTFAVEKRGVHEIREIRQFHFTGWPDHGVPYHATGLLGFVRQVKSKSPPSAGPLVVHCSAGAGRTGCFIVIDIMLDMAEREGVVDIYNCVRELRSRRVNMVQTEEQYVFIHDAILEACLCGDTSVPASQVRSLYYDMNKLDPQTNSSQIKEEFRTLNMVTPTLRVEDCSIALLPRNHEKNRCMDILPPDRCLPFLITIDGESSNYINAALMDSYKQPSAFIVTQHPLPNTVKDFWRLVLDYHCTSVVMLNDVDPAQLCPQYWPENGVHRHGPIQVEFVSADLEEDIISRIFRIYNAARPQDGYRMVQQFQFLGWPMYRDTPVSKRSFLKLIRQVDKWQEEYNGGEGRTVVHCLNGGGRSGTFCAISIVCEMLRHQRTVDVFHAVKTLRNNKPNMVDLLDQYKFCYEVALEYLNSG

SEQ ID NO: 3645 - protein, 979 aa, unidentified
MRRPRRPGGLGGSGGLRLLLCLLLLSSRPGGCSAVSAHGCLFDRRLCSHLEVCIQDGLFGQCQVGVGQARPLLQVTSPVLQRLQGVLRQLMSQGLSWHDDLTQYVISQEMERIPRLRPPEPRPRDRSGLAPKRPGPAGELLLQDIPTGSAPAAQHRLPQPPVGKGGAGASSSLSPLQAELLPPLLEHLLLPPQPPHPSLSYEPALLQPYLFHQFGSRDGSRVSEGSPGMVSVGPLPKAEAPALFSRTASKGIFGDHPGHSYGDLPGPSPAQLFQDSGLLYLAQELPAPSRARVPRLPEQGSSSRAEDSPEGYEKEGLGDRGEKPASPAVQPDAALQRLAAVLAGYGVELRQLTPEQLSTLLTLLQLLPKGAGRNPGGVVNVGADIKKTMEGPVEGRDTAELPARTSPMPGHPTASPTSSEVQQVPSPVSSEPPKAARPPVTPVLLEKKSPLGQSQPTVAGQPSARPAAEEYGYIVTDQKPLSLAAGVKLLEILAEHVHMSSGSFINISVVGPALTFRIRHNEQNLSLADVTQQAGLVKSELEAQTGLQILQTGVGQREEAAAVLPQTAHSTSPMRSVLLTLVALAGVAGLLVALAVALCVRQHARQQDKERLAALGPEGAHGDTTFEYQDLCRQHMATKSLFNRAEGPPEPSRVSSVSSQFSDAAQASPSSHSSTPSWCEEPAQANMDISTGHMILAYMEDHLRNRDRLAKEWQALCAYQAEPNTCATAQGEGNIKKNRHPDFLPYDHARIKLKVESSPSRSDYINASPIIEHDPRMPAYIATQGPLSHTIADFWQMVWESGCTVIVMLTPLVEDGVKQCDRYWPDEGASLYHVYEVNLVSEHIWCEDFLVRSFYLKNVQTQETRTLTQFHFLSWPAEGTPASTRPLLDFRRKVNKCYRGRSCPIIVHCSDGAGRTGTYILIDMVLNRMAKGVKEIDIAATLEHVRDQRPGLVRSKDQFEFALTAVAEEVNAILKALPQ

SEQ ID NO: 3646 - protein, 1015 aa, unidentified
MGPPLPLLLLLLLLLPPRVLPAAPSSVPRGRQLPGRLGCLLEEGLCGASEACVNDGVFGRCQKVPAMDFYRYEVSPVALQRLRVALQKLSGTGFTWQDDYTQYVMDQELADLPKTYLRRPEASSPARPSKHSVGSERRYSREGGAALANALRRHLPFLEALSQAPASDVLARTHTAQDRPPAEGDDRFSESILTYVAHTSALTYPPGSRTQLREDLLPRTLGQLQPDELSPKVDSGVDRHHLMAALSAYAAQRPPAPPGEGSLEPQYLLRAPSRMPRPLLAPAAPQKWPSPLGDSEDPSSTGDGARIHTLLKDLQRQPAEVRGLSGLELDGMAELMAGLMQGVDHGVARGSPGRAALGESGEQADGPKATLRGDSFPDDGVQDDDDRLYQEVHRLSATLGGLLQDHGSRLLPGALPFARPLDMERKKSEHPESSLSSEEETAGVENVKSQTYSKDLLGQQPHSEPGAAAFGELQNQMPGPSKEEQSLPAGAQEALSDGLQLEVQPSEEEARGYIVTDRDPLRPEEGRRLVEDVARLLQVPSSAFADVEVLGPAVTFKVSANVQNVTTEDVEKATVDNKDKLEETSGLKILQTGVGSKSKLKFLPPQAEQEDSTKFIALTLVSLACILGVLLASGLIYCLRHSSQHRLKEKLSGLGGDPGADATAAYQELCRQRMATRPPDRPEGPHTSRISSVSSQFSDGPIPSPSARSSASSWSEEPVQSNMDISTGHMILSYMEDHLKNKNRLEKEWEALCAYQAEPNSSFVAQREENVPKNRSLAVLTYDHSRVLLKAENSHSHSDYINASPIMDHDPRNPAYIATQGPLPATVADFWQMVWESGCVVIVMLTPLAENGVRQCYHYWPDEGSNLYHIYEVNLVSEHIWCEDFLVRSFYLKNLQTNETRTVTQFHFLSWYDRGVPSSSRSLLDFRRKVNKCYRGRSCPIIVHCSDGAGRSGTYVLIDMVLNKMAKGAKEIDIAATLEHLRDQRPGMVQTKEQFEFALTAVAEEVNAILKALPQ

SEQ ID NO: 3647 - protein, 1216 aa, unidentified
MGHLPTGIHGARRLLPLLWLFVLFKNATAFHVTVQDDNNIVVSLEASDVISPASVYVVKITGESKNYFFEFEEFNSTLPPPVIFKASYHGLYYIITLVVVNGNVVTKPSRSITVLTKPLPVTSVSIYDYKPSPETGVLFEIHYPEKYNVFTRVNISYWEGKDFRTMLYKDFFKGKTVFNHWLPGMCYSNITFQLVSEATFNKSTLVEYSGVSHEPKQHRTAPYPPQNISVRIVNLNKNNWEEQSGNFPEESFMRSQDTIGKEKLFHFTEETPEIPSGNISSGWPDFNSSDYETTSQPYWWDSASAAPESEDEFVSVLPMEYENNSTLSETEKSTSGSFSFFPVQMILTWLPPKPPTAFDGFHIHIEREENFTEYLMVDEEAHEFVAELKEPGKYKLSVTTFSSSGSCETRKSQSAKSLSFYISPSGEWIEELTEKPQHVSVHVLSSTTALMSWTSSQENYNSTIVSVVSLTCQKQKESQRLEKQYCTQVNSSKPIIENLVPGAQYQVVIYLRKGPLIGPPSDPVTFAIVPTGIKDLMLYPLGPTAVVLSWTRPYLGVFRKYVVEMFYFNPATMTSEWTTYYEIAATVSLTASVRIANLLPAWYYNFRVTMVTWGDPELSCCDSSTISFITAPVAPEITSVEYFNSLLYISWTYGDDTTDLSHSRMLHWMVVAEGKKKIKKSVTRNVMTAILSLPPGDIYNLSVTACTERGSNTSMLRLVKLEPAPPKSLFAVNKTQTSVTLLWVEEGVADFFEVFCQQVGSSQKTKLQEPVAVSSHVVTISSLLPATAYNCSVTSFSHDSPSVPTFIAVSTMVTEMNPNVVVISVLAILSTLLIGLLLVTLIILRKKHLQMARECGAGTFVNFASLERDGKLPYNWRRSIFAFLTLLPSCLWTDYLLAFYINPWSKNGLKKRKLTNPVQLDDFDAYIKDMAKDSDYKFSLQFEELKLIGLDIPHFAADLPLNRCKNRYTNILPYDFSRVRLVSMNEEEGADYINANYIPGYNSPQEYIATQGPLPETRNDFWKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCSAGVGRTGTFIALDRLLQHIRDHEFVDILGLVSEMRSYRMSMVQTEEQYIFIHQCVQLMWMKKKQQFCISDVIYENVSKS

SEQ ID NO: 3648 - protein, 657 aa, unidentified
MRRAVCFPALCLLLNLHAAGCFSGNNDHFLAINQKKSGKPVFIYKHSQDIEKSLDIAPQKIYRHSYHSSSEAQVSKRHQIVNSAFPRPAYDPSLNLLAMDGQDLEVENLPIPAANVIVVTLQMDVNKLNITLLRIFRQGVAAALGLLPQQVHINRLIGKKNSIELFVSPINRKTGISDALPSEEVLRSLNINVLHQSLSQFGITEVSPEKNVLQGQHEADKIWSKEGFYAVVIFLSIFVIIVTCLMILYRLKERFQLSLRQDKEKNQEIHLSPITLQPALSEAKTVHSMVQPEQAPKVLNVVVDPQGRGAPEIKATTATSVCPSPFKMKPIGLQERRGSNVSLTLDMSSLGNIEPFVSIPTPREKVAMEYLQSASRILTRSQLRDVVASSHLLQSEFMEIPMNFVDPKEIDIPRHGTKNRYKTILPNPLSRVCLRPKNVTDSLSTYINANYIRGYSGKEKAFIATQGPMINTVDDFWQMVWQEDSPVIVMITKLKEKNEKCVLYWPEKRGIYGKVEVLVISVNECDNYTIRNLVLKQGSHTQHVKHYWYTSWPDHKTPDSAQPLLQLMLDVEEDRLASQGRGPVVVHCSAGIGRTGCFIATSIGCQQLKEEGVVDALSIVCQLRMDRGGMVQTSEQYEFVHHALCLYESRLSAETVQ

SEQ ID NO: 3649 - protein, 1948 aa, unidentified
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSETFESTPIRGALQIESSEETDQGKYECVATNSAGVRYSSPANLYVRELREVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSKPSAPPQDVKCVSVRSTAILVSWRPPPPETHNGALVGYSVRYRPLGSEDPEPKEVNGIPPTTTQILLEALEKWTQYRITTVAHTEVGPGPESSPVVVRTDEDVPSAPPRKVEAEALNATAIRVLWRSPAPGRQHGQIRGYQVHYVRMEGAEARGPPRIKDVMLADAQWETDDTAEYEMVITNLQPETAYSITVAAYTMKGDGARSKPKVVVTKGAVLGRPTLSVQQTPEGSLLARWEPPAGTAEDQVLGYRLQFGREDSTPLATLEFPPSEDRYTASGVHKGATYVFRLAARSRGGLGEEAAEVLSIPEDTPRGHPQILEAAGNASAGTVLLRWLPPVPAERNGAIVKYTVAVREAGALGPARETELPAAAEPGAENALTLQGLKPDTAYDLQVRAHTRRGPGPFSPPVRYRTFLRDQVSPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISRLQRRSLRHSRQLEVPRPYIAARFSVLPPTFHPGDQKQYGGFDNRGLEPGHRYVLFVLAVLQKSEPTFAASPFSDPFQLDNPDPQPIVDGEEGLIWVIGPVLAVVFIICIVIAILLYKNKPDSKRKDSEPRTKCLLNNADLAPHHPKDPVEMRRINFQTPDSGLRSPLREPGFHFESMLSHPPIPIADMAEHTERLKANDSLKLSQEYESIDPGQQFTWEHSNLEVNKPKNRYANVIAYDHSRVILQPIEGIMGSDYINANYVDGYRCQNAYIATQGPLPETFGDFWRMVWEQRSATIVMMTRLEEKSRIKCDQYWPNRGTETYGFIQVTLLDTIELATFCVRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDEYQFCYQAALEYLGSFDHYAT

SEQ ID NO: 3650 - protein, 1441 aa, unidentified
MASLAALALSLLLRLQLPPLPGARAQSAAGGCSFDEHYSNCGYSVALGTNGFTWEQINTWEKPMLDQAVPTGSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGPPLTTRTKCADPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKGASTQNSNTVEPEKQVDNTVKMAGVIAGLLMFIIILLGVMLTIKRRRNAYSYSYYLKLAKKQKETQSGAQREMGPVASADKPTTKLSASRNDEGFSSSSQDVNGFTDGSRGELSQPTLTIQTHPYRTCDPVEMSYPRDQFQPAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF

SEQ ID NO: 3651 - protein, 1446 aa, unidentified
MARAQALVLALTFQLCAPETETPAAGCTFEEASDPAVPCEYSQAQYDDFQWEQVRIHPGTRAPADLPHGSYLMVNTSQHAPGQRAHVIFQSLSENDTHCVQFSYFLYSRDGHSPGTLGVYVRVNGGPLGSAVWNMTGSHGRQWHQAELAVSTFWPNEYQVLFEALISPDRRGYMGLDDILLLSYPCAKAPHFSRLGDVEVNAGQNASFQCMAAGRAAEAERFLLQRQSGALVPAAGVRHISHRRFLATFPLAAVSRAEQDLYRCVSQAPRGAGVSNFAELIVKEPPTPIAPPQLLRAGPTYLIIQLNTNSIIGDGPIVRKEIEYRMARGPWAEVHAVSLQTYKLWHLDPDTEYEISVLLTRPGDGGTGRPGPPLISRTKCAEPMRAPKGLAFAEIQARQLTLQWEPLGYNVTRCHTYTVSLCYHYTLGSSHNQTIRECVKTEQGVSRYTIKNLLPYRNVHVRLVLTNPEGRKEGKEVTFQTDEDVPSGIAAESLTFTPLEDMIFLKWEEPQEPNGLITQYEISYQSIESSDPAVNVPGPRRTISKLRNETYHVFSNLHPGTTYLFSVRARTGKGFGQAALTEITTNISAPSFDYADMPSPLGESENTITVLLRPAQGRGAPISVYQVIVEEERARRLRREPGGQDCFPVPLTFEAALARGLVHYFGAELAASSLPEAMPFTVGDNQTYRGFWNPPLEPRKAYLIYFQAASHLKGETRLNCIRIARKAACKESKRPLEVSQRSEEMGLILGICAGGLAVLILLLGAIIVIIRKGRDHYAYSYYPKPVNMTKATVNYRQEKTHMMSAVDRSFTDQSTLQEDERLGLSFMDTHGYSTRGDQRSGGVTEASSLLGGSPRRPCGRKGSPYHTGQLHPAVRVADLLQHINQMKTAEGYGFKQEYESFFEGWDATKKKDKVKGSRQEPMPAYDRHRVKLHPMLGDPNADYINANYIDGYHRSNHFIATQGPKPEMVYDFWRMVWQEHCSSIVMITKLVEVGRVKCSRYWPEDSDTYGDIKIMLVKTETLAEYVVRTFALERRGYSARHEVRQFHFTAWPEHGVPYHATGLLAFIRRVKASTPPDAGPIVIHCSAGTGRTGCYIVLDVMLDMAECEGVVDIYNCVKTLCSRRVNMIQTEEQYIFIHDAILEACLCGETTIPVSEFKATYKEMIRIDPQSNSSQLREEFQTLNSVTPPLDVEECSIALLPRNRDKNRSMDVLPPDRCLPFLISTDGDSNNYINAALTDSYTRSAAFIVTLHPLQSTTPDFWRLVYDYGCTSIVMLNQLNQSNSAWPCLQYWPEPGRQQYGLMEVEFMSGTADEDLVARVFRVQNISRLQEGHLLVRHFQFLRWSAYRDTPDSKKAFLHLLAEVDKWQAESGDGRTIVHCLNGGGRSGTFCACATVLEMIRCHNLVDVFFAAKTLRNYKPNMVETMDQYHFCYDVALEYLEGLESR

SEQ ID NO: 3652 - protein, 2315 aa, unidentified
MRILKRFLACIQLLCVCRLDWANGYYRQQRKLVEEIGWSYTGALNQKNWGKKYPTCNSPKQSPINIDEDLTQVNVNLKKLKFQGWDKTSLENTFIHNTGKTVEINLTNDYRVSGGVSEMVFKASKITFHWGKCNMSSDGSEHSLEGQKFPLEMQIYCFDADRFSSFEEAVKGKGKLRALSILFEVGTEENLDFKAIIDGVESVSRFGKQAALDPFILLNLLPNSTDKYYIYNGSLTSPPCTDTVDWIVFKDTVSISESQLAVFCEVLTMQQSGYVMLMDYLQNNFREQQYKFSRQVFSSYTGKEEIHEAVCSSEPENVQADPENYTSLLVTWERPRVVYDTMIEKFAVLYQQLDGEDQTKHEFLTDGYQDLGAILNNLLPNMSYVLQIVAICTNGLYGKYSDQLIVDMPTDNPELDLFPELIGTEEIIKEEEEGKDIEEGAIVNPGRDSATNQIRKKEPQISTTTHYNRIGTKYNEAKTNRSPTRGSEFSGKGDVPNTSLNSTSQPVTKLATEKDISLTSQTVTELPPHTVEGTSASLNDGSKTVLRSPHMNLSGTAESLNTVSITEYEEESLLTSFKLDTGAEDSSGSSPATSAIPFISENISQGYIFSSENPETITYDVLIPESARNASEDSTSSGSEESLKDPSMEGNVWFPSSTDITAQPDVGSGRESFLQTNYTEIRVDESEKTTKSFSAGPVMSQGPSVTDLEMPHYSTFAYFPTEVTPHAFTPSSRQQDLVSTVNVVYSQTTQPVYNGETPLQPSYSSEVFPLVTPLLLDNQILNTTPAASSSDSALHATPVFPSVDVSFESILSSYDGAPLLPFSSASFSSELFRHLHTVSQILPQVTSATESDKVPLHASLPVAGGDLLLEPSLAQYSDVLSTTHAASETLEFGSESGVLYKTLMFSQVEPPSSDAMMHARSSGPEPSYALSDNEGSQHIFTVSYSSAIPVHDSVGVTYQGSLFSGPSHIPIPKSSLITPTASLLQPTHALSGDGEWSGASSDSEFLLPDTDGLTALNISSPVSVAEFTYTTSVFGDDNKALSKSEIIYGNETELQIPSFNEMVYPSESTVMPNMYDNVNKLNASLQETSVSISSTKGMFPGSLAHTTTKVFDHEISQVPENNFSVQPTHTVSQASGDTSLKPVLSANSEPASSDPASSEMLSPSTQLLFYETSASFSTEVLLQPSFQASDVDTLLKTVLPAVPSDPILVETPKVDKISSTMLHLIVSNSASSENMLHSTSVPVFDVSPTSHMHSASLQGLTISYASEKYEPVLLKSESSHQVVPSLYSNDELFQTANLEINQAHPPKGRHVFATPVLSIDEPLNTLINKLIHSDEILTSTKSSVTGKVFAGIPTVASDTFVSTDHSVPIGNGHVAITAVSPHRDGSVTSTKLLFPSKATSELSHSAKSDAGLVGGGEDGDTDDDGDDDDDDRGSDGLSIHKCMSCSSYRESQEKVMNDSDTHENSLMDQNNPISYSLSENSEEDNRVTSVSSDSQTGMDRSPGKSPSANGLSQKHNDGKEENDIQTGSALLPLSPESKAWAVLTSDEESGSGQGTSDSLNENETSTDFSFADTNEKDADGILAAGDSEITPGFPQSPTSSVTSENSEVFHVSEAEASNSSHESRIGLAEGLESEKKAVIPLVIVSALTFICLVVLVGILIYWRKCFQTAHFYLEDSTSPRVISTPPTPIFPISDDVGAIPIKHFPKHVADLHASSGFTEEFETLKEFYQEVQSCTVDLGITADSSNHPDNKHKNRYINIVAYDHSRVKLAQLAEKDGKLTDYINANYVDGYNRPKAYIAAQGPLKSTAEDFWRMIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTEEQYVFIHDTLVEAILSKETEVLDSHIHAYVNALLIPGPAGKTKLEKQFQLLSQSNIQQSDYSAALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMAEEHKCLSNEEKLIIQDFILEATQDDYVLEVRHFQCPKWPNPDSPISKTFELISVIKEEAANRDGPMIVHDEHGGVTAGTFCALTTLMHQLEKENSVDVYQVAKMINLMRPGVFADIEQYQFLYKVILSLVSTRQEENPSTSLDSNGAALPDGNIAESLESLV

SEQ ID NO: 3653 - protein, 179 aa, unidentified
MPSKSLVMEYLAHPSTLGLAVGVACGMCLGWSLRVCFGMLPKSKTSKTHTDTESEASILGDSGEYKMILVVRNDLKMGKGKVAAQCSHAAVSAYKQIQRRNPEMLKQWEYCGQPKVVVKAPDEETLIALLAHAKMLGLTVSLIQDAGRTQIAPGSQTVLGIGPGPADLIDKVTGHLKLY

SEQ ID NO: 3654 - protein, 180 aa, unidentified
MAPGVARGPTPYWRLRLGGAALLLLLIPVAAAQEPPGAACSQNTNKTCEECLKNVSCLWCNTNKACLDYPVTSVLPPASLCKLSSARWGVCWVNFEALIITMSVVGGTLLLGIAICCCCCCRRKRSRKPDRSEEKAMREREERRIRQEERRAEMKTRHDEIRKKYGLFKEENPYARFENN

SEQ ID NO: 3655 - protein, 417 aa, unidentified
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRNAIIFLVLGILVFLILLGIGIYFYWSKCSREVLWHCHLCPSSTEHASASANGHVSYSAVSRENSSSQDPQTEGTR

SEQ ID NO: 3656 - protein, 326 aa, unidentified
MRTEAQVPALQPPEPGLEGAMGHRTLVLPWVLLTLCVTAGTPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGSLPPSSDPGLSAPPTPAPILRADLAGILGVSGVLLFGCVYLLHLLRRHKHRPAPRLQPSRTSPQAPRARAWAPSQASQAALHVPYATINTSCRPATLDTAHPHGGPSWWASLPTHAAHRPQGPAAWASTPIPARGSFVSVENGLYAQAGERPPHTGPGLTLFPDPRGPRAMEGPLGVR

SEQ ID NO: 3657 - protein, 195 aa, unidentified
MAPAASRLRAEAGLGALPRRALAQYLLFLRLYPVLTKAATSGILSALGNFLAQMIEKKRKKENSRSLDVGGPLRYAVYGFFFTGPLSHFFYFFMEHWIPPEVPLAGLRRLLLDRLVFAPAFLMLFFLIMNFLEGKDASAFAAKMRGGFWPALRMNWRVWTPLQFININYVPLKFRVLFANLAALFWYAYLASLGK

SEQ ID NO: 3658 - protein, 212 aa, unidentified
MAAPPQLRALLVVVNALLRKRRYHAALAVLKGFRNGAVYGAKIRAPHALVMTFLFRNGSLQEKLWAILQATYIHSWNLARFVFTYKGLRALQSYIQGKTYPAHAFLAAFLGGILVFGENNNINSQINMYLLSRVLFALSRLAVEKGYIPEPRWDPFPLLTAVVWGLVLWLFEYHRSTLQPSLQSSMTYLYEDSNVWHDISDFLVYNKSRPSN

SEQ ID NO: 3659 - protein, 775 aa, unidentified
MAALDSLSLFTSLGLSEQKARETLKNSALSAQLREAATQAQQTLGSTIDKATGILLYGLASRLRDTRRLSFLVSYIASKKIHTEPQLSAALEYVRSHPLDPIDTVDFERECGVGVIVTPEQIEEAVEAAINRHRPQLLVERYHFNMGLLMGEARAVLKWADGKMIKNEVDMQVLHLLGPKLEADLEKKFKVAKARLEETDRRTAKDVVENGETADQTLSLMEQLRGEALKFHKPGENYKTPGYVVTPHTMNLLKQHLEITGGQVRTRFPPEPNGILHIGHAKAINFNFGYAKANNGICFLRFDDTNPEKEEAKFFTAICDMVAWLGYTPYKVTYASDYFDQLYAWAVELIRRGLAYVCHQRGEELKGHNTLPSPWRDRPMEESLLLFEAMRKGKFSEGEATLRMKLVMEDGKMDPVAYRVKYTPHHRTGDKWCIYPTYDYTHCLCDSIEHITHSLCTKEFQARRSSYFWLCNALDVYCPVQWEYGRLNLHYAVVSKRKILQLVATGAVRDWDDPRLFTLTALRRRGFPPEAINNFCARVGVTVAQTTMEPHLLEACVRDVLNDTAPRAMAVLESLRVIITNFPAAKSLDIQVPNFPADETKGFHQVPFAPIVFIERTDFKEEPEPGFKRLAWGQPVGLRHTGYVIELQHVVKGPSGCVESLEVTCRRADAGEKPKAFIHWVSQPLMCEVRLYERLFQHKNPEDPTEVPGGFLSDLNLASLHVVDAALVDCSVALAKPFDKFQFERLGYFSVDPDSHQGKLVFNRTVTLKEDPGKV

SEQ ID NO: 3660 - protein, 431 aa, unidentified
MQALNITPEQFSRLLRDHNLTREQFIALYRLRPLVYTPELPGRAKLALVLTGVLIFALALFGNALVFYVVTRSKAMRTVTNIFICSLALSDLLITFFCIPVTMLQNISDNWLGGAFICKMVPFVQSTAVVTEILTMTCIAVERHQGLVHPFKMKWQYTNRRAFTMLGVVWLVAVIVGSPMWHVQQLEIKYDFLYEKEHICCLEEWTSPVHQKIYTTFILVILFLLPLMVMLILYSKIGYELWIKKRVGDGSVLRTIHGKEMSKIARKKKRAVIMMVTVVALFAVCWAPFHVVHMMIEYSNFEKEYDDVTIKMIFAIVQIIGFSNSICNPIVYAFMNENFKKNVLSAVCYCIVNKTFSPAQRHGNSGITMMRKKAKFSLRENPVEETKGEAFSDGNIEVKLCEQTEEKKKLKRHLALFRSELAENSPLDSGH

SEQ ID NO: 3661 - protein, 747 aa, unidentified
MRRCNSGSGPPPSLLLLLLWLLAVPGANAAPRSALYSPSDPLTLLQADTVRGAVLGSRSAWAVEFFASWCGHCIAFAPTWKALAEDVKAWRPALYLAALDCAEETNSAVCRDFNIPGFPTVRFFKAFTKNGSGAVFPVAGADVQTLRERLIDALESHHDTWPPACPPLEPAKLEEIDGFFARNNEEYLALIFEKGGSYLGREVALDLSQHKGVAVRRVLNTEANVVRKFGVTDFPSCYLLFRNGSVSRVPVLMESRSFYTAYLQRLSGLTREAAQTTVAPTTANKIAPTVWKLADRSKIYMADLESALHYILRIEVGRFPVLEGQRLVALKKFVAVLAKYFPGRPLVQNFLHSVNEWLKRQKRNKIPYSFFKTALDDRKEGAVLAKKVNWIGCQGSEPHFRGFPCSLWVLFHFLTVQAARQNVDHSQEAAKAKEVLPAIRGYVHYFFGCRDCASHFEQMAAASMHRVGSPNAAVLWLWSSHNRVNARLAGAPSEDPQFPKVQWPPRELCSACHNERLDVPVWDVEATLNFLKAHFSPSNIILDFPAAGSAARRDVQNVAAAPELAMGALELESRNSTLDPGKPEMMKSPTNTTPHVPAEGPEASRPPKLHPGLRAAPGQEPPEHMAELQRNEQEQPLGQWHLSKRDTGAALLAESRAEKNRLWGPLEVRRVGRSSKQLVDIPEGQLEARAGRGRGQWLQVLGGGFSYLDISLCVGLYSLSFMGLLAMYTYFQAKIRALKGHAGHPAA

SEQ ID NO: 3662 - protein, 698 aa, unidentified
MAAAGAAVARSPGIGAGPALRARRSPPPRAARLPRLLVLLAAAAVGPGAGGAARLYRAGEDAVWVLDSGSVRGATANSSAAWLVQFYSSWCGHCIGYAPTWRALAGDVRDWASAIRVAALDCMEEKNQAVCHDYDIHFYPTFRYFKAFTKEFTTGENFKGPDRELRTVRQTMIDFLQNHTEGSRPPACPRLDPIQPSDVLSLLDNRGSHYVAIVFESNSSYLGREVILDLIPYESIVVTRALDGDKAFLEKLGVSSVPSCYLIYPNGSHGLINVVKPLRAFFSSYLKSLPDVRKKSLPLPEKPHKEENSEIVVWREFDKSKLYTVDLESGLHYLLRVELAAHKSLAGAELKTLKDFVTVLAKLFPGRPPVKKLLEMLQEWLASLPLDRIPYNAVLDLVNNKMRISGIFLTNHIKWVGCQGSRSELRGYPCSLWKLFHTLTVEASTHPDALVGTGFEDDPQAVLQTMRRYVHTFFGCKECGEHFEEMAKESMDSVKTPDQAILWLWKKHNMVNGRLAGHLSEDPRFPKLQWPTPDLCPACHEEIKGLASWDEGHVLTFLKQHYGRDNLLDTYSADQGDSSEGGTLARGEEEEKRLTPPEVSHGDRDTQSVRPPGALGPRPALPESLHHSLDGKLQSLDGPGAHKEVGGAAPFLGVDFSSLDMSLCVVLYVASSLFLMVMYFFFRVRSRRWKVKHHHPAV

SEQ ID NO: 3663 - protein, 206 aa, unidentified
MDEDVLTTLKILIIGESGVGKSSLLLRFTDDTFDPELAATIGVDFKVKTISVDGNKAKLAIWDTAGQERFRTLTPSYYRGAQGVILVYDVTRRDTFVKLDNWLNELETYCTRNDIVNMLVGNKIDKENREVDRNEGLKFARKHSMLFIEASAKTCDGVQCAFEELVEKIIQTPGLWESENQNKGVKLSHREEGQGGGACGGYCSVL

SEQ ID NO: 3664 - protein, 185 aa, unidentified
MAAQKDQQKDAEAEGLSGTTLLPKLIPSGAGREWLERRRATIRPWSTFVDQQRFSRPRNLGELCQRLVRNVEYYQSNYVFVFLGLILYCVVTSPMLLVALAVFFGACYILYLRTLESKLVLFGREVSPAHQYALAGGISFPFFWLAGAGSAVFWVLGATLVVIGSHAAFHQIEAVDGEELQMEPV

SEQ ID NO: 3665 - protein, 1069 aa, unidentified
MDDKASVGKISVSSDSVSTLNSEDFVLVSRQGDETPSTNNGSDDEKTGLKIVGNGSEQQLQKELADVLMDPPMDDQPGEKELVKRSQLDGEGDGPLSNQLSASSTINPVPLVGLQKPEMSLPVKPGQGDSEASSPFTPVADEDSVVFSKLTYLGCASVNAPRSEVEALRMMSILRSQCQISLDVTLSVPNVSEGIVRLLDPQTNTEIANYPIYKILFCVRGHDGTPESDCFAFTESHYNAELFRIHVFRCEIQEAVSRILYSFATAFRRSAKQTPLSATAAPQTPDSDIFTFSVSLEIKEDDGKGYFSAVPKDKDRQCFKLRQGIDKKIVIYVQQTTNKELAIERCFGLLLSPGKDVRNSDMHLLDLESMGKSSDGKSYVITGSWNPKSPHFQVVNEETPKDKVLFMTTAVDLVITEVQEPVRFLLETKVRVCSPNERLFWPFSKRSTTENFFLKLKQIKQRERKNNTDTLYEVVCLESESERERRKTTASPSVRLPQSGSQSSVIPSPPEDDEEEDNDEPLLSGSGDVSKECAEKILETWGELLSKWHLNLNVRPKQLSSLVRNGVPEALRGEVWQLLAGCHNNDHLVEKYRILITKESPQDSAITRDINRTFPAHDYFKDTGGDGQDSLYKICKAYSVYDEEIGYCQGQSFLAAVLLLHMPEEQAFSVLVKIMFDYGLRELFKQNFEDLHCKFYQLERLMQEYIPDLYNHFLDISLEAHMYASQWFLTLFTAKFPLYMVFHIIDLLLCEGISVIFNVALGLLKTSKDDLLLTDFEGALKFFRVQLPKRYRSEENAKKLMELACNMKISQKKLKKYEKEYHTMREQQAQQEDPIERFERENRRLQEANMRLEQENDDLAHELVTSKIALRKDLDNAEEKADALNKELLMTKQKLIDAEEEKRRLEEESAQLKEMCRRELDKAESEIKKNSSIIGDYKQICSQLSERLEKQQTANKVEIEKIRQKVDDCERCREFFNKEGRVKGISSTKEVLDEDTDEEKETLKNQLREMELELAQTKLQLVEAECKIQDLEHHLGLALNEVQAAKKTWFNRTLSSIKTATGVQGKETC

SEQ ID NO: 3666 - protein, 253 aa, unidentified
MIENSSWSMTFEERENRRLQEASMRLEQENDDLAHELVTSKIALRNDLDQAEDKADVLNKELLLTKQRLVETEEEKRKQEEETAQLKEVFRKQLEKAEYEIKKTTAIIAEYKQICSQLSTRLEKQQAASKEELEVVKGKMMACKHCSDIFSKEGALKLAATGREDQGIETDDEKDSLKKQLREMELELAQTKLQLVEAKCKIQELEHQRGALMNEIQAAKNSWFSKTLNSIKTATGTQPLQPAPVTQPPKEST

SEQ ID NO: 3667 - protein, 384 aa, unidentified
MGSKKLKRVGLSQELCDRLSRHQILTCQDFLCLSPLELMKVTGLSYRGVHELLCMVSRACAPKMQTAYGIKAQRSADFSPAFLSTTLSALDEALHGGVACGSLTEITGPPGCGKTQFCIMMSILATLPTNMGGLEGAVVYIDTESAFSAERLVEIAESRFPRYFNTEEKLLLTSSKVHLYRELTCDEVLQRIESLEEEIISKGIKLVILDSVASVVRKEFDAQLQGNLKERNKFLAREASSLKYLAEEFSIPVILTNQITTHLSGALASQADLVSPADDLSLSEGTSGSSCVIAALGNTWSHSVNTRLILQYLDSERRQILIAKSPLAPFTSFVYTIKEEGLVLQETTFCSVTQAELNWAPEILPPQPPEQLGLQMCHHTQLIF

SEQ ID NO: 3668 - protein, 263 aa, unidentified
MRRISLTSSPVRLLLFLLLLLIALEIMVGGHSLCFNFTIKSLSRPGQPWCEAQVFLNKNLFLQYNSDNNMVKPLGLLGKKVYATSTWGELTQTLGEVGRDLRMLLCDIKPQIKTSDPSTLQVEMFCQREAERCTGASWQFATNGEKSLLFDAMNMTWTVINHEASKIKETWKKDRGLEKYFRKLSKGDCDHWLREFLGHWEAMPEPTVSPVNASDIHWSSSSLPDRWIILGAFILLVLMGIVLICVWWQNGEWQAGLWPLRTS

SEQ ID NO: 3669 - protein, 334 aa, unidentified
MAAAASPAFLLRLPLLLLLSSWCRTGLADPHSLCYDITVIPKFRPGPRWCAVQGQVDEKTFLHYDCGSKTVTPVSPLGKKLNVTTAWKAQNPVLREVVDILTEQLLDIQLENYIPKEPLTLQARMSCEQKAEGHGSGSWQLSFDGQIFLLFDSENRMWTTVHPGARKMKEKWENDKDMTMSFHYISMGDCTGWLEDFLMGMDSTLEPSAGAPPTMSSGTAQPRATATTLILCCLLIMCLLICSRHSLTQSHGHHPQSLQPPPHPPLLHPTWLLRRVLWSDSYQIAKRPLSGGHVTRVTLPIIGDDSHSLPCPLALYTINNGAARYSEPLQVSIS

SEQ ID NO: 3670 - protein, 246 aa, unidentified
MAAAAIPALLLCLPLLFLLFGWSRARRDDPHSLCYDITVIPKFRPGPRWCAVQGQVDEKTFLHYDCGNKTVTPVSPLGKKLNVTMAWKAQNPVLREVVDILTEQLLDIQLENYTPKEPLTLQARMSCEQKAEGHSSGSWQFSIDGQTFLLFDSEKRMWTTVHPGARKMKEKWENDKDVAMSFHYISMGDCIGWLEDFLMGMDSTLEPSAGAPLAMSSGTTQLRATATTLILCCLLIILPCFILPGI

SEQ ID NO: 3671 - protein, 2036 aa, unidentified
MFSKKPHGDVKKSTQKVLDTKKDALTRLKHLRIVIENAESIDLKQFFDQHFSHIYYVFFENFVTIEASLKQKGHKSQREELDAILFIFEKILQLLPERIHQRWQFHSIGLILKKLLHTGNSLKIRREGVRLFLLWLQALQNNCSKEQLWMFSCLIPGFSAPQSEHGPRTLDNLINPPLNLQETQVTIEEITPLVPPQSGDKGQEDLTSYFLEALLKYIVIQVKSLEWKNKENQERGFSFLFSHFKKYYLPYIFPNICKENSLYHPILDIPQMRPKPHYVVIKKDAETNEAIYCTKEPFIKARVIVIRWLVSFWLEPKPHTGPHIPGMEGEVLPKNIQRAAASLVSREESKNDNADKTDRTTEPEQSHSNTSTLTEREPSSSSLCSIDEEHLTDIEIVRRVFSSKRSNVNFVTEIFRQAFLLPICEAAAMRKVVKVYQEWIQQEEKPLFMQEPEEIVITSSDLPCIENVTDHDISMEEGEKREEENGTNTADHVRNSSWAKNGSYQGALHNASEEATEQNIRAGTQAVLQVFIINSSNIFLLEPANEIKNLLDEHTDMCKRILNIYRYMVVQVSMDKKTWEQMLLVLLRVTESVLKMPSQAFLQFQGKKNMTLAGRLAGPLFQTLIVAWIKANLNVYISRELWDDLLSVLSSLTYWEELATEWSLTMETLTKVLARNLYSLDLSDLPLDKLSEQKQKKHKGKGVGHEFQKVSVDKSFSRGWSRDQPGQAPMRQRSATTTGSPGTEKARSIVRQKTVDIDDAQILPRSTRVRHFSQSEETGNEVFGALNEEQPLPRSSSTSDILEPFTVERAKVNKEDMSQKLPPLNSDIGGSSANVPDLMDEFIAERLRSGNASTMTRRGSSPGSLEIPKDLPDILNKQNQMRPIDDPGVPSEWTSPASAGSSDLISSDSHSDSFSAFQYDGRKFDNFGFGTDTGVTSSADVDSGSGHHQSAEEQEVASLTTLHIDSETSSLNQQAFSAEVATITGSESASPVHSPLGSRSQTPSPSTLNIDHMEQKDLQLDEKLHHSVLQTPDDLEISEFPSECCSVMAGGTLTGWHADVATVMWRRMLGILGDVNSIMDPEIHAQVFDYLCELWQNLAKIRDNLGISTDNLTSPSPPVLIPPLRILTPWLFKATMLTDKYKQGKLHAYKLICNTMKRRQDVSPNRDFLTHFYNIMHCGLLHIDQDIVNTIIKHCSPQFFSLGLPGATMLIMDFIVAAGRVASSAFLNAPRVEAQVLLGSLVCFPNLYCELPSLHPNIPDVAVSQFTDVKELIIKTVLSSARDEPSGPARCVALCSLGIWICEELVHESHHPQIKEALNVICVSLKFTNKTVAHVACNMLHMLVHYVPRLQIYQPDSPLKIIQILIATITHLLPSTEASSYEMDKRLVVSLLLCLLDWIMALPLKTLLQPFHATGAESDKTEKSVLNCIYKVLHGCVYGAQCFSNPRYFPMSLSDLASVDYDPFMHLESLKEPEPLHSPDSERSSKLQPVTEVKTQMQHGLISIAARTVITHLVNHLGHYPMSGGPAMLTSQVCENHDNHYSESTELSPELFESPNIQFFVLNNTTLVSCIQIRSEENMPGGGLSAGLASANSNVRIIVRDLSGKYSWDSAILYGPPPVSGLSEPTSFMLSLSHQEKPEEPPTSNECLEDITVKDGLSLQFKRFRETVPTWDTIRDEEDVLDELLQYLGVTSPECLQRTGISLNIPAPQPVCISEKQENDVINAILKQHTEEKEFVEKHFNDLNMKAVEQDEPIPQKPQSAFYYCRLLLSILGMNSWDKRRSFHLLKKNEKLLRELRNLDSRQCRETHKIAVFYVAEGQEDKHSILTNTGGSQAYEDFVAGLGWEVNLTNHCGFMGGLQKNKSTGLTTPYFATSTVEVIFHVSTRMPSDSDDSLTKKLRHLGNDEVHIVWSEHTRDYRRGIIPTEFGDVLIVIYPMKNHMFSIQIMKKPEVPFFGPLFDGAIVNGKVLPIMVRATAINASRALKSLIPLYQNFYEERARYLQTIVQHHLEPTTFEDFAAQVFSPAPYHHLPSDADH

SEQ ID NO: 3672 - protein, 1873 aa, unidentified
MFSRRSHGDVKKSTQKVLDPKKDVLTRLKHLRALLDNVDANDLKQFFETNYSQIYFIFYENFIALENSLKLKGNNKSQREELDSILFLFEKILQFLPERIFFRWHYQSIGSTLKKLLHTGNSIKIRCEGIRLFLLWLQALQTNCAEEQVLIFACLVPGFPAVMSSRGPCTLETLINPSPSVADVKIYPEEITPLLPAISGEKIAEDQTCFFLQILLKYMVIQAASLEWKNKENQDTGFKFLFTLFRKYYLPHLFPSFTKLTNIYKPVLDIPHLRPKPVYITTTRDNENIYSTKIPYMAARVVFIKWIVTFFLEKKYLTATQNTKNGVDVLPKIIQTVGGGAVQERAPELDGGGPTEQDKSHSNSSTLSDRRLSNSSLCSIEEEHRMVYEMVQRILLSTRGYVNFVNEVFHQAFLLPSCEIAVTRKVVQVYRKWILQDKPVFMEEPDRKDVAQEDAEKLGFSETDSKEASSESSGHKRSSSWGRTYSFTSAMSRGCVTEEENTNVKAGVQALLQVFLTNSANIFLLEPCAEVPVLLKEQVDACKAVLIIFRRMIMELTMNKKTWEQMLQILLRITEAVMQKPKDKQIKDLFAQSLAGLLFRTLMVAWIRANLCVYISRELWDDFLGVLSSLTEWEELINEWANIMDSLTAVLARTVYGVEMTNLPLDKLSEQKEKKQRGKGCVLDPQKGTTVGRSFSLSWRSHPDVTEPMRFRSATTSGAPGVEKARNIVRQKATEVEECQQSENAPAAGSGHLTVGQQQQVLRSSSTSDIPEPLCSDSSQGQKAENTQNSSSSEPQPIQENKGHVKREHEGITILVRRSSSPAELDLKDDLQQTQGKCRERQKSESTNSDTTLGCTNEAELSMGPWQTCEEDPELNTPTDVVADADARHWLQLSPTDASNLTDSSECLTDDCSIIAGGSLTGWHPDSAAVLWRRVLGILGDVNNIQSPKIHARVFCYLYELWYKLAKIRDNLAISLDNQSSPSPPVLIPPLRMFASWLFKAATLPNEYKEGKLQAYRLICAMMTRRQDVLPNSDFLVHFYLVMHLGLTSEDQDILNTIIRHCPPRFFSLGFPGFSMLVGDFITAAARVLSTDILTAPRSEAVTVLGSLVCFPNTYQEIPLLQSVPEVNEAITGTEDVKHYLINILLKNATEEPNEYARCIAVCSLGVWICEELAQCTSHPQVKEAINVIGVTLKFPNKIVAQVACDVLQLLVSYWEKLQMFETSLPRKMAEILVATVAFLLPSAEYSSVETDKKFIVSLLLCLLDWCMALPVSVLLHPVSTAVLEEQHSARAPLLDYIYRVLHCCVCGSSTYTQQSHYILTLADLSSTDYDPFLPLANVKSSEPVQYHSSAELGNLLTVEEEKKRRSLELIPLTARMVMAHLVNHLGHYPLSGGPAILHSLVSENHDNAHVEGSELSFEVFRSPNLQLFVFNDSTLISYLQTPTEGPVGGSPVGSLSDVRVIVRDISGKYSWDGKVLYGPLEGCLAPNGRNPSFLISSWHRDTFGPQKDSSQVEEGDDVLDKLLENIGHTSPECLLPSQLNLNEPSLTPCGMNYDQEKEIIEVILRQNAQEDEYIQSHNFDSAMKVTSQGQPSPVEPRGPFYFCRLLLDDLGMNSWDRRKNFHLLKKNSKLLRELKNLDSRQCRETHKIAVFYIAEGQEDKCSILSNERGSQAYEDFVAGLGWEVDLSTHCGFMGGLQRNGSTGQTAPYYATSTVEVIFHVSTRMPSDSDDSLTKKLRHLGNDEVHIVWSEHSRDYRRGIIPTAFGDVSIIIYPMKNHMFFIAITKKPEVPFFGPLFDGAIVSGKLLPSLVCATCINASRAVKCLIPLYQSFYEERALYLEAIIQNHREVMTFEDFAAQVFSPSPSYSLSGTD

SEQ ID NO: 3673 - protein, 148 aa, unidentified
MARALCRLPRRGLWLLLAHHLFMTTACQEANYGALLRELCLTQFQVDMEAVGETLWCDWGRTIRSYRELADCTWHMAEKLGCFWPNAEVDRFFLAVHGRYFRSCPISGRAVRDPPGSILYPFIVVPITVTLLVTALVVWQSKRTEGIV

SEQ ID NO: 3674 - protein, 175 aa, unidentified
MASLRVERAGGPRLPRTRVGRPAALRLLLLLGAVLNPHEALAQPLPTTGTPGSEGGTVKNYETAVQFCWNHYKDQMDPIEKDWCDWAMISRPYSTLRDCLEHFAELFDLGFPNPLAERIIFETHQIHFANCSLVQPTFSDPPEDVLLAMIIAPICLIPFLITLVVWRSKDSEAQA

SEQ ID NO: 3675 - protein, 148 aa, unidentified
METGALRRPQLLPLLLLLCGGCPRAGGCNETGMLERLPLCGKAFADMMGKVDVWKWCNLSEFIVYYESFTNCTEMEANVVGCYWPNPLAQGFITGIHRQFFSNCTVDRVHLEDPPDEVLIPLIVIPVVLTVAMAGLVVWRSKRTDTLL

SEQ ID NO: 3676 - protein, 1088 aa, unidentified
MALHFQSLAELEVLCTHLYIGTDLTQRIEAEKALLELIDSPECLSKCQLLLEQGTTSYAQLLAATCLSKLVSRVSPLPVEQRMDIRNYILNYVASQPKLAPFVIQALIQVIAKITKLGWFEVQKDQFVFREIIADVKKFLQGTVEHCIIGVIILSELTQEMNLVDYSRPSAKHRKIATSFRDTSLKDVLVLACSLLKEVFAKPLNLQDQCQQNLVMQVLKLVLNCLNFDFIGSSADESADDLCTVQIPTTWRTIFLEPETLDLFFNLYHSLPPLLSQLALSCLVQFASTRRSLFNSPERAKYLGNLIKGVKRILENPQGLSDPGNYHEFCRFLARLKTNYQLGELVMVKEYPEVIRLIANFTITSLQHWEFAPNSVHYLLTLWQRMVASVPFVKSTEPHLLDTYAPEITKAFITSRLDSVAIVVRDHLDDPLDDTATVFQQLEQLCTVSRCEYEKTCALLVQLFDQNAQNYQKLLHPYSGVTVDITIQEGRLAWLVYLVGTVVGGRLTYTSTDEHDAMDGELSCRVFQLISLMDTGLPRCCNEKIELAILWFLDQFRKTYVGDQLQRTSKVYARMSEVLGITDDNHVLETFMTKIVTNLKYWGRYEPVISRTLQFLNDLSVGYILLKKLVKIDAVKFMLKNHTSEHFPFLGISDNHSLSDFRCRTTFYTALTRLLMVDLGEDEDEFENFMLPLTVAFETVLQIFNNNFKQEDVKRMLIGLARDLRGIAFALNTKTSYTMLFDWMYPTYLPLLQNAVERWYGEPTCTTPILKLMAELMQNRSQRLNFDVSSPNGILLFREASKMVCTYGNQILSLGSLSKDQIYPMKLKGISICYSALKSALCGNYVSFGVFKLYGDNHFDNVLQAFVKMLLSVSHSDLLQYRKLSQSYYPLLECLTQDHMSFIINLEPPVLMYVLTSISEGLTTLDTVVSSSCCTSLDYIVTYLFKHIAKEGKKPLRCREATQAGQRLLHFMQQNPDVLQQMMSVLMNTIVFEDCRNQWSVSRPLLGLILLNEKYFSELRASLINSQPLPKQEVLAQCFRNLMEGVEQNLSVKNRDRFTQNLSVFRRDVAEALRSDGNTEPCSLDMMS

SEQ ID NO: 3677 - protein, 164 aa, unidentified
MASPHQEPKPGDLIEIFRLGYEHWALYIGDGYVIHLAPPSEYPGAGSSSVFSVLSNSAEVKRERLEDVVGGCCYRVNNSLDHEYQPRPVEVIISSAKEMVGQKMKYSIVSRNCEHFVTQLRYGKSRCKQVEKAKVEVGVATALGILVVAGCSFAIRRYQKKATA

SEQ ID NO: 3678 - protein, 473 aa, unidentified
MPQTPPFSAMFDSSGYNRNLYQSAEDSCGGLYYHDNNLLSGSLEALIQHLVPNVDYYPDRTYIFTFLLSSRLFMHPYELMAKVCHLCVEHQRLSDPDSDKNQMRKIAPKILQLLTEWTETFPYDFRDERMMRNLKDLAHRIASGEEQTYRKNVQQMMQCLIRKLAALSQYEEVLAKISSTSTDRLTVLKTKPQSIQRDIITVCNDPYTLAQQLTHIELERLNYIGPEEFVQAFVQKDPLDNDKSCYSERKKTRNLEAYVEWFNRLSYLVATEICMPVKKKHRARMIEYFIDVARECFNIGNFNSLMAIISGMNMSPVSRLKKTWAKVKTAKFDILEHQMDPSSNFYNYRTALRGAAQRSLTAHSSREKIVIPFFSLLIKDIYFLNEGCANRLPNGHVNFEKFWELAKQVSEFMTWKQVECPFERDRKILQYLLTVPVFSEDALYLASYESEGPENHIEKDRWKSLRSSLLGRV

SEQ ID NO: 3679 - protein, 928 aa, unidentified
MPPKTPRKTAATAAAAAAEPPAPPPPPPPEEDPEQDSGPEDLPLVRLEFEETEEPDFTALCQKLKIPDHVRERAWLTWEKVSSVDGVLGGYIQKKKELWGICIFIAAVDLDEMSFTFTELQKNIEISVHKFFNLLKEIDTSTKVDNAMSRLLKKYDVLFALFSKLERTCELIYLTQPSSSISTEINSALVLKVSWITFLLAKGEVLQMEDDLVISFQLMLCVLDYFIKLSPPMLLKEPYKTAVIPINGSPRTPRRGQNRSARIAKQLENDTRIIEVLCKEHECNIDEVKNVYFKNFIPFMNSLGLVTSNGLPEVENLSKRYEEIYLKNKDLDARLFLDHDKTLQTDSIDSFETQRTPRKSNLDEEVNVIPPHTPVRTVMNTIQQLMMILNSASDQPSENLISYFNNCTVNPKESILKRVKDIGYIFKEKFAKAVGQGCVEIGSQRYKLGVRLYYRVMESMLKSEEERLSIQNFSKLLNDNIFHMSLLACALEVVMATYSRSTSQNLDSGTDLSFPWILNVLNLKAFDFYKVIESFIKAEGNLTREMIKHLERCEHRIMESLAWLSDSPLFDLIKQSKDREGPTDHLESACPLNLPLQNNHTAADMYLSPVRSPKKKGSTTRVNSTANAETQATSAFQTQKPLKSTSLSLFYKKVYRLAYLRLNTLCERLLSEHPELEHIIWTLFQHTLQNEYELMRDRHLDQIMMCSMYGICKVKNIDLKFKIIVTAYKDLPHAVQETFKRVLIKEEEYDSIIVFYNSVFMQRLKTNILQYASTRPPTLSPIPHIPRSPYKFPSSPLRIPGGNIYISPLKSPYKISEGLPTPTKMTPRSRILVSIGESFGTSEKFQKINQMVCNSDRVLKRSAEGSNPPKPLKKLRFDIEGSDEADGSKHLPGESKFQQKLAEMTSTRTRMQKQKMNDSMDTSNKEEK

SEQ ID NO: 3680 - protein, 1068 aa, unidentified
MFEDKPHAEGAAVVAAAGEALQALCQELNLDEGSAAEALDDFTAIRGNYSLEGEVTHWLACSLYVACRKSIIPTVGKGIMEGNCVSLTRILRSAKLSLIQFFSKMKKWMDMSNLPQEFRERIERLERNFEVSTVIFKKYEPIFLDIFQNPYEEPPKLPRSRKQRRIPCSVKDLFNFCWTLFVYTKGNFRMIGDDLVNSYHLLLCCLDLIFANAIMCPNRQDLLNPSFKGLPSDFHTADFTASEEPPCIIAVLCELHDGLLVEAKGIKEHYFKPYISKLFDRKILKGECLLDLSSFTDNSKAVNKEYEEYVLTVGDFDERIFLGADAEEEIGTPRKFTRDTPLGKLTAQANVEYNLQQHFEKKRSFAPSTPLTGRRYLREKEAVITPVASATQSVSRLQSIVAGLKNAPSDQLINIFESCVRNPVENIMKILKGIGETFCQHYTQSTDEQPGSHIDFAVNRLKLAEILYYKILETVMVQETRRLHGMDMSVLLEQDIFHRSLMACCLEIVLFAYSSPRTFPWIIEVLNLQPFYFYKVIEVVIRSEEGLSRDMVKHLNSIEEQILESLAWSHDSALWEALQVSANKVPTCEEVIFPNNFETGNGGNVQGHLPLMPMSPLMHPRVKEVRTDSGSLRRDMQPLSPISVHERYSSPTAGSAKRRLFGEDPPKEMLMDKIITEGTKLKIAPSSSITAENVSILPGQTLLTMATAPVTGTTGHKVTIPLHGVANDAGEITLIPLSMNTNQESKVKSPVSLTAHSLIGASPKQTNLTKAQEVHSTGINRPKRTGSLALFYRKVYHLASVRLRDLCLKLDVSNELRRKIWTCFEFTLVHCPDLMKDRHLDQLLLCAFYIMAKVTKEERTFQEIMKSYRNQPQANSHVYRSVLLKSIPREVVAYNKNINDDFEMIDCDLEDATKTPDCSSGPVKEERGDLIKFYNTIYVGRVKSFALKYDLANQDHMMDAPPLSPFPHIKQQPGSPRRISQQHSIYISPHKNGSGLTPRSALLYKFNGSPSKSLKDINNMIRQGEQRTKKRVIAIDSDAESPAKRVCQENDDVLLKRLQDVVSERANH

SEQ ID NO: 3681 - protein, 197 aa, unidentified [sequence omitted]

SEQ ID NO: 3682 - protein, 329 aa, unidentified
MAALGGDGLRLLSVSRPERPPESAALGGLGPGLCCWVSVFSCLSLACSYVGSLYVWKSELPRDHPAVIKRRFTSVLVVSSLSPLCVLLWRELTGIQPGTSLLTLMGFRLEGIFPAALLPLLLTMILFLGPLMQLSMDCPCDLADGLKVVLAPRSWARCLTDMRWLRNQVIAPLTEELVFRACMLPMLAPCMGLGPAVFTCPLFFGVAHFHHIIEQLRFRQSSVGNIFLSAAFQFSYTAVFGAYTAFLFIRTGHLIGPVLCHSFCNYMGFPAVCAALEHPQRRPLLAGYALGVGLFLLLLQPLTDPKLYGSLPLCVLLERAGDSEAPLCS

SEQ ID NO: 3683 - protein, 328 aa, unidentified
MMWRPSVLLLLLLLRHGAQGKPSPDAGPHGQGRVHQAAPLSDAPHDDAHGNFQYDHEAFLGREVAKEFDQLTPEESQARLGRIVDRMDRAGDGDGWVSLAELRAWIAHTQQRHIRDSVSAAWDTYDTDRDGRVGWEELRNATYGHYAPGEEFHDVEDAETYKKMLARDERRFRVADQDGDSMATREELTAFLHPEEFPHMRDIVIAETLEDLDRNKDGYVQVEEYIADLYSAEPGEEEPAWVQTERQQFRDFRDLNKDGHLDGSEVGHWVLPPAQDQPLVEANHLLHESDTDKDGRLSKAEILGNWNMFVGSQATNYGEDLTRHHDEL

SEQ ID NO: 3684 - protein, 341 aa, unidentified
MNIVVEFFVVTFKVLWAFVLAAARWLVRPKEKSVAGQVCLITGAGSGLGRLFALEFARRRALLVLWDINTQSNEETAGMVRHIYRDLEAADAAALQAGNGEEEILPHCNLQVFTYTCDVGKRENVYLTAERVRKEVGEVSVLVNNAGVVSGHHLLECPDELIERTMMVNCHAHFWTTKAFLPTMLEINHGHIVTVASSLGLFSTAGVEDYCASKFGVVGFHESLSHELKAAEKDGIKTTLVCPYLVDTGMFRGCRIRKEIEPFLPPLKPDYCVKQAMKAILTDQPMICTPRLMYIVTFMKSILPFEAVVCMYRFLGADKCMYPFIAQRKQATNNNEAKNGI

SEQ ID NO: 3685 - protein, 317 aa, unidentified
MWLYLAVFVGLYYLLHWYRERQVLSHLRDKYVFITGCDSGFGKLLARQLDARGLRVLAACLTEKGAEQLRGQTSDRLETVTLDVTKTESVAAAAQWVKECVRDKGLWGLVNNAGISLPTAPNELLTKQDFVTILDVNLLGVIDVTLSLLPLVRRARGRVVNVSSVMGRVSLFGGGYCISKYGVEAFSDSLRRELSYFGVKVAMIEPGYFKTAVTSKERFLKSFLEIWDRSSPEVKEAYGEKFVADYKKSAEQMEQKCTQDLSLVTNCMEHALIACHPRTRYSAGWDAKLLYLPMSYMPTFLVDAIMYWVSPSPAKAL

SEQ ID NO: 3686 - protein, 971 aa, unidentified
MATVRASLRGALLLLLAVAGVAEVAGGLAPGSAGALCCNHSKDNQMCRDVCEQIFSSKSESRLKHLLQRAPDYCPETMVEIWNCMNSSLPGVFKKSDGWVGLGCCELAIALECRQACKQASSKNDISKVCRKEYENALFSCISRNEMGSVCCSYAGHHTNCREYCQAIFRTDSSPGPSQIKAVENYCASISPQLIHCVNNYTQSYPMRNPTDSLYCCDRAEDHACQNACKRILMSKKTEMEIVDGLIEGCKTQPLPQDPLWQCFLESSQSVHPGVTVHPPPSTGLDGAKLHCCSKANTSTCRELCTKLYSMSWGNTQSWQEFDRFCEYNPVEVSMLTCLADVREPCQLGCRNLTYCTNFNNRPTELFRSCNAQSDQGAMNDMKLWEKGSIKMPFINIPVLDIKKCQPEMWKAIACSLQIKPCHSKSRGSIICKSDCVEILKKCGDQNKFPEDHTAESICELLSPTDDLKNCIPLDTYLRPSTLGNIVEEVTHPCNPNPCPANELCEVNRKGCPSGDPCLPYFCVQGCKLGEASDFIVRQGTLIQVPSSAGEVGCYKICSCGQSGLLENCMEMHCIDLQKSCIVGGKRKSHGTSFSIDCNVCSCFAGNLVCSTRLCLSEHSSEDDRRTFTGLPCNCADQFVPVCGQNGRTYPSACIARCVGLQDHQFEFGSCMSKDPCNPNPCQKNQRCIPKPQVCLTTFDKFGCSQYECVPRQLACDQVQDPVCDTDHMEHNNLCTLYQRGKSLSYKGPCQPFCRATEPVCGHNGETYSSVCAAYSDRVAVDYYGDCQAVGVLSEHSSVAECASVKCPSLLAAGCKPIIPPGACCPLCAGMLRVLFDKEKLDTIAKVTNKKPITVLEILQKIRMHVSVPQCDVFGYFSIESEIVILIIPVDHYPKALQIEACNKEAEKIESLINSDSPTLASHVPLSALIISQVQVSSSVPSAGVRARPSCHSLLLPLSLGLALHLLWTYN

SEQ ID NO: 3687 - protein, 201 aa, unidentified
MVSWIISRLVVLIFGTLYPAYYSYKAVKSKDIKEYVKWMMYWIIFALFTTAETFTDIFLCWFPFYYELKIAFVAWLLSPYTKGSSLLYRKFVHPTLSSKEKEIDDCLVQAKDRSYDALVHFGKRGLNVAATAAVMAASKGQGALSERLRSFSMQDLTTIRGDGAPAPSGPPPPGSGRASGKHGQPKMSRSASESASSSGTA

SEQ ID NO: 3688 - protein, 252 aa, unidentified
MVSWIISRLVVLIFGTLYPAYSSYKAVKTKNVKEYVKWMMYWIVFAFFTTAETLTDIVLSWFPFYFELKIAFVIWLLSPYTKGSSVLYRKFVHPTLSNKEKEIDEYITQARDKSYETMMRVGKRGLNLAANAAVTAAAKGVLSEKLRSFSMQDLTLIRDEDALPLQRPDGRLRPSPGSLLDTIEDLGDDPALSLRSSTNPADSRTEASEDDMGDKAPKRAKPIKKAPKAEPLASKTLKTRPKKKTSGGGDSA

SEQ ID NO: 3689 - protein, 255 aa, unidentified
MVSWMISRAVVLVFGMLYPAYYSYKAVKTKNVKEYVRWMMYWIVFALYTVIETVADQTVAWFPLYYELKIAFVIWLLSPYTKGASLIYRKFLHPLLSSKEREIDDYIVQAKERGYETMVNFGRQGLNLAATAAVTAAVKSQGAITERLRSFSMHDLTTIQGDEPVGQRPYQPLPEAKKKSKPAPSESAGYGIPLKDGDEKTDEEAEGPYSDNEMLTHKGLRRSQSMKSVKTTKGRKEVRYGSLKYKVKKRPQVYF

SEQ ID NO: 3690 - protein, 257 aa, unidentified
MVSWMICRLVVLVFGMLCPAYASYKAVKTKNIREYVRWMMYWIVFALFMAAEIVTDIFISWFPFYYEIKMAFVLWLLSPYTKGASLLYRKFVHPSLSRHEKEIDAYIVQAKERSYETVLSFGKRGLNIAASAAVQAATKSQGALAGRLRSFSMQDLRSISDAPAPAYHDPLYLEDQVSHRRPPIGYRAGGLQDSDTEDECWSDTEAVPRAPARPREKPLIRSQSLRVVKRKPPVREGTSRSLKVRTRKKTVPSDVDS

SEQ ID NO: 3691 - protein, 189 aa, unidentified
MSAAMRERFDRFLHEKNCMTDLLAKLEAKTGVNRSFIALGVIGLVALYLVFGYGASLLCNLIGFGYPAYISIKAIESPNKEDDTQWLTYWVVYGVFSIAEFFSDIFLSWFPFYYMLKCGFLLWCMAPSPSNGAELLYKRIIRPFFLKHESQMDSVVKDLKDKAKETADAITKEAKKATVNLLGEEKKST

SEQ ID NO: 3692 - protein, 211 aa, unidentified
MDGLRQRVEHFLEQRNLVTEVLGALEAKTGVEKRYLAAGAVTLLSLYLLFGYGASLLCNLIGFVYPAYASIKAIESPSKDDDTVWLTYWVVYALFGLAEFFSDLLLSWFPFYYVGKCAFLLFCMAPRPWNGALMLYQRVVRPLFLRHHGAVDRIMNDLSGRALDAAAGITRNVLQVLARSRAGITPVAVAGPSTPLEADLKPSQTPQPKDK

SEQ ID NO: 3693 - protein, 271 aa, unidentified
MAPRALPGSAVLAAAVFVGGAVSSPLVAPDNGSSRTLHSRTETTPSPSNDTGNGHPEYIAYALVPVFFIMGLFGVLICHLLKKKGYRCTTEAEQDIEEEKVEKIELNDSVNENSDTVGQIVHYIMKNEANADVLKAMVADNSLYDPESPVTPSTPGSPPVSPGPLSPGGTPGKHVCGHHLHTVGGVVERDVCHRCRHKRWHFIKPTNKSRESRPRRQGEVTVLSVGRFRVTKVEHKSNQKERRSLMSVSGAETVNGEVPATPVKRERSGTE

SEQ ID NO: 3694 - protein, 303 aa, unidentified
MSEPQPDLEPPQHGLYMLFLLVLVFFLMGLVGFMICHVLKKKGYRCRTSRGSEPDDAQLQPPEDDDMNEDTVERIVRCIIQNEANAEALKEMLGDSEGEGTVQLSSVDATSSLQDGAPSHHHTVHLGSAAPCLHCSRSKRPPLVRQGRSKEGKSRPRTGETTVFSVGRFRVTHIEKRYGLHEHRDGSPTDRSWGSGGGQDPGGGQGSGGGQPKAGMPAMERLPPERPQPQVLASPPVQNGGLRDSSLTPRALEGNPRASAEPTLRAGGRGPSPGLPTQEANGQPSKPDTSDHQVSLPQGAGSM

SEQ ID NO: 3695 - protein, 430 aa, unidentified
MKPSLLCRPLSCFLMLLPWPLATLTSTTLWQCPPGEEPDLDPGQGTLCRPCPPGTFSAAWGSSPCQPHARCSLWRRLEAQVGMATRDTLCGDCWPGWFGPWGVPRVPCQPCSWAPLGTHGCDEWGRRARRGVEVAAGASSGGETRQPGNGTRAGGPEETAAQYAVIAIVPVFCLMGLLGILVCNLLKRKGYHCTAHKEVGPGPGGGGSGINPAYRTEDANEDTIGVLVRLITEKKENAAALEELLKEYHSKQLVQTSHRPVSKLPPAPPNVPHICPHRHHLHTVQGLASLSGPCCSRCSQKKWPEVLLSPEAVAATTPVPSLLPNPTRVPKAGAKAGRQGEITILSVGRFRVARIPEQRTSSMVSEVKTITEAGPSWGDLPDSPQPGLPPEQQALLGSGGSRTKWLKPPAENKAEENRYVVRLSESNLVI

SEQ ID NO: 3696 - protein, 196 aa, unidentified
MSEGDSVGESVHGKPSVVYRFFTRLGQIYQSWLDKSTPYTAVRWVVTLGLSFVYMIRVYLLQGWYIVTYALGIYHLNLFIAFLSPKVDPSLMEDSDDGPSLPTKQNEEFRPFIRRLPEFKFWHAATKGILVAMVCTFFDAFNVPVFWPILVMYFIMLFCITMKRQIKHMIKYRYIPFTHGKRRYRGKEDAGKAFAS

SEQ ID NO: 3697 - protein, 1114 aa, unidentified
MAKATSGAAGLRLLLLLLLPLLGKVALGLYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCQAFSGINVQYKLHSSGANCSTLGVVTSAEDTSGILFVNDTKALRRPKCAELHYMVVATDQQTSRQAQAQLLVTVEGSYVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCRTVIAAAVLFSFIVSVLLSAFCIHCYHKFAHKPPISSAEMTFRRPAQAFPVSYSSSGARRPSLDSMENQVSVDAFKILEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQSDVWSFGVLLWEIVTLGGNPYPGIPPERLFNLLKTGHRMERPDNCSEEMYRLMLQCWKQEPDKRPVFADISKDLEKMMVKRRDYLDLAASTPSDSLIYDDGLSEEETPLVDCNNAPLPRALPSTWIENKLYGMSDPNWPGESPVPLTRADGTNTGFPRYPNDSVYANWMLSPSAAKLMDTFDS

SEQ ID NO: 3698 - protein, 610 aa, unidentified
MWLPLVLLLAVLLLAVLCKVYLGLFSGSSPNPFSEDVKRPPAPLVTDKEARKKVLKQAFSANQVPEKLDVVVIGSGFGGLAAAAILAKAGKRVLVLEQHTKAGGCCHTFGKNGLEFDTGIHYIGRMEEGSIGRFILDQITEGQLDWAPLSSPFDIMVLEGPNGRKEYPMYSGEKAYIQGLKEKFPQEEAIIDKYIKLVKVVSSGAPHAILLKFLPLPVVQLLDRCGLLTRFSPFLQASTQSLAEVLQQLGASSELQAVLSYIFPTYGVTPNHSAFSMHALLVNHYMKGGFYPRGGSSEIAFHTIPVIQRAGGAVLTKATVQSVLLDSAGKACGVSVKKGHELVNIYCPIVVSNAGLFNTYEHLLPGNARCLPGVKQQLGTVRPGLGMTSVFICLRGTKEDLHLPSTNYYVYYDTDMDQAMERYVSMPREEAAEHIPLLFFAFPSAKDPTWEDRFPGRSTMIMLIPTAYEWFEEWQAELKGKRGSDYETFKNSFVEASMSVVLKLFPQLEGKVESVTAGSPLTNQFYLAAPRGACYGADHDLGRLHPCVMASLRAQSPIPNLYLTGQDIFTCGLVGALQGALLCSSAILKRNLYSDLKNLDSRIRAQKKKN

SEQ ID NO: 3699 - protein, 541 aa, unidentified
MGSQEVLGHAARLASSGLLLQVLFRLITFVLNAFILRFLSKEIVGVVNVRLTLLYSTTLFLAREAFRRACLSGGTQRDWSQTLNLLWLTVPLGVFWSLFLGWIWLQLLEVPDPNVVPHYATGVVLFGLSAVVELLGEPFWVLAQAHMFVKLKVIAESLSVILKSVLTAFLVLWLPHWGLYIFSLAQLFYTTVLVLCYVIYFTKLLGSPESTKLQTLPVSRITDLLPNITRNGAFINWKEAKLTWSFFKQSFLKQILTEGERYVMTFLNVLNFGDQGVYDIVNNLGSLVARLIFQPIEESFYIFFAKVLERGKDATLQKQEDVAVAAAVLESLLKLALLAGLTITVFGFAYSQLALDIYGGTMLSSGSGPVLLRSYCLYVLLLAINGVTECFTFAAMSKEEVDRYNFVMLALSSSFLVLSYLLTRWCGSVGFILANCFNMGIRITQSLCFIHRYYRRSPHRPLAGLHLSPVLLGTFALSGGVTAVSEVFLCCEQGWPARLAHIAVGAFCLGATLGTAFLTETKLIHFLRTQLGVPRRTDKMT

SEQ ID NO: 3700 - protein, 437 aa, unidentified
MGLRAAPSSAAAAAAEVEQRRSPGLCPPPLELLLLLLFSLGLLHAGDCQQPAQCRIQKCTTDFVSLTSHLNSAVDGFDSEFCKALRAYAGCTQRTSKACRGNLVYHSAVLGISDLMSQRNCSKDGPTSSTNPEVTHDPCNYHSHAGAREHRRGDQNPPSYLFCGLFGDPHLRTFKDNFQTCKVEGAWPLIDNNYLSVQVTNVPVVPGSSATATNKITIIFKAHHECTDQKVYQAVTDDLPAAFVDGTTSGGDSDAKSLRIVERESGHYVEMHARYIGTTVFVRQVGRYLTLAIRMPEDLAMSYEESQDLQLCVNGCPLSERIDDGQGQVSAILGHSLPRTSLVQAWPGYTLETANTQCHEKMPVKDIYFQSCVFDLLTTGDANFTAAAHSALEDVEALHPRKERWHIFPSSGNGTPRGGSDLSVSLGLTCLILIVFL

SEQ ID NO: 3701 - protein, 291 aa, unidentified
MAETSALPTGFGELEVLAVGMVLLVEALSGLSLNTLTIFSFCKTPELRTPCHLLVLSLALADSGISLNALVAATSSLLRRWPYGSDGCQAHGFQGFVTALASICSSAAIAWGRYHHYCTRSQLAWNSAVSLVLFVWLSSAFWAALPLLGWGHYDYEPLGTCCTLDYSKGDRNFTSFLFTMSFFNFAMPLFITITSYSLMEQKLGKSGHLQVNTTLPARTLLLGWGPYAILYLYAVIADVTSISPKLQMVPALIAKMVPTINAINYALGNEMVCRGIWQCLSPQKREKDRTK

SEQ ID NO: 3702 - protein, 235 aa, unidentified
MAREECKALLDGLNKTTACYHHLVLTVGGSADSQNLRQELQKTRQKAQELAVSTCARLTAVLRDRGLAADERAEFERLWVAFSGCLDLLEADMRRALELGAAFPLHAPRRPLVRTGVAGASSGVAARALSTRSLRLEAEGDFDVADLRELEREVLQVGEMIDNMEMKVNVPRWTVQARQAAGAELLSTVSAGPSSVVSLQERGGGCDPRKALAAILFGAVLLAAVALAVCVAKLS

SEQ ID NO: 3703 - protein, 1076 aa, unidentified
MSSAEIIGSTNLIILLEDEVFADFFNTFLSLPVFGQTPFYTVENSQWSLWPEIPCNLIAKYKGLLTWLEKCRLPFFCKTNLCFHYILCQEFISFIKSPEGGEELVDFWILAENILSIDEMDLEVRDYYLSLLLMLRATHLQEGSRVVTLCNMNIKSLLNLSIWHPNQSTTRREILSHMQKVALFKLQSYWLPNFYTHTKMTMAKEEACHGLMQEYETRLYSVCYTHIGGLPLNMSIKKCHHFQKRYSSRKAKRKMWQLVDPDSWSLEMDLKPDAIGMPLQETCPQEKVVIQMPSLKMASSKETRISSLEKDMHYAKISSMENKAKSHLHMEAPFETKVSTHLRTVIPIVNHSSKMTIQKAIKQSFSLGYIHLALCADACAGNPFRDHLKKLNLKVEIQLLDLWQDLQHFLSVLLNNKKNGNAIFRHLLGDRICELYLNEQIGPCLPLKSQTIQGLKELLPSGDVIPWIPKAQKEICKMLSPWYDEFLDEEDYWFLLFTTQNRFISSRQHKREFIGKEENILLYKRIQQSLELSQALADMKEMDYRQWRKIATEDLKQGGSLQVELTSPVFLTDITKMSFEELCYKNPKMAIQKISDDYKIYCEKAPKIDFKMEIIKETKTVSRSNRKMSLLKRTLVRKPSMRPRNLTEVLLNTQHLEFFREFLKERKAKIPLQFLTAVQKISIETNEKICKSLIENVIKTFFQGQLSPEEMLQCDAPIIKEIASMRHVTTSTLLTLQGHVMKSIEEKWFKDYQDLFPPHHQEVEVQSEVQISSRKPSKIVSTYLQESQKKGWMRMISFIRSFCKYRRFMLNPSKRQEFEDYLHQEMQNSKENFTTAHNTSGRSAPPSTNVRSADQENGEITLVKRRIFGHRIITVNFAINDLYFFSEMEKFNDLVSSAHMLQVNRAYNENDVILMRSKMNIIQKLFLNSDIPPKLRVNVPEFQKDAILAAITEGYLDRSVFHGAIMSVFPVVMYFWKRFCFWKATRSYLQYRGKKFKDRKSPPKSTDKYPFSSGGDNAILRFTLLRGIEWLQPQREAISSVQNSSSSKLTQPRLVVSAMQLHPVQGQKLSYIKKEK

SEQ ID NO: 3704 - protein, 409 aa, unidentified
MRFTFPLMAIVLEIAMIVLFGLFVEYETDQTVLEQLNITKPTDMGIFFELYPLFQDVHVMIFVGFGFLMTFLKKYGFSSVGINLLVAALGLQWGTIVQGILQSQGQKFNIGIKNMINADFSAATVLISFGAVLGKTSPTQMLIMTILEIVFFAHNEYLVSEIFKASDIGASMTIHAFGAYFGLAVAGILYRSGLRKGHENEESAYYSDLFAMIGTLFLWMFWPSFNSAIAEPGDKQCRAIVNTYFSLAACVLTAFAFSSLVEHRGKLNMVHIQNATLAGGVAVGTCADMAIHPFGSMIIGSIAGMVSVLGYKFLTPLFTTKLRIHDTCGVHNLHGLPGVVGGLAGIVAVAMGASNTSMAMQAAALGSSIGTAVVGGLMTGLILKLPLWGQPSDQNCYDDSVYWKVPKTR

SEQ ID NO: 3705 - protein, 315 aa, unidentified
MQRRSRGINTGLILLLSQIFHVGINNIPPVTLATLALNIWFFLNPQKPLYSSCLSVEKCYQQKDWQRLLLSPLHHADDWHLYFNMASMLWKGINLERRLGSRWFAYVITAFSVLTGVVYLLLQFAVAEFMDEPDFKRSCAVGFSGVLFALKVLNNHYCPGGFVNILGFPVPNRFACWVELVAIHLFSPGTSFAGHLAGILVGLMYTQGPLKKIMEACAGGFSSSVGYPGRQYYFNSSGSSGYQDYYPHGRPDHYEEAPRNYDTYTAGLSEEEQLERALQASLWDRGNTRNSPPPYGFHLSPEEMRRQRLHRFDSQ

SEQ ID NO: 3706 - protein, 364 aa, unidentified
MAASGPGCRSWCLCPEVPSATFFTALLSLLVSGPRLFLLQQPLAPSGLTLKSEALRNWQVYRLVTYIFVYENPISLLCGAIIIWRFAGNFERTVGTVRHCFFTVIFAIFSAIIFLSFEAVSSLSKLGEVEDARGFTPVAFAMLGVTTVRSRMRRALVFGMVVPSVLVPWLLLGASWLIPQTSFLSNVCGLSIGLAYGLTYCYSIDLSERVALKLDQTFPFSLMRRISVFKYVSGSSAERRAAQSRKLNPVPGSYPTQSCHPHLSPSHPVSQTQHASGQKLASWPSCTPGHMPTLPPYQPASGLCYVQNHFGPNPTSSSVYPASAGTSLGIQPPTPVNSPGTVYSGALGTPGAAGSKESSRVPMP

SEQ ID NO: 3707 - protein, 386 aa, unidentified
MHARGPHGQLSPALPLASSVLMLLMSTLWLVGAGPGLVLAPELLLDPWQVHRLLTHALGHTALPGLLLSLLLLPTVGWQQECHLGTLRFLHASALLALASGLLAVLLAGLGLSSAAGSCGYMPVHLAMLAGEGHRPRRPRGALPPWLSPWLLLALTPLLSSEPPFLQLLCGLLAGLAYAAGAFRWLEPSERRLQVLQEGVLCRTLAGCWPLRLLATPGSLAELPVTHPAGVRPPIPGPPYVASPDLWSHWEDSALPPPSLRPVQPTWEGSSEAGLDWAGASFSPGTPMWAALDEQMLQEGIQASLLDGPAQEPQSAPWLSKSSVSSLRLQQLERMGFPTEQAVVALAATGRVEGAVSLLVGGQVGTETLVTHGKGGPAHSEGPGPP

SEQ ID NO: 3708 - protein, 855 aa, unidentified
MSEARRDSTSSLQRKKPPWLKLDIPSAVPLTAEEPSFLQPLRRQAFLRSVSMPAETAHISSPHHELRRPVLQRQTSITQTIRRGTADWFGVSKDSDSTQKWQRKSIRHCSQRYGKLKPQVLRELDLPSQDNVSLTSTETPPPLYVGPCQLGMQKIIDPLARGRAFRVADDTAEGLSAPHTPVTPGAASLCSFSSSRSGFHRLPRRRKRESVAKMSFRAAAALMKGRSVRDGTFRRAQRRSFTPASFLEEDTTDFPDELDTSFFAREGILHEELSTYPDEVFESPSEAALKDWEKAPEQADLTGGALDRSELERSHLMLPLERGWRKQKEGAAAPQPKVRLRQEVVSTAGPRRGQRIAVPVRKLFAREKRPYGLGMVGRLTNRTYRKRIDSFVKRQIEDMDDHRPFFTYWLTFVHSLVTILAVCIYGIAPVGFSQHETVDSVLRNRGVYENVKYVQQENFWIGPSSEALIHLGAKFSPCMRQDPQVHSFIRSAREREKHSACCVRNDRSGCVQTSEEECSSTLAVWVKWPIHPSAPELAGHKRQFGSVCHQDPRVCDEPSSEDPHEWPEDITKWPICTKNSAGNHTNHPHMDCVITGRPCCIGTKGRCEITSREYCDFMRGYFHEEATLCSQVHCMDDVCGLLPFLNPEVPDQFYRLWLSLFLHAGILHCLVSICFQMTVLRDLEKLAGWHRIAIIYLLSGVTGNLASAIFLPYRAEVGPAGSQFGILACLFVELFQSWQILARPWRAFFKLLAVVLFLFTFGLLPWIDNFAHISGFISGLFLSFAFLPYISFGKFDLYRKRCQIIIFQVVFLGLLAGLVVLFYVYPVRCEWCEFLTCIPFTDKFCEKYELDAQLH

SEQ ID NO: 3709 - protein, 856 aa, unidentified
MASADKNGGSVSSVSSSRLQSRKPPNLSITIPPPEKETQAPGEQDSMLPEGFQNRRLKKSQPRTWAAHTTACPPSFLPKRKNPAYLKSVSLQEPRSRWQESSEKRPGFRRQASLSQSIRKGAAQWFGVSGDWEGQRQQWQRRSLHHCSMRYGRLKASCQRDLELPSQEAPSFQGTESPKPCKMPKIVDPLARGRAFRHPEEMDRPHAPHPPLTPGVLSLTSFTSVRSGYSHLPRRKRMSVAHMSLQAAAALLKGRSVLDATGQRCRVVKRSFAFPSFLEEDVVDGADTFDSSFFSKEEMSSMPDDVFESPPLSASYFRGIPHSASPVSPDGVQIPLKEYGRAPVPGPRRGKRIASKVKHFAFDRKKRHYGLGVVGNWLNRSYRRSISSTVQRQLESFDSHRPYFTYWLTFVHVIITLLVICTYGIAPVGFAQHVTTQLVLRNKGVYESVKYIQQENFWVGPSSIDLIHLGAKFSPCIRKDGQIEQLVLRERDLERDSGCCVQNDHSGCIQTQRKDCSETLATFVKWQDDTGPPMDKSDLGQKRTSGAVCHQDPRTCEEPASSGAHIWPDDITKWPICTEQARSNHTGFLHMDCEIKGRPCCIGTKGSCEITTREYCEFMHGYFHEEATLCSQVHCLDKVCGLLPFLNPEVPDQFYRLWLSLFLHAGVVHCLVSVVFQMTILRDLEKLAGWHRIAIIFILSGITGNLASAIFLPYRAEVGPAGSQFGLLACLFVELFQSWPLLERPWKAFLNLSAIVLFLFICGLLPWIDNIAHIFGFLSGLLLAFAFLPYITFGTSDKYRKRALILVSLLAFAGLFAALVLWLYIYPINWPWIEHLTCFPFTSRFCEKYELDQVLH

SEQ ID NO: 3710 - protein, 438 aa, unidentified
MGRVEDGGTTEELEDWDPGTSALPAPGIKQGPREQTGTGPLSQKCWEPEPDAPSQPGPALWSRGRARTQALAGGSSLQQLDPENTGFIGADTFTGLVHSHELPLDPAKLDMLVALAQSNEQGQVCYQELVDLISSKRSSSFKRAIANGQRALPRDGPLDEPGLGVYKRFVRYVAYEILPCEVDRRWYFYRHRSCPPPVFMASVTLAQIIVFLCYGARLNKWVLQTYHPEYMKSPLVYHPGHRARAWRFLTYMFMHVGLEQLGFNALLQLMIGVPLEMVHGLLRISLLYLAGVLAGSLTVSITDMRAPVVGGSGGVYALCSAHLANVVMNWAGMRCPYKLLRMVLALVCMSSEVGRAVWLRFSPPLPASGPQPSFMAHLAGAVVGVSMGLTILRSYEERLRDQCGWWVVLLAYGTFLLFAVFWNVFAYDLLGAHIPPPP

SEQ ID NO: 3711 - protein, 303 aa, unidentified
MAAVHDLEMESMNLNMGREMKEELEEEEKMREDGGGKDRAKSKKVHRIVSKWMLPEKSRGTYLERANCFPPPVFIISISLAELAVFIYYAVWKPQKQWITLDTGILESPFIYSPEKREEAWRFISYMLVHAGVQHILGNLCMQLVLGIPLEMVHKGLRVGLVYLAGVIAGSLASSIFDPLRYLVGASGGVYALMGGYFMNVLVNFQEMIPAFGIFRLLIIILIIVLDMGFALYRRFFVPEDGSPVSFAAHIAGGFAGMSIGYTVFSCFDKALLKDPRFWIAIAAYLACVLFAVFFNIFLSPAN

SEQ ID NO: 3712 - protein, 404 aa, unidentified
MGEHPSPGPAVAACAEAERIEELEPEAEERLPAAPEDHWKVLFDQFDPGNTGYISTGKFRSLLESHSSKLDPHKREVLLALADSHADGQIGYQDFVSLMSNKRSNSFRQAILQGNRRLSSKALLEEKGLSLSQRLIRHVAYETLPREIDRKWYYDSYTCCPPPWFMITVTLLEVAFFLYNGVSLGQFVLQVTHPRYLKNSLVYHPQLRAQVWRYLTYIFMHAGIEHLGLNVVLQLLVGVPLEMVHGATRIGLVYVAGVVAGSLAVSVADMTAPVVGSSGGVYALVSAHLANIVMNWSGMKCQFKLLRMAVALICMSMEFGRAVWLRFHPSAYPPCPHPSFVAHLGGVAVGITLGVVVLRNYEQRLQDQSLWWIFVAMYTVFVLFAVFWNIFAYTLLDLKLPPPP

SEQ ID NO: 3713 - protein, 441 aa, unidentified
MAGSPSRAAGRRLQLPLLCLFLQGATAVLFAVFVRYNHKTDAALWHRSNHSNADNEFYFRYPSFQDVHAMVFVGFGFLMVFLQRYGFSSVGFTFLLAAFALQWSTLVQGFLHSFHGGHIHVGVESMINADFCAGAVLISFGAVLGKTGPTQLLLMALLEVVLFGINEFVLLHLLGVRDAGGSMTIHTFGAYFGLVLSRVLYRPQLEKSKHRQGSVYHSDLFAMIGTIFLWIFWPSFNAALTALGAGQHRTALNTYYSLAASTLGTFALSALVGEDGRLDMVHIQNAALAGGVVVGTSSEMMLTPFGALAAGFLAGTVSTLGYKFFTPILESKFKVQDTCGVHNLHGMPGVLGALLGVLVAGLATHEAYGDGLESVFPLIAEGQRSATSQAMHQLFGLFVTLMFASVGGGLGGLLLKLPFLDSPPRLPALRGPSSLAGAWRA

SEQ ID NO: 3714 - protein, 417 aa, unidentified [sequence omitted]

SEQ ID NO: 3715 - protein, 479 aa, unidentified
MAWNTNLRWRLPLTCLLLQVIMVILFGVFVRYDFEADAHWWSERTHKNLSDMENEFYYRYPSFQDVHVMVFVGFGFLMTFLQRYGFSAVGFNFLLAAFGIQWALLMQGWFHFLQDRYIVVGVENLINADFCVASVCVAFGAVLGKVSPIQLLIMTFFQVTLFAVNEFILLNLLKVKDAGGSMTIHTFGAYFGLTVTRILYRRNLEQSKERQNSVYQSDLFAMIGTLFLWMYWPSFNSAISYHGDSQHRAAINTYCSLAACVLTSVAISSALHKKGKLDMVHIQNATLAGGVAVGTAAEMMLMPYGALIIGFVCGIISTLGFVYLTPFLESRLHIQDTCGINNLHGIPGIIGGIVGAVTAASASLEVYGKEGLVHSFDFQGFNGDWTARTQGKFQIYGLLVTLAMALMGGIIVGLILRLPFWGQPSDENCFEDAVYWEMPEGNSTVYIPEDPTFKPSGPSVPSVPMVSPLPMASSVPLVP

SEQ ID NO: 3716 - protein, 417 aa, unidentified
MSSKYPRSVRRCLPLWALTLEAALILLFYFFTHYDASLEDQKGLVASYQVGQDLTVMAAIGLGFLTSSFRRHSWSSVAFNLFMLALGVQWAILLDGFLSQFPSGKVVITLFSIRLATMSALSVLISVDAVLGKVNLAQLVVMVLVEVTALGNLRMVISNIFNTDYHMNMMHIYVFAAYFGLSVAWCLPKPLPEGTEDKDQTATIPSLSAMLGALFLWMFWPSFNSALLRSPIERKNAVFNTYYAVAVSVVTAISGSSLAHPQGKISKTYVHSAVLAGGVAVGTSCHLIPSPWLAMVLGLVAGLISVGGAKYLPGCCNRVLGIPHSSIMGYNFSLLGLLGEIIYIVLLVLDTVGAGNGMIGFQVLLSIGELSLAIVIALMSGLLTGLLLNLKIWKAPHEAKYFDDQVFWKFPHLAVGF

SEQ ID NO: 3717 - protein, 348 aa, unidentified [sequence omitted]

SEQ ID NO: 3718 - protein, 618 aa, unidentified
MKKDVRILLVGEPRVGKTSLIMSLVSEEFPEEVPPRAEEITIPADVTPERVPTHIVDYSEAEQSDEQLHQEISQANVICIVYAVNNKHSIDKVTSRWIPLINERTDKDSRLPLILVGNKSDLVEYSSMETILPIMNQYTEIETCVECSAKNLKNISELFYYAQKAVLHPTGPLYCPEEKEMKPACIKALTRIFKISDQDNDGTLNDAELNFFQRICFNTPLAPQALEDVKNVVRKHISDGVADSGLTLKGFLFLHTLFIQRGRHETTWTVLRRFGYDDDLDLTPEYLFPLLKIPPDCTTELNHHAYLFLQSTFDKHDLDRDCALSPDELKDLFKVFPYIPWGPDVNNTVCTNERGWITYQGFLSQWTLTTYLDVQRCLEYLGYLGYSILTEQESQASAVTVTRDKKIDLQKKQTQRNVFRCNVIGVKNCGKSGVLQALLGRNLMRQKKIREDHKSYYAINTVYVYGQEKYLLLHDISESEFLTEAEIICDVVCLVYDVSNPKSFEYCARIFKQHFMDSRIPCLIVAAKSDLHEVKQEYSISPTDFCRKHKMPPPQAFTCNTADAPSKDIFVKLTTMAMYPHVTQADLKSSTFWLRASFGATVFAVLGFAMYKALLKQR

SEQ ID NO: 3719 - protein, 618 aa, unidentified
MRRDVRILLLGEAQVGKTSLILSLVGEEFPEEVPPRAEEITIPADVTPEKVPTHIVDYSEAEQTDEELREEIHKANVVCVVYDVSEEATIEKIRTKWIPLVNGGTTQGPRVPIILVGNKSDLRSGSSMEAVLPIMSQFPEIETCVECSAKNLRNISELFYYAQKAVLHPTAPLYDPEAKQLRPACAQALTRIFRLSDQDLDQALSDEELNAFQKSCFGHPLAPQALEDVKTVVCRNVAGGVREDRLTLDGFLFLNTLFIQRGRHETTWTILRRFGYSDALELTADYLSPLIHVPPGCSTELNHLGYQFVQRVFEKHDQDRDGALSPVELQSLFSVFPAAPWGPELPRTVRTEAGRLPLHGYLCQWTLVTYLDVRSCLGHLGYLGYPTLCEQDQAHAITVTREKRLDQEKGQTQRSVLLCKVVGARGVGKSAFLQAFLGRGLGHQDTREQPPGYAIDTVQVNGQEKYLILCEVGTDGLLATSLDATCDVACLMFDGSDPKSFAHCASVYKHHYMDGQTPCLFVSSKADLPEGVAVSGPSPAEFCRKHRLPAPVPFSCAGPAEPSTTIFTQLATMAAFPHLVHAELHPSSFWLRGLLGVVGAAVAAVLSFSLYRVLVKSQ

SEQ ID NO: 3720 - protein, 1423 aa, unidentified
MYFLSGWPKRLLCPLGSPAEAPFHVQSDPQRAFFAVLAAARLSIWYSRPSVLIVTYKEPAKSSTQFGSYKQAEWRPDSTMIAVSTANGYILFFHITSTRGDKYLYEPVYPKGSPQMKGTPHFKEEQCAPALNLEMRKILDLQAPIMSLQSVLEDLLVATSDGLLHLIHWEGMTNGRKAINLCTVPFSVDLQSSRVGSFLGFTDVHIRDMEYCATLDGFAVVFNDGKVGFITPVSSRFTAEQLHGVWPQDVVDGTCVAVNNKYRLMAFGCVSGSVQVYTIDNSTGAMLLSHKLELTAKQYPDIWNKTGAVKLMRWSPDNSVVIVTWEYGGLSLWSVFGAQLICTLGGDFAYRSDGTKKDPLKINSMSWGAEGYHLWVISGFGSQNTEIESDLRSVVKQPSILLFQFIKSVLTVNPCMSNQEQVLLQGEDRLYLNCGEASQTQNPRSSSTHSEHKPSREKSPFADGGLESQGLSTLLGHRHWHVVQISSTYLESNWPIRFSAIDKLGQNIAVVGKFGFAHYSLLTKKWKLFGNITQEQNMIVTGGLAWWNDFMVLACYNINDRQEELRVYLRTSNLDNAFAHVTKAQAETLLLSVFQDMVIVFRADCSICLYSIERKSDGPNTTAGIQVLQEVSMSRYIPHPFLVVSVTLTSVSTENGITLKMPQQARGAESIMLNLAGQLIMMQRDRSGPQIREKDSNPNNQRKLLPFCPPVVLAQSVENVWTTCRANKQKRHLLEALWLSCGGAGMKVWLPLFPRDHRKPHSFLSQRIMLPFHINIYPLAVLFEDALVLGAVNDTLLYDSLYTRNNAREQLEVLFPFCVVERTSQIYLHHILRQLLVRNLGEQALLLAQSCATLPYFPHVLELMLHEVLEEEATSREPIPDPLLPTVAKFITEFPLFLQTVVHCARKTEYALWNYLFAAVGNPKDLFEECLMAQDLDTAASYLIILQNMEVPAVSRQHATLLFNTALEQGKWDLCRHMIRFLKAIGSGESETPPSTPTAQEPSSSGGFEFFRNRSISLSQSAENVPASKFSLQKTLSMPSGPSGKRWSKDSDCAENMYIDMMLWRHARRLLEDVRLKDLGCFAAQLGFELISWLCKERTRAARVDNFVIALKRLHKDFLWPLPIIPASSISSPFKNGKYRTVGEQLLKSQSADPFLNLEMDAGISNIQRSQSWLSNIGPTHHEIDTASSHGPQMQDAFLSPLSNKGDECSIGSATDLTESSSMVDGDWTMVDENFSTLSLTQSELEHISMELASKGPHKSQVQLRYLLHIFMEAGCLDWCIVIGLILRESSIINQILVITQSSEVDGEMLQNIKTGLHAVDRWASTDCPGYKPFLNIIKPQLQKLSEITEEQVQPDAFQPITMGKTPEQTSPRAEESRGSSSHGSIPQGEVGSSNMVSRKEEDTAQAEEEEPFQDGTYDCSVS

SEQ ID NO: 3721 - protein, 369 aa, unidentified
MAYSTVQRVALASGLVLALSLLLPKAFLSRGKRQEPPPTPEGKLGRFPPMMHHHQAPSDGQTPGARFQRSHLAEAFAKAKGSGGGAGGGGSGRGLMGQIIPIYGFGIFLYILYILFKLSKGKTTAEDGKCYTAMPGNTHRKITSFELAQLQEKLKETEAAMEKLINRVGPNGESRAQTVTSDQEKRLLHQLREITRVMKEGKFIDRFSPEKEAEEAPYMEDWEGYPEETYPIYDLSDCIKRRQETILVDYPDPKELSAEEIAERMGMIEEEESDHLGWESLPTDPRAQEDNSVTSCDPKPETCSCCFHEDEDPAVLAENAGFSADSYPEQEETTKEEWSQDFKDEGLGISTDKAYTGSMLRKRNPQGLE

SEQ ID NO: 3722 - protein, 410 aa, unidentified
MPYSTNKELILGIMVGTAGISLLLLWYHKVRKPGIAMKLPEFLSLGNTFNSITLQDEIHDDQGTTVIFQERQLQILEKLNELLTNMEELKEEIRFLKEAIPKLEEYIQDELGGKITVHKISPQHRARKRRLPTIQSSATSNSSEEAESEGGYITANTDTEEQSFPVPKAFNTRVEELNLDVLLQKVDHLRMSESGKSESFELLRDHKEKFRDEIEFMWRFARAYGDMYELSTNTQEKKHYANIGKTLSERAINRAPMNGHCHLWYAVLCGYVSEFEGLQNKINYGHLFKEHLDIAIKLLPEEPFLYYLKGRYCYTVSKLSWIEKKMAATLFGKIPSSTVQEALHNFLKAEELCPGYSNPNYMYLAKCYTDLEENQNALKFCNLALLLPTVTKEDKEAQKEMQKIMTSLKR

SEQ ID NO: 3723 - protein, 470 aa, unidentified
MSRLGALGGARAGLGLLLGTAAGLGFLCLLYSQRWKRTQRHGRSQSLPNSLDYTQTSDPGRHVMLLRAVPGGAGDASVLPSLPREGQEKVLDRLDFVLTSLVALRREVEELRSSLRGLAGEIVGEVRCHMEENQRVARRRRFPFVRERSDSTGSSSVYFTASSGATFTDAESEGGYTTANAESDNERDSDKESEDGEDEVSCETVKMGRKDSLDLEEEAASGASSALEAGGSSGLEDVLPLLQQADELHRGDEQGKREGFQLLLNNKLVYGSRQDFLWRLARAYSDMCELTEEVSEKKSYALDGKEEAEAALEKGDESADCHLWYAVLCGQLAEHESIQRRIQSGFSFKEHVDKAIALQPENPMAHFLLGRWCYQVSHLSWLEKKTATALLESPLSATVEDALQSFLKAEELQPGFSKAGRVYISKCYRELGKNSEARWWMKLALELPDVTKEDLAIQKDLEELEVILRD

SEQ ID NO: 3724 - protein, 449 aa, unidentified
MPATLLRAVARSHHILSKAHQCRRIGHLMLKPLKEFENTTCSTLTIRQSLDLFLPDKTASGLNKSQILEMNQKKSDTSMLSPLNAARCQDEKAHLPTMKSFGTHRRVTHKPNLLGSKWFIKILKRHFSSVSTETFVPKQDFPQVKRPLKASRTRQPSRTNLPVLSVNEDLMHCTAFATADEYHLGNLSQDLASHGYVEVTSLPRDAANILVMGVENSAKEGDPGTIFFFREGAAVFWNVKDKTMKHVMKVLEKHEIQPYEIALVHWENEELNYIKIEGQSKLHRGEIKLNSELDLDDAILEKFAFSNALCLSVKLAIWEASLDKFIESIQSIPEALKAGKKVKLSHEEVMQKIGELFALRHRINLSSDFLITPDFYWDRENLEGLYDKTCQFLSIGRRVKVMNEKLQHCMELTDLMRNHLNEKRALRLEWMIVILITIEVMFELGRVFF

SEQ ID NO: 3725 - protein, 137 aa, unidentified
MGWLRPGPRPLCPPARASWAFSHRFPSPLAPRRSPTPFFMASLLCCGPKLAACGIVLSAWGVIMLIMLGIFFNVHSAVLIEDVPFTEKDFENGPQNIYNLYEQVSYNCFIAAGLYLLLGGFSFCQVRLNKRKEYMVR

SEQ ID NO: 3726 - protein, 685 aa, unidentified
MWLKLFFLLLYFLVLFVLARFFEAIVWYETGIFATQLVDPVALSFKKLKTILECRGLGYSGLPEKKDVRELVEKSGDLMEGELYSALKEEEASESVSSTNFSGEMHFYELVEDTKDGIWLVQVIANDRSPLVGKIHWEKMVKKVSRFGIRTGTFNCSSDPRYCRRRGWVRSTLIMSVPQTSTSKGKVMLKEYSGRKIEVEHIFKWITAHAASRIKTIYNAEHLKEEWNKSDQYWLKIYLFANLDQPPAFFSALSIKFTGRVEFIFVNVENWDNKSYMTDIGIYNMPSYILRTPEGIYRYGNHTGEFISLQAMDSFLRSLQPEVNDLFVLSLVLVNLMAWMDLFITQGATIKRFVVLISTLGTYNSLLIISWLPVLGFLQLPYLDSFYEYSLKLLRYSNTTTLASWVRADWMFYSSHPALFLSTYLGHGLLIDYFEKKRRRNNNNDEVNANNLEWLSSLWDWYTSYLFHPIASFQNFPVESDWDEDPDLFLERLAFPDLWLHPLIPTDYIKNLPMWRFKCLGVQSEEEMSEGSQDTENDSESENTDTLSSEKEVFEDKQSVLHNSPGTASHCDAEACSCANKYCQTSPCERKGRSYGSYNTNEDMEPDWLTWPADMLHCTECVVCLENFENGCLLMGLPCGHVFHQNCIVMWLAGGRHCCPVCRWPSYKKKQPYAQHQPLSNDVPS

SEQ ID NO: 3727 - protein, 631 aa, unidentified
MPRPALSVTSFCHRLGKRERKQSFMGNSGNSWSHTPFPKLELGLGPQPMAPRELPTCSICLERLRDPISLDCGHDFCIRCFSTHRLPGCEPPCCPECRKICKQKRGLRSLGEKMKLLPQRPLPPALQETCPVRAEPLLLVRINASGGLILRMGAINRCLKHPLARDTPVCLLAVLGEQHSGKSFLLNHLLQGLPGLESGEGGRPRGGEASLQGCRWGANGLARGIWMWSHPFLLGKEGKKVAVFLVDTGDAMSPELSRETRIKLCALTTMLSSYQILSTSQELKDTDLDYLEMFVHVAEVMGKHYGMVPIQHLDLLVRDSSHPNKAGQGHVGNIFQRLSGRYPKVQELLQGKRARCCLLPAPGRRRMNQGHASPGDTDDDFRHLLGAYVSDVLSAAPQHAKSRCQGYWNEGRAVARGDRRLLTGQQLAQEIKNLSGWMGRTGPGFTSPDEMAAQLHDLRKVEAAKREFEEYVRQQDVATKRIFSALRVLPDTMRNLLSTQKDAILARHGVALLCKGRDQTLEALEAELQATAKAFMDSYTMRFCGHLAAVGGAVGAGLMGLAGGVVGAGMAAAALAAEAGMVAAGAAVGATGAAVVGGGVGAGLAATVGCMEKEEDERLLEGDREPLLQEE

SEQ ID NO: 3728 - protein, 327 aa, unidentified
MAAVVEVEVGGGAAGERELDEVDMSDLSPEEQWRVEHARMHAKHRGHEAMHAEMVLILIATLVVAQLLLVQWKQRHPRSYNMVTLFQMWVVPLYFTVKLHWWRFLVIWILFSAVTAFVTFRATRKPLVQTTPRLVYKWFLLIYKISYATGIVGYMAVMFTLFGLNLLFKIKPEDAMDFGISLLFYGLYYGVLERDFAEMCADYMASTIGFYSESGMPTKHLSDSVCAVCGQQIFVDVSEEGIIENTYRLSCNHVFHEFCIRGWCIVGKKQTCPYCKEKVDLKRMFSNPWERPHVMYGQLLDWLRYLVAWQPVIIGVVQGINYILGLE

SEQ ID NO: 3729 - protein, 155 aa, unidentified
MHPFQWCNGCFCGLGLVSTNKSCSMPPISFQDLPLNIYMVIFGTGIFVFMLSLIFCCYFISKLRNQAQSERYGYKEVVLKGDAKKLQLYGQTCAVCLEDFKGKDELGVLPCQHAFHRKCLVKWLEVRCVCPMCNKPIASPSEATQNIGILLDELV

SEQ ID NO: 3730 - protein, 428 aa, unidentified
MGPPPGAGVSCRGGCGFSRLLAWCFLLALSPQAPGSRGAEAVWTAYLNVSWRVPHTGVNRTVWELSEEGVYGQDSPLEPVAGVLVPPDGPGALNACNPHTNFTVPTVWGSTVQVSWLALIQRGGGCTFADKIHLAYERGASGAVIFNFPGTRNEVIPMSHPGAVDIVAIMIGNLKGTKILQSIQRGIQVTMVIEVGKKHGPWVNHYSIFFVSVSFFIITAATVGYFIFYSARRLRNARAQSRKQRQLKADAKKAIGRLQLRTLKQGDKEIGPDGDSCAVCIELYKPNDLVRILTCNHIFHKTCVDPWLLEHRTCPMCKCDILKALGIEVDVEDGSVSLQVPVSNEISNSASSHEEDNRSETASSGYASVQGTDEPPLEEHVQSTNESLQLVNHEANSVAVDVIPHVDNPTFEEDETPNQETAVREIKS

SEQ ID NO: 3731 - protein, 381 aa, unidentified
MLLSIGMLMLSATQVYTILTVQLFAFLNLLPVEADILAYNFENASQTFDDLPARFGYRLPAEGLKGFLINSKPENACEPIVPPPVKDNSSGTFIVLIRRLDCNFDIKVLNAQRAGYKAAIVHNVDSDDLISMGSNDIEVLKKIDIPSVFIGESSANSLKDEFTYEKGGHLILVPEFSLPLEYYLIPFLIIVGICLILIVIFMITKFVQDRHRARRNRLRKDQLKKLPVHKFKKGDEYDVCAICLDEYEDGDKLRILPCSHAYHCKCVDPWLTKTKKTCPVCKQKVVPSQGDSDSDTDSSQEENEVTEHTPLLRPLASVSAQSFGALSESRSHQNMTESSDYEEDDNEDTDSSDAENEINEHDVVVQLQPNGERDYNIANTV

SEQ ID NO: 3732 - protein, 376 aa, unidentified
MHLLKVGTWRNNTASSWLMKFSVLWLVSQNCCRASVVWMAYMNISFHVGNHVLSELGETGVFGRSSTLKRVAGVIVPPEGKIQNACNPNTIFSRSKYSETWLALIERGGCTFTQKIKVATEKGASGVIIYNVPGTGNQVFPMFHQAFEDVVVVMIGNLKGTEIFHLIKKGVLITAVVEVGRKHIIWMNHYLVSFVIVTTATLAYFIFYHIHRLCLARIQNRRWQRLTTDLQNTFGQLQLRVVKEGDEEINPNGDSCVICFERYKPNDIVRILTCKHFFHKNCIDPWILPHGTCPICKCDILKVLGIQVVVENGTEPLQVLMSNELPETLSPSEEETNNEVSPAGTSDKVIHVEENPTSQNNDIQPHSVVEDVHPSP

SEQ ID NO: 3733 - protein, 664 aa, unidentified
MAAVGPPQQQVRMAHQQVWAALEVALRVPCLYIIDAIFNSYPDSSQSRFCIVLQIFLRLFGVFASSIVLILSQRSLFKFYTYSSAFLLAATSVLVNYYASLHIDFYGAYNTSAFGIELLPRKGPSLWMALIVLQLTFGIGYVTLLQIHSIYSQLIILDLLVPVIGLITELPLHIRETLLFTSSLILTLNTVFVLAVKLKWFYYSTRYVYLLVRHMYRIYGLQLLMEDTWKRIRFPDILRVFWLTRVTAQATVLMYILRMANETDSFFISWDDFWDLICNLIISGCDSTLTVLGMSAVISSVAHYLGLGILAFIGSTEEDDRRLGFVAPVLFFILALQTGLSGLRPEERLIRLSRNMCLLLTAVLHFIHGMTDPVLMSLSASHVSSFRRHFPVLFVSACLFILPVLLSYVLWHHYALNTWLFAVTAFCVELCLKVIVSLTVYTLFMIDGYYNVLWEKLDDYVYYVRSTGSIIEFIFGVVMFGNGAYTMMFESGSKIRAFMMCLHAYFNIYLQAKNGWKTFMNRRTAVKKINSLPEIKGSRLQEINDVCAICYHEFTTSARITPCNHYFHALCLRKWLYIQDTCPMCHQKVYIEDDIKDNSNVSNNNGFIPPNETPEEAVREAAAESDRELNEDDSTDCDDDVQRERNGVIQHTGAAAEEFNDDTD

SEQ ID NO: 3734 - protein, 292 aa, unidentified
MTTTRYRPTWDLALDPLVSCKLCLGEYPVEQMTTIAQCQCIFCTLCLKQYVELLIKEGLETAISCPDAACPKQGHLQENEIECMVAAEIMQRYKKLQFEREVLFDPCRTWCPASTCQAVCQLQDVGLQTPQPVQCKACRMEFCSTCKASWHPGQGCPETMPITFLPGETSAAFKMEEDDAPIKRCPKCKVYIERDEGCAQMMCKNCKHAFCWYCLESLDDDFLLIHYDKGPCRNKLGHSRASVIWHRTQVVGIFAGFGLLLLVASPFLLLATPFVLCCKCKCSKGDDDPLPT

SEQ ID NO: 3735 - protein, 303 aa, unidentified
MGSAGRLHYLAMTAENPTPGDLAPAPLITCKLCLCEQSLDKMTTLQECQCIFCTACLKQYMQLAIREGCGSPITCPDMVCLNHGTLQEAEIACLVPVDQFQLYQRLKFEREVHLDPYRTWCPVADCQTVCPVASSDPGQPVLVECPSCHLKFCSCCKDAWHAEVSCRDSQPIVLPTEHRALFGTDAEAPIKQCPVCRVYIERNEGCAQMMCKNCKHTFCWYCLQNLDNDIFLRHYDKGPCRNKLGHSRASVMWNRTQVVGILVGLGIIALVTSPLLLLASPCIICCVCKSCRGKKKKHDPSTT

SEQ ID NO: 3736 - protein, 663 aa, unidentified
MAAKEKLEAVLNVALRVPSIMLLDVLYRWDVSSFFQQIQRSSLSNNPLFQYKYLALNMHYVGYILSVVLLTLPRQHLVQLYLYFLTALLLYAGHQISRDYVRSELEFAYEGPMYLEPLSMNRFTTALIGQLVVCTLCSCVMKTKQIWLFSAHMLPLLARLCLVPLETIVIINKFAMIFTGLEVLYFLGSNLLVPYNLAKSAYRELVQVVEVYGLLALGMSLWNQLVVPVLFMVFWLVLFALQIYSYFSTRDQPASRERLLFLFLTSIAECCSTPYSLLGLVFTVSFVALGVLTLCKFYLQGYRAFMNDPAMNRGMTEGVTLLILAVQTGLIELQVVHRAFLLSIILFIVVASILQSMLEIADPIVLALGASRDKSLWKHFRAVSLCLFLLVFPAYMAYMICQFFHMDFWLLIIISSSILTSLQVLGTLFIYVLFMVEEFRKEPVENMDDVIYYVNGTYRLLEFLVALCVVAYGVSETIFGEWTVMGSMIIFIHSYYNVWLRAQLGWKSFLLRRDAVNKIKSLPIATKEQLEKHNDICAICYQDMKSAVITPCSHFFHAGCLKKWLYVQETCPLCHCHLKNSSQLPGLGTEPVLQPHAGAEQNVMFQEGTEPPGQEHTPGTRIQEGSRDNNEYIARRPDNQEGAFDPKEYPHSAKDEAHPVESA

SEQ ID NO: 3737 - protein, 305 aa, unidentified
MSFLRITPSTHSSVSSGLLRLSIFLLLSFPDSNGKAIWTAHLNITFQVGNEITSELGESGVFGNHSPLERVSGVVALPEGWNQNACHPLTNFSRPKQADSWLALIERGGCTFTHKINVAAEKGANGVIIYNYQGTGSKVFPMSHQGTENIVAVMISNLKGMEILHSIQKGVYVTVIIEVGRMHMQWVSHYIMYLFTFLAATIAYFYLDCVWRLTPRVPNSFTRRRSQIKTDVKKAIDQLQLRVLKEGDEELDLNEDNCVVCFDTYKPQDVVRILTCKHFFHKACIDPWLLAHRTCPMCKCDILKT

SEQ ID NO: 3738 - protein, 400 aa, unidentified
MAWRRREASVGARGVLALALLALALCVPGARGRALEWFSAVVNIEYVDPQTNLTVWSVSESGRFGDSSPKEGAHGLVGVPWAPGGDLEGCAPDTRFFVPEPGGRGAAPWVALVARGGCTFKDKVLVAARRNASAVVLYNEERYGNITLPMSHAGTGNIVVIMISYPKGREILELVQKGIPVTMTIGVGTRHVQEFISGQSVVFVAIAFITMMIISLAWLIFYYIQRFLYTGSQIGSQSHRKETKKVIGQLLLHTVKHGEKGIDVDAENCAVCIENFKVKDIIRILPCKHIFHRICIDPWLLDHRTCPMCKLDVIKALGYWGEPGDVQEMPAPESPPGRDPAANLSLALPDDDGSDDSSPPSASPAESEPQCDPSFKGDAGENTALLEAGRSDSRHGGPIS

SEQ ID NO: 3739 - protein, 438 aa, unidentified
MAMSLIQACCSLALSTWLLSFCFVHLLCLDFTVAEKEEWYTAFVNITYAEPAPDPGAGAAGGGGAELHTEKTECGRYGEHSPKQDARGEVVMASSAHDRLACDPNTKFAAPTRGKNWIALIPKGNCTYRDKIRNAFLQNASAVVIFNVGSNTNETITMPHAGVEDIVAIMIPEPKGKEIVSLLERNITVTMYITIGTRNLQKYVSRTSVVFVSISFIVLMIISLAWLVFYYIQRFRYANARDRNQRRLGDAAKKAISKLQIRTIKKGDKETESDFDNCAVCIEGYKPNDVVRILPCRHLFHKSCVDPWLLDHRTCPMCKMNILKALGIPPNADCMDDLPTDFEGSLGGPPTNQITGASDTTVNESSVTLDPAVRTVGALQVVQDTDPIPQEGDVIFTTNSEQEPAVSSDSDISLIMAMEVGLSDVELSTDQDCEEVKS

SEQ ID NO: 3740 - protein, 203 aa, unidentified
METLSQDSLLECQICFNYYSPRRRPKLLDCKHTCCSVCLQQMRTSQKDVRCPWCRGVTKLPPGFSVSQLPDDPEVLAVIAIPHTSEHTPVFIKLPSNGCYMLPLPISKERALLPGDMGCRLLPGSQQKSVTVVTIPAEQQPLQGGAPQEAVEEEQDRRGVVKSSTWSGVCTVILVACVLVFLLGIVLHNMSCISKRFTVISCG

SEQ ID NO: 3741 - protein, 350 aa, unidentified [sequence omitted]

SEQ ID NO: 3742 - protein, 258 aa, unidentified
MAKYQGEVQSLKLDDDSVIEGVSDQVLVAVVVSFALIATLVYALFRNVHQNIHPENQELVRVLREQLQTEQDAPAATRQQFYTDMYCPICLHQASFPVETNCGHLFCGACIIAYWRYGSWLGAISCPICRQTVTLLLTVFGEDDQSQDVLRLHQDINDYNRRFSGQPRSIMERIMDLPTLLRHAFREMFSVGGLFWMFRIRIILCLMGAFFYLISPLDFVPEALFGILGFLDDFFVIFLLLIYISIMYREVITQRLTR

SEQ ID NO: 3743 - protein, 328 aa, unidentified
MAAGTAARKAAPVLEAPPQQEQLSHTKLSAEDTWNLQQERMYKMHRGHDSMHVEMILIFLCVLVIAQIVLVQWRQRHGRSYNLVTLLQMWVVPLYFTIKLYWWRFLSMWGMFSVITSYILFRATRKPLSGRTPRLVYKWFLLIYKLSYAFGVVGYLAIMFTMCGFNLFFKIKARDSMDFGIVSLFYGLYYGVMGRDFAEICSDYMASTIGFYSVSRLPTRSLSDNICAVCGQKIIVELDEEGLIENTYQLSCNHVFHEFCIRGWCIVGKKQTCPYCKEKVDLKRMISNPWERTHFLYGQILDWLRYLVAWQPVVIGIVQGIIYSLGLE

SEQ ID NO: 3744 - protein, 592 aa, unidentified
MKRSKELITKNHSQEETSILRCWKCRKCIASSGCFMEYLENQVIKDKDDSVDAQNICHVWHMNVEALPEWISCLIQKAQWTVGKLNCPFCGARLGGFNFVSTPKCSCGQLAAVHLSKSRTDYQPTQAGRLMRPSVKYLSHPRVQSGCDKEALLTGGGSENRNHRLLNMARNNNDPGRLTEALCLEVRPTYFEMKNEKLLSKASEPKYQLFVPQLVTGRCATRAFHRKSHSLDLNISEKLTLLPTLYEIHSKTTAYSRLNETQPIDLSGLPLQSSKNSYSFQNPSSFDPSMLLQRFSVAPHETQTQRGGEFQCGLEAASVYSDHTNTNNLTFLMDLPSAGRSMPEASDQEEHLSPLDFLHSANFSLGSINQRLNKRERSKLKNLRRKQRRRERWLQKQGKYSGVGLLDHMTLNNEMSTDEDNEYAEEKDSYICAVCLDVYFNPYMCYPCHHIFCEPCLRTLAKDNPSSTPCPLCRTIISRVFFQTELNNATKTFFTKEYLKIKQSFQKSNSAKWPLPSCRKAFHLFGGFRRHAAPVTRRQFPHGAHRMDYLHFEDDSRGWWFDMDMVIIYIYSVNWVIGFIVFCFLCYFFFPF

SEQ ID NO: 3745 - protein, 247 aa, unidentified
MASQPPEDTAESQASDELECKICYNRYNLKQRKPKVLECCHRVCAKCLYKIIDFGDSPQGVIVCPFCRFETCLPDDEVSSLPDDNNILVNLTCGGKGKKCLPENPTELLLTPKRLASLVSPSHTSSNCLVITIMEVQRESSPSLSSTPVVEFYRPASFDSVTTVSHNWTVWNCTSLLFQTSIRVLVWLLGLLYFSSLPLGIYLLVSKKVTLGVVFVSLVPSSLVILMVYGFCQCVCHEFLDCMAPPS

SEQ ID NO: 3746 - protein, 192 aa, unidentified
MAEQQGRELEAECPVCWNPFNNTFHTPKMLDCCHSFCVECLAHLSLVTPARRRLLCPLCRQPTVLASGQPVTDLPTDTAMLALLRLEPHHVILEGHQLCLKDQPKSRYFLRQPQVYTLDLGPQPGGQTGPPPDTASATVSTPILIPSHHSLRECFRNPQFRIFAYLMAVILSVTLLLIFSIFWTKQFLWGVG

SEQ ID NO: 3747 - protein, 192 aa, unidentified
MASKGPSASASPENSSAGGPSGSSNGAGESGGQDSTFECNICLDTAKDAVISLCGHLFCWPCLHQWLETRPNRQVCPVCKAGISRDKVIPLYGRGSTGQQDPREKTPPRPQGQRPEPENRGGFQGFGFGDGGFQMSFGIGAFPFGIFATAFNINDGRPPPAVPGTPQYVDEQFLSRLFLFVALVIMFWLLIA

SEQ ID NO: 3748 - protein, 227 aa, unidentified
MACTKTLQQSQPISAGATTTTTAVAPAGGHSGSTECDLECLVCREPYSCPRLPKLLACQHAFCAICLKLLLCVQDNTWSITCPLCRKVTAVPGGLICSLRDHEAVVGQLAQPCTEVSLCPQGLVDPADLAAGHPSLVGEDGQDEVSANHVAARRLAAHLLLLALLIILIGPFIYPGVLRWVLTFIIALALLMSTLFCCLPSTRGSCWPSSRTLFCREQKHSHISSIA

SEQ ID NO: 3749 - protein, 838 aa, unidentified
MQEQEIGFISKYNEGLCVNTDPVSILTSILDMSLHRQMGSDRDLQSSASSVSLPSVKKAPKKRRISIGSLFRRKKDNKRKSRELNGGVDGIASIESIHSEMCTDKNSIFSTNTSSDNGLTSISKQIGDFIECPLCLLRHSKDRFPDIMTCHHRSCVDCLRQYLRIEISESRVNISCPECTERFNPHDIRLILSDDVLMEKYEEFMLRRWLVADPDCRWCPAPDCGYAVIAFGCASCPKLTCGREGCGTEFCYHCKQIWHPNQTCDAARQERAQSLRLRTIRSSSISYSQESGAAADDIKPCPRCAAYIIKMNDGSCNHMTCAVCGCEFCWLCMKEISDLHYLSPSGCTFWGKKPWSRKKKILWQLGTLVGAPVGIALIAGIAIPAMIIGIPVYVGRKIHNRYEGKDVSKHKRNLAIAGGVTLSVIVSPVVAAVTVGIGVPIMLAYVYGVVPISLCRSGGCGVSAGNGKGVRIEFDDENDINVGGTNTAVDTTSVAEARHNPSIGEGSVGGLTGSLSASGSHMDRIGAIRDNLSETASTMALAGASITGSLSGSAMVNCFNRLEVQADVQKERYSLSGESGTVSLGTVSDNASTKAMAGSILNSYIPLDKEGNSMEVQVDIESKPSKFRHNSGSSSVDDGSATRSHAGGSSSGLPEGKSSATKWSKEATAGKKSKSGKLRKKGNMKINETREDMDAQLLEQQSTNSSEFEAPSLSDSMPSVADSHSSHFSEFSCSDLESMKTSCSHGSSDYHTRFATVNILPEVENDRLENSPHQCSISVVTQTASCSEVSQLNHIAEEHGNNGIKPNVDLYFGDALKETNNNHSHQTMELKVAIQTEI

SEQ ID NO: 3750 - protein, 732 aa, unidentified
MGSEKDSESPRSTSLHAAAPDPKCRSGGRRRRLTLHSVFSASARGRRARAKPQAEPPPPAAQPPPAPAPAAAQGPPPEALPAEPAAEAEAEAAAAAAEPGFDDEEAAEGGGPGAEEVECPLCLVRLPPERAPRLLSCPHRSCRDCLRHYLRLEISESRVPISCPECSERLNPHDIRLLLADPPLMHKYEEFMLRRYLASDPDCRWCPAPDCGYAVIAYGCASCPKLTCEREGCQTEFCYHCKQIWHPNQTCDMARQQRAQTLRVRTKHTSGLSYGQESGPADDIKPCPRCSAYIIKMNDGSCNHMTCAVCGCEFCWLCMKEISDLHYLSPSGCTFWGKKPWSRKKKILWQLGTLIGAPVGISLIAGIAIPAMVIGIPVYVGRKIHSRYEGRKTSKHKRNLAITGGVTLSVIASPVIAAVSVGIGVPIMLAYVYGVVPISLCRGGGCGVSTANGKGVKIEFDEDDGPITVADAWRALKNPSIGESSIEGLTSVLSTSGSPTDGLSVMQGPYSETASFAALSGGTLSGGILSSGKGKYSRLEVQADVQKEIFPKDTASLGAISDNASTRAMAGSIISSYNPQDRECNNMEIQVDIEAKPSHYQLVSGSSTEDSLHVHAQMAENEEEGSGGGGSEEDPPCRHQSCEQKDCLASKPWDISLAQPESIRSDLESSDAQSDDVPDITSDECGSPRSHTAACPSTPRAQGAPSPSAHMNLSALAEGQTVLKPEGGEARV

SEQ ID NO: 3751 - protein, 5207 aa, unidentified
MECPSCQHVSKEETPKFCSQCGERLPPAAPIADSENNNSTMASASEGEMECGQELKEEGGPCLFPGSDSWQENPEEPCSKASWTVQESKKKKRKKKKKGNKSASSELASLPLSPASPCHLTLLSNPWPQDTALPHSQAQQSGPTGQPSQPPGTATTPLEGDGLSAPTEVGDSPLQAQALGEAGVATGSEAQSSPQFQDHTEGEDQDASIPSGGRGLSQEGTGPPTSAGEGHSRTEDAAQELLLPESKGGSSEPGTELQTTEQQAGASASMAVDAVAEPANAVKGAGKEMKEKTQRMKQPPATTPPFKTHCQEAETKTKDEMAAAEEKVGKNEQGEPEDLKKPEGKNRSAAAVKNEKEQKNQEADVQEVKASTLSPGGGVTVFFHAIISLHFPFNPDLHKVFIRGGEEFGESKWDSNICELHYTRDLGHDRVLVEGIVCISKKHLDKYIPYKYVIYNGESFEYEFIYKHQQKKGEYVNRCLFIKSSLLGSGDWHQYYDIVYMKPHGRLQKVMNHITDGPRKDLVKGKQIAAALMLDSTFSILQTWDTINLNSFFTQFEQFCFVLQQPMIYEGQAQLWTDLQYREKEVKRYLWQHLKKHVVPLPDGKSTDFLPVDCPVRSKLKTGLIVLFVVEKIELLLEGSLDWLCHLLTSDASSPDEFHRDLSHILGIPQSWRLYLVNLCQRCMDTRTYTWLGALPVLHCCMELAPRHKDAWRQPEDTWAALEGLSFSPFREQMLDTSSLLQFMREKQHLLSIDEPLFRSWFSLLPLSHLVMYMENFIEHLGRFPAHILDCLSGIYYRLPGLEQVLNTQDVQDVQNVQNILEMLLRLLDTYRDKIPEEALSPSYLTVCLKLHEAICSSTKLLKFYELPALSAEIVCRMIRLLSLVDSAGQRDETGNNSVQTVFQGTLAATKRWLREVFTKNMLTSSGASFTYVKEIEVWRRLVEIQFPAEHGWKESLLGDMEWRLTKEEPLSQITAYCNSCWDTKGLEDSVAKTFEKCIIEAVSSACQSQTSILQGFSYSDLRKFGIVLSAVITKSWPRTADNFNDILKHLLTLADVKHVFRLCGTDEKILANVTEDAKRLIAVADSVLTKVVGDLLSGTILVGQLELIIKHKNQFLDIWQLREKSLSPQDEQCAVEEALDWRREELLLLKKEKRCVDSLLKMCGNVKHLIQVDFGVLAVRHSQDLSSKRLNDTVTVRLSTSSNSQRATHYHLSSQVQEMAGKIDLLRDSHIFQLFWREAAEPLSEPKEDQEAAELLSEPEEESERHILELEEVYDYLYQPSYRKFIKLHQDLKSGEVTLAEIDVIFKDFVNKYTDLDSELKIMCTVDHQDQRDWIKDRVEQIKEYHHLHQAVHAAKVILQVKESLGLNGDFSVLNTLLNFTDNFDDFRRETLDQINQELIQAKKLLQDISEARCKGLQALSLRKEFICWVREALGGINELKVFVDLASISAGENDIDVDRVACFHDAVQGYASLLFKLDPSVDFSAFMKHLKKLWKALDKDQYLPRKLCDSARNLEWLKTVNESHGSVERSSLTLATAINQRGIYVIQAPKGGQKISPDTVLHLILPESPGSHEESREYSLEEVKELLNKLMLMSGKKDRNNTEVERFSEVFCSVQRLSQAFIDLHSAGNMLFRTWIAMAYCSPKQGVSLQMDFGLDLVTELKEGGDVTELLAALCRQMEHFLDSWKRFVTQKRMEHFYLNFYTAEQLVYLSTELRKQPPSDAALTMLSFIKSNCTLRDVLRASVGCGSEAARYRMRRVMEELPLMLLSEFSLVDKLRIIMEQSMRCLPAFLPDCLDLETLGHCLAHLAGMGGSPVERCLPRGLQVGQPNLVVCGHSEVLPAALAVYMQTPSQPLPTYDEVLLCTPATTFEEVALLLRRCLTLGSLGHKVYSLLFADQLSYEVARQAEELFHNLCTQQHREDYQLVMVCDGDWEHCYLPSAFSQHKVFVTPQAPLEAIQAYLAGHYRVPKQTLSAAAVFNDRLCVGIVASERAGVGKSLYVKRLHDKMKMQLNVKNVPLKTIRLIDPQVDESRVLGALLPFLDAQYQKVPVLFHLDVTSSVQTGIWVFLFKLLILQYLMDINGKMWLRNPCHLYIVEILERRTSVPSRSSSALRTRVPQFSFLDIFPKVTCRPPKEVIDMELSALRSDTEPGMDLWEFCSETFQRPYQYLRRFNQNQDLDTFQYQEGSVEGTPEECLQHFLFHCGVINPSWSELRNFARFLNYQLRDCEASLFCNPSFIGDTLRGFKKFVVTFMIFMARDFATPSLHTSDQSPGKHMVTMDGVREEDLAPFSLRKRWESEPHPYVFFNDDHTTMTFIGFHLQPNINGSVDAISHLTGKVIKRDVMTRDLYQGLLLQRVPFNVDFDKLPRHKKLERLCLTLGIPQATDPDKTYELTTDNMLKILAIEMRFRCGIPVIIMGETGCGKTRLIKFLSDLRRGGTNADTIKLVKVHGGTTADMIYSRVREAENVAFANKDQHQLDTILFFDEANTTEAISCIKEVLCDHMVDGQPLAEDSGLHIIAACNPYRKHSEEMICRLESAGLGYRVSMEETADRLGSIPLRQLVYRVHALPPSLIPLVWDFGQLSDVAEKLYIQQIVQRLVESISLDENGTRVITEVLCASQGFMRKTEDECSFVSLRDVERCVKVFRWFHEHSAMLLAQLNAFLSKSSVSKNHTERDPVLWSLMLAIGVCYHASLEKKDSYRKAIARFFPKPYDDSRLLLDEITRAQDLFLDGVPLRKTIAKNLALKENVFMMVVCIELKIPLFLVGKPGSSKSLAKTIVADAMQGPAAYSDLFRSLKQVHLVSFQCSPHSTPQGIISTFRQCARFQQGKDLQQYVSVVVLDEVGLAEDSPKMPLKTLHPLLEDGCIEDDPAPHKKVGFVGISNWALDPAKMNRGIFVSRGSPNETELIESAKGICSSDILVQDRVQGYFASFAKAYETVCKRQDKEFFGLRDYYSLIKMVFAAAKASNRKPSPQDIAQAVLRNFSGKDDIQALDIFLANLPEAKCSEEVSPMQLIKQNIFGPSQKVPGGEQEDAESRYLLVLTKNYVALQILQQTFFEGDQQPEIIFGSGFPKDQEYTQLCRNINRVKICMETGKMVLLLNLQNLYESLYDALNQYYVHLGGQKYVDLGLGTHRVKCRVHPNFRLIVIEEKDVVYKHFPIPLINRLEKHYLDINTVLEKWQKSIVEELCAWVEKFINVKAHHFQKRHKYSPSDVFIGYHSDACASVVLQVIERQGPRALTEELHQKVSEEAKSILLNCATPDAVVRLSAYSLGGFAAEWLSQEYFHRQRHNSFADFLQAHLHTADLERHAIFTEITTFSRLLTSHDCEILESEVTGRAPKPTLLWLQQFDTEYSFLKEVRNCLTNTAKCKILIFQTDFEDGIRSAQLIASAKYSVINEINKIRENEDRIFVYFITKLSRVGRGTAYVGFHGGLWQSVHIDDLRRSTLMVSDVTRLQHVTISQLFAPGDLPELGLEHRAEDGHEEAMETEASTSGEVAEVAEEAMETESSEKVGKETSELGGSDVSILDTTRLLRSCVQSAVGMLRDQNESCTRNMRRVVLLLGLLNEDDACHASFLRVSKMRLSVFLKKQEESQFHPLEWLAREACNQDALQEAGTFRHTLWKRVQGAVTPLLASMISFIDRDGNLELLTRPDTPPWARDLWMFIFSDTMLLNIPLVMNNERHKGEMAYIVVQNHMNLSENASNNVPFSWKIKDYLEELWVQAQYITDAEGLPKKFVDIFQQTPLGRFLAQLHGEPQQELLQCYLKDFILLTMRVSTEEELKFLQMALWSCTRKLKAASEAPEEEVSLPWVHLAYQRFRSRLQNFSRILTIYPQVLHSLMEARWNHELAGCEMTLDAFAAMACTEMLTRNTLKPSPQAWLQLVKNLSMPLELICSDEHMQGSGSLAQAVIREVRAQWSRIFSTALFVEHVLLGTESRVPELQGLVTEHVFLLDKCLRENSDVKTHGPFEAVMRTLCECKETASKTLSRFGIQPCSICLGDAKDPVCLPCDHVHCLRCLRAWFASEQMICPYCLTALPDEFSPAVSQAHREAIEKHARFRQMCNSFFVDLVSTICFKDNAPPEKEVIESLLSLLFVQKGRLRDAAQRHCEHTKSLSPFNDVVDKTPVIRSVILKLLLKYSFHDVKDYIQEYLTLLKKKAFITEDKTELYMLFINCLEDSILEKTSAYSRNDELNHLEEEGRFLKAYSPASRGREPANEASVEYLQEVARIRLCLDRAADFLSEPEGGPEMAKEKQCYLQQVKQFCIRVENDWHRVYLVRKLSSQRGMEFVQGLSKPGRPHQWVFPKDVVKQQGLRQDHPGQMDRYLVYGDEYKALRDAVAKAVLECKPLGIKTALKACKTPQSQQSAYFLLTLFREVAILYRSHNASLHPTPEQCEAVSKFIGECKILSPPDISRFATSLVDNSVPLLRAGPSDSNLDGTVTEMAIHAAAVLLCGQNELLEPLKNLAFSPATMAHAFLPTMPEDLLAQARRWKGLERVHWYTCPNGHPCSVGECGRPMEQSICIDCHAPIGGIDHKPRDGFHLVKDKADRTQTGHVLGNPQRRDVVTCDRGLPPVVFLLIRLLTHLALLLGASQSSQALINIIKPPVRDPKGFLQQHILKDLEQLAKMLGHSADETIGVVHLVLRRLLQEQHQLSSRRLLNFDTELSTKEMRNNWEKEIAAVISPELEHLDKTLPTMNNLISQDKRISSNPVAKIIYGDPVTFLPHLPRKSVVHCSKIWSCRKRITVEYLQHIVEQKNGKERVPILWHFLQKEAELRLVKFLPEILALQRDLVKQFQNVQQVEYSSIRGFLSKHSSDGLRQLLHNRITVFLSTWNKLRRSLETNGEINLPKDYCSTDLDLDTEFEILLPRRRGLGLCATALVSYLIRLHNEIVYAVEKLSKENNSYSVDAAEVTELHVISYEVERDLTPLILSNCQYQVEEGRETVQEFDLEKIQRQIVSRFLQGKPRLSLKGIPTLVYRHDWNYEHLFMDIKNKMAQDSLPSSVISAISGQLQSYSDACEVLSVVEVTLGFLSTAGGDPNMQLNVYTQDILQMGDQTIHVLKALNRCQLKHTIALWQFLSAHKSEQLLRLHKEPFGEISSRYKADLSPENAKLLSTFLNQTGLDAFLLELHEMIILKLKNPQTQTEERFRPQWSLRDTLVSYMQTKESEILPEMASQFPEEILLASCVSVWKTAAVLKWNREMR

SEQ ID NO: 3752 - protein, 377 aa, unidentified
MGPAARPALRSPPPPPPPPPSPLLLLLPLLPLWLGLAGPGAAADGSEPAAGAGRGGARAVRVDVRLPRQDALVLEGVRIGSEADPAPLLGGRLLLMDIVDAEQEAPVEGWIAVAYVGKEQAAQFHQENKGSGPQAYPKALVQQMRRALFLGASALLLLILNHNVVRELDISQLLLRPVIVLHYSSNVTKLLDALLQRTQATAEITSGESLSANIEWKLTLWTTCGLSKDGYGGWQDLVCLGGSRAQEQKPLQQLWNAILLVAMLLCTGLVVQAQRQASRQSQRELGGQVDLFKRRVVRRLASLKTRRCRLSRAAQGLPDPGAETCAVCLDYFCNKQWLRVLPCKHEFHRDCVDPWLMLQQTCPLCKFNVLGNRYSDD

SEQ ID NO: 3753 - protein, 542 aa, unidentified
MGEEQSTVSGGGGPQESQTLASGTAGHPEPPRPQGDSARAPPLRAASAEPSGGGCGSDWGCADTSAPEPARSLGPPGWSKSRAPAQPAGLALTGPLNPQTLPLQLELEEEEEEAGDRKEGGDEQQEAPPGEELEPRTRVGAADGLVLDVLGQRRPSLAKRQVFCSVYCVESDLPEAPASEQLSPPASPPGAPPVLNPPSTRSSFPSPRLSLPTDSLSPDGGSIELEFYLAPEPFSMPSLLGAPPYSGLGGVGDPYVPLMVLMCRVCLEDKPIKPLPCCKKAVCEECLKVYLSAQVQLGQVEIKCPITECFEFLEETTVVYNLTHEDSIKYKYFLELGRIDSSTKPCPQCKHFTTFKKKGHIPTPSRSESKYKIQCPTCQFVWCFKCHSPWHEGVNCKEYKKGDKLLRHWASEIEHGQRNAQKCPKCKIHIQRTEGCDHMTCSQCNTNFCYRCGERYRQLRFFGDHTSNLSIFGCKYRYLPERPHLRRLVRGSVCAGKLFIAPLIMVLGLALGAIAVVIGLFVFPIYCLCKKQRKRSRTGMHW

SEQ ID NO: 3754 - protein, 220 aa, unidentified
MSEGESKDSSGSECPVCYEKFRDLEGASRTLSCGHVFCHDCLVKYLLSTRVDGQVQRTLVCPICRYVTFLSKKSSRWPSMLDKSSQTLAVPVGLPSVPPLDSLGHTNPLAASSPAWRPPPGQARPPGSPGQSAQLPLDLLPSLPRESQIFVISRHGMPLGEQDSVLPRRSLAELSEASLAPRSARAFCCRSRALLLITLIAVVAVVAAILPWVLLVRKQA

SEQ ID NO: 3755 - protein, 249 aa, unidentified
MSSGQQVWHTAVPPPRRSSSIASMPRSPSSAGSPRSPGTPGSERVASPLECSICFSGYDNIFKTPKELSCTHVFCLECLARLAAAQPVGRPGGEAVPCPFCRQPTAVPPAGAPALCTSRQLQARMPAHLRREEPVWLEGTKLCCQPLPTTPGREPGFVCVDVGLSKPAEPPAPARDPAPRRGRLARCWARCRDWRRMALVSALLLMLFCVALWPVQCALKTGNLRCLPLPPRPPATSTAASPLGPLTDN

SEQ ID NO: 3756 - protein, 148 aa, unidentified
MSSDFPHYNFRMPNIGFQNLPLNIYIVVFGTAIFVFILSLLFCCYLIRLRHQAHKEFYAYKQVILKEKVKELNLHELCAVCLEDFKPRDELGICPCKHAFHRKCLIKWLEVRKVCPLCNMPVLQLAQLHSKQDRGPPQGPLPGAENIV

SEQ ID NO: 3757 - protein, 433 aa, unidentified
MEAVYLVVNGLGLVLDVLTLVLDLNFLLVSSLLASLAWLLAFVYNLPHTVLTSLLHLGRGVLLSLLALIEAVVRFTCGGLQALCTLLYSCCSGLESLKLLGHLASHGALRSREILHRGVLNVVSSGHALLRQACDICAIAMSLVAYVINSLVNICLIGTQNLFSLVLALWDAVTGPLWRMTDVVAAFLAHISSSAVAMAILLWTPCQLALELLASAARLLASFVLVNLTGLVLLACVLAVTVTVLHPDFTLRLATQALSQLHARPSYHRLREDVMRLSRLALGSEAWRRVWSRSLQLASWPNRGGAPGAPQGDPMRVFSVRTRRQDTLPEAGRRSEAEEEEARTIRVTPVRGRERLNEEEPPGGQDPWKLLKEQEERKKCVICQDQSKTVLLLPCRHLCLCQACTEILMRHPVYHRNCPLCRRGILQTLNVYL

SEQ ID NO: 3758 - protein, 783 aa, unidentified
MSGGHQLQLAALWPWLLMATLQAGFGRTGLVLAAAVESERSAEQKAIIRVIPLKMDPTGKLNLTLEGVFAGVAEITPAEGKLMQSHPLYLCNASDDDNLEPGFISIVKLESPRRAPRPCLSLASKARMAGERGASAVLFDITEDRAAAEQLQQPLGLTWPVVLIWGNDAEKLMEFVYKNQKAHVRIELKEPPAWPDYDVWILMTVVGTIFVIILASVLRIRCRPRHSRPDPLQQRTAWAISQLATRRYQASCRQARGEWPDSGSSCSSAPVCAICLEEFSEGQELRVISCLHEFHRNCVDPWLHQHRTCPLCMFNITEGDSFSQSLGPSRSYQEPGRRLHLIRQHPGHAHYHLPAAYLLGPSRSAVARPPRPGPFLPSQEPGMGPRHHRFPRAAHPRAPGEQQRLAGAQHPYAQGWGLSHLQSTSQHPAACPVPLRRARPPDSSGSGESYCTERSGYLADGPASDSSSGPCHGSSSDSVVNCTDISLQGVHGSSSTFCSSLSSDFDPLVYCSPKGDPQRVDMQPSVTSRPRSLDSVVPTGETQVSSHVHYHRHRHHHYKKRFQWHGRKPGPETGVPQSRPPIPRTQPQPEPPSPDQQVTRSNSAAPSGRLSNPQCPRALPEPAPGPVDASSICPSTSSLFNLQKSSLSARHPQRKRRGGPSEPTPGSRPQDATVHPACQIFPHYTPSVAYPWSPEAHPLICGPPGLDKRLLPETPGPCYSNSQPVWLCLTPRQPLEPHPPGEGPSEWSSDTAEGRPCPYPHCQVLSAQPGSEEELEELCEQAV

SEQ ID NO: 3759 - protein, 180 aa, unidentified
MAAAEEEDGGPEGPNRERGGAGATFECNICLETAREAVVSVCGHLYCWPCLHQWLETRPERQECPVCKAGISREKVVPLYGRGSQKPQDPRLKTPPRPQGQRPAPESRGGFQPFGDTGGFHFSFGVGAFPFGFFTTVFNAHEPFRRGTGVDLGQGHPASSWQDSLFLFLAIFFFFWLLSI

SEQ ID NO: 3760 - protein, 435 aa, unidentified
MPLFLLSLPTPPSASGHERRQRPEAKTSGSEKKYLRAMQANRSQLHSPPGTGSSEDASTPQCVHTRLTGEGSCPHSGDVHIQINSIPKECAENASSRNIRSGVHSCAHGCVHSRLRGHSHSEARLTDDTAAESGDHGSSSFSEFRYLFKWLQKSLPYILILSVKLVMQHITGISLGIGLLTTFMYANKSIVNQVFLRERSSKIQCAWLLVFLAGSSVLLYYTFHSQSLYYSLIFLNPTLDHLSFWEVFWIVGITDFILKFFFMGLKCLILLVPSFIMPFKSKGYWYMLLEELCQYYRTFVPIPVWFRYLISYGEFGNVTRWSLGILLALLYLILKLLEFFGHLRTFRQVLRIFFTQPSYGVAASKRQCSDVDDICSICQAEFQKPILLICQHIFCEECMTLWFNREKTCPLCRTVISDHINKWKDGATSSHLQIY

SEQ ID NO: 3761 - protein, 444 aa, unidentified
MWLFTVNQVLRKMQRRHSSNTDNIPPERNRSQALSSEASVDEGGVFESLKAEAASPPALFSGLSGSLPTSSFPSSLVLGSSAGGGDVFIQMPASREEGGGRGEGGAYHHRQPHHHFHHGGHRGGSLLQHVGGDHRGHSEEGGDEQPGTPAPALSELKAVICWLQKGLPFILILLAKLCFQHKLGIAVCIGMASTFAYANSTLREQVSLKEKRSVLVILWILAFLAGNTLYVLYTFSSQQLYNSLIFLKPNLEMLDFFDLLWIVGIADFVLKYITIALKCLIVALPKIILAVKSKGKFYLVIEELSQLFRSLVPIQLWYKYIMGDDSSNSYFLGGVLIVLYSLCKSFDICGRVGGVRKALKLLCTSQNYGVRATGQQCTEAGDICAICQAEFREPLILLCQHVFCEECLCLWLDRERTCPLCRSVAVDTLRCWKDGATSAHFQVY

SEQ ID NO: 3762 - protein, 1651 aa, unidentified
MKWKHVPFLVMISLLSLSPNHLFLAQLIPDPEDVERGNDHGTPIPTSDNDDNSLGYTGSRLRQEDFPPRIVEHPSDLIVSKGEPATLNCKAEGRPTPTIEWYKGGERVETDKDDPRSHRMLLPSGSLFFLRIVHGRKSRPDEGVYVCVARNYLGEAVSHNASLEVAILRDDFRQNPSDVMVAVGEPAVMECQPPRGHPEPTISWKKDGSPLDDKDERITIRGGKLMITYTRKSDAGKYVCVGTNMVGERESEVAELTVLERPSFVKRPSNLAVTVDDSAEFKCEARGDPVPTVRWRKDDGELPKSRYEIRDDHTLKIRKVTAGDMGSYTCVAENMVGKAEASATLTVQEPPHFVVKPRDQVVALGRTVTFQCEATGNPQPAIFWRREGSQNLLFSYQPPQSSSRFSVSQTGDLTITNVQRSDVGYYICQTLNVAGSIITKAYLEVTDVIADRPPPVIRQGPVNQTVAVDGTFVLSCVATGSPVPTILWRKDGVLVSTQDSRIKQLENGVLQIRYAKLGDTGRYTCIASTPSGEATWSAYIEVQEFGVPVQPPRPTDPNLIPSAPSKPEVTDVSRNTVTLSWQPNLNSGATPTSYIIEAFSHASGSSWQTVAENVKTETSAIKGLKPNAIYLFLVRAANAYGISDPSQISDPVKTQDVLPTSQGVDHKQVQRELGNAVLHLHNPTVLSSSSIEVHWTVDQQSQYIQGYKILYRPSGANHGESDWLVFEVRTPAKNSVVIPDLRKGVNYEIKARPFFNEFQGADSEIKFAKTLEEAPSAPPQGVTVSKNDGNGTAILVSWQPPPEDTQNGMVQEYKVWCLGNETRYHINKTVDGSTFSVVIPFLVPGIRYSVEVAASTGAGSGVKSEPQFIQLDAHGNPVSPEDQVSLAQQISDVVKQPAFIAGIGAACWIILMVFSIWLYRHRKKRNGLTSTYAGIRKVPSFTFTPTVTYQRGGEAVSSGGRPGLLNISEPAAQPWLADTWPNTGNNHNDCSISCCTAGNGNSDSNLTTYSRPADCIANYNNQLDNKQTNLMLPESTVYGDVDLSNKINEMKTFNSPNLKDGRFVNPSGQPTPYATTQLIQSNLSNNMNNGSGDSGEKHWKPLGQQKQEVAPVQYNIVEQNKLNKDYRANDTVPPTIPYNQSYDQNTGGSYNSSDRGSSTSGSQGHKKGARTPKVPKQGGMNWADLLPPPPAHPPPHSNSEEYNISVDESYDQEMPCPVPPARMYLQQDELEEEEDERGPTPPVRGAASSPAAVSYSHQSTATLTPSPQEELQPMLQDCPEETGHMQHQPDRRRQPVSPPPPPRPISPPHTYGYISGPLVSDMDTDAPEEEEDEADMEVAKMQTRRLLLRGLEQTPASSVGDLESSVTGSMINGWGSASEEDNISSGRSSVSSSDGSFFTDADFAQAVAAAAEYAGLKVARRQMQDAAGRRHFHASQCPRPTSPVSTDSNMSAAVMQKTRPAKKLKHQPGHLRRETYTDDLPPPPVPPPAIKSPTAQSKTQLEVRPVVVPKLPSMDARTDRSSDRKGSSYKGREVLDGRQVVDMRTNPGDPREAQEQQNDGKGRGNKAAKRDLPPAKTHLIQEDILPYCRPTFPTSNNPRDPSSSSSMSSRGSGSRQREQANVGRRNIAEMQVLGGYERGEDNNEELEETES

SEQ ID NO: 3763 - protein, 1378 aa, unidentified
MSLLMFTQLLLCGFLYVRVDGSRLRQEDFPPRIVEHPSDVIVSKGEPTTLNCKAEGRPTPTIEWYKDGERVETDKDDPRSHRMLLPSGSLFFLRIVHGRRSKPDEGSYVCVARNYLGEAVSRNASLEVALLRDDFRQNPTDVVVAAGEPAILECQPPRGHPEPTIYWKKDKVRIDDKEERISIRGGKLMISNTRKSDAGMYTCVGTNMVGERDSDPAELTVFERPTFLRRPINQVVLEEEAVEFRCQVQGDPQPTVRWKKDDADLPRGRYDIKDDYTLRIKKTMSTDEGTYMCIAENRVGKMEASATLTVRAPPQFVVRPRDQIVAQGRTVTFPCETKGNPQPAVFWQKEGSQNLLFPNQPQQPNSRCSVSPTGDLTITNIQRSDAGYYICQALTVAGSILAKAQLEVTDVLTDRPPPIILQGPANQTLAVDGTALLKCKATGDPLPVISWLKEGFTFPGRDPRATIQEQGTLQIKNLRISDTGTYTCVATSSSGETSWSAVLDVTESGATISKNYDLSDLPGPPSKPQVTDVTKNSVTLSWQPGTPGTLPASAYIIEAFSQSVSNSWQTVANHVKTTLYTVRGLRPNTIYLFMVRAINPQGLSDPSPMSDPVRTQDISPPAQGVDHRQVQKELGDVLVRLHNPVVLTPTTVQVTWTVDRQPQFIQGYRVMYRQTSGLQATSSWQNLDAKVPTERSAVLVNLKKGVTYEIKVRPYFNEFQGMDSESKTVRTTEEAPSAPPQSVTVLTVGSYNSTSISVSWDPPPPDHQNGIIQEYKIWCLGNETRFHINKTVDAAIRSVIIGGLFPGIQYRVEVAASTSAGVGVKSEPQPIIIGRRNEVVITENNNSITEQITDVVKQPAFIAGIGGACWVILMGFSIWLYWRRKKRKGLSNYAVTFQRGDGGLMSNGSRPGLLNAGDPSYPWLADSWPATSLPVNNSNSGPNEIGNFGRGDVLPPVPGQGDKTATMLSDGAIYSSIDFTTKTSYNSSSQITQATPYATTQILHSNSIHELAVDLPDPQWKSSIQQKTDLMGFGYSLPDQNKGNNGGKGGKKKKNKNSSKPQKNNGSTWANVPLPPPPVQPLPGTELEHYAVEQQENGYDSDSWCPPLPVQTYLHQGLEDELEEDDDRVPTPPVRGVASSPAISFGQQSTATLTPSPREEMQPMLQAHLDELTRAYQFDIAKQTWHIQSNNQPPQPPVPPLGYVSGALISDLETDVADDDADDEEEALEIPRPLRALDQTPGSSMDNLDSSVTGKAFTSSQRPRPTSPFSTDSNTSAALSQSQRPRPTKKHKGGRMDQQPALPHRREGMTDEEALVPYSKPSFPSPGGHSSSGTASSKGSTGPRKTEVLRAGHQRNASDLLDIGYMGSNSQGQFTGEL

SEQ ID NO: 3764 - protein, 1386 aa, unidentified
MLRYLLKTLLQMNLFADSLAGDISNSSELLLGFNSSLAALNHTLLPPGDPSLNGSRVGPEDAMPRIVEQPPDLLVSRGEPATLPCRAEGRPRPNIEWYKNGARVATVREDPRAHRLLLPSGALFFPRIVHGRRARPDEGVYTCVARNYLGAAASRNASLEVAVLRDDFRQSPGNVVVAVGEPAVLECVPPRGHPEPSVSWRKDGARLKEEEGRITIRGGKLMMSHTLKSDAGMYVCVASNMAGERESAAAEVMVLERPSFLRRPVNQVVLADAPVTFLCEVKGDPPPRLRWRKEDGELPTGRYEIRSDHSLWIGHVSAEDEGTYTCVAENSVGRAEASGSLSVHVPPQLVTQPQDQMAAPGESVAFQCETKGNPPPAIFWQKEGSQVLLFPSQSLQPTGRFSVSPRGQLNITAVQRGDAGYYVCQAVSVAGSILAKALLEIKGASLDGLPPVILQGPANQTLVLGSSVWLPCRVTGNPQPSVRWKKDGQWLQGDDLQFKTMANGTLYIANVQEMDMGFYSCVAKSSTGEATWSGWLKMREDWGVSPDPPTEPSSPPGAPSQPVVTEITKNSITLTWKPNPQTGAAVTSYVIEAFSPAAGNTWRTVADGVQLETHTVSGLQPNTIYLFLVRAVGAWGLSEPSPVSEPVRTQDSSPSRPVEDPWRGQQGLAEVAVRLQEPIVLGPRTLQVSWTVDGPVQLVQGFRVSWRVAGPEGGSWTMLDLQSPSQQSTVLRGLPPGTQIQIKVQAQGQEGLGAESLSVTRSIPEEAPSGPPQGVAVALGGDGNSSITVSWEPPLPSQQNGVITEYQIWCLGNESRFHLNRSAAGWARSAMLRGLVPGLLYRTLVAAATSAGVGVPSAPVLVQLPSPPDLEPGLEVGAGLAVRLARVLREPAFLAGSGAACGALLLGLCAALYWRRKQRKELSHYTASFAYTPAVSFPHSEGLSGASSRPPMGLGPAPYSWLADSWPHPSRSPSAQEPRGSCCPSNPDPDDRYYNEAGISLYLAQTARGTAAPGEGPVYSTIDPAGEELQTFHGGFPQHPSGDLGPWSQYAPPEWSQGDSGAKGGKVKLLGKPVQMPSLNWPEALPPPPPSCELSCLEGPEEELEGSSEPEEWCPPMPERSHLTEPSSSGGCLVTPSRRETPSPTPSYGQQSTATLTPSPPDPPQPPTDMPHLHQMPRRVPLGPSSPLSVSQPMLGIREARPAGLGAGPAASPHLSPSPAPSTASSAPGRTWQGNGEMTPPLQGPRARFRKKPKALPYRRENSPGDLPPPPLPPPEEEASWALELRAAGSMSSLERERSGERKAVQAVPLAAQRVLHPDEEAWLPYSRPSFLSRGQGTSTCSTAGSNSSRGSSSSRGSRGPGRSRSRSQSRSQSQRPGQKRREEPR

SEQ ID NO: 3765 - protein, 1007 aa, unidentified
MGSGGDSLLGGRGSLPLLLLLIMGGMAQDSPPQILVHPQDQLFQGPGPARMSCQASGQPPPTIRWLLNGQPLSMVPPDPHHLLPDGTLLLLQPPARGHAHDGQALSTDLGVYTCEASNRLGTAVSRGARLSVAVLREDFQIQPRDMVAVVGEQFTLECGPPWGHPEPTVSWWKDGKPLALQPGRHTVSGGSLLMARAEKSDEGTYMCVATNSAGHRESRAARVSIQEPQDYTEPVELLAVRIQLENVTLLNPDPAEGPKPRPAVWLSWKVSGPAAPAQSYTALFRTQTAPGGQGAPWAEELLAGWQSAELGGLHWGQDYEFKVRPSSGRARGPDSNVLLLRLPEKVPSAPPQEVTLKPGNGTVFVSWVPPPAENHNGIIRGYQVWSLGNTSLPPANWTVVGEQTQLEIATHMPGSYCVQVAAVTGAGAGEPSRPVCLLLEQAMERATQEPSEHGPWTLEQLRATLKRPEVIATCGVALWLLLLGTAVCIHRRRRARVHLGPGLYRYTSEDAILKHRMDHSDSQWLADTWRSTSGSRDLSSSSSLSSRLGADARDPLDCRRSLLSWDSRSPGVPLLPDTSTFYGSLIAELPSSTPARPSPQVPAVRRLPPQLAQLSSPCSSSDSLCSRRGLSSPRLSLAPAEAWKAKKKQELQHANSSPLLRGSHSLELRACELGNRGSKNLSQSPGAVPQALVAWRALGPKLLSSSNELVTRHLPPAPLFPHETPPTQSQQTQPPVAPQAPSSILLPAAPIPILSPCSPPSPQASSLSGPSPASSRLSSSSLSSLGEDQDSVLTPEEVALCLELSEGEETPRNSVSPMPRAPSPPTTYGYISVPTASEFTDMGRTGGGVGPKGGVLLCPPRPCLTPTPSEGSLANGWGSASEDNAASARASLVSSSDGSFLADAHFARALAVAVDSFGFGLEPREADCVFIDASSPPSPRDEIFLTPNLSLPLWEWRPDWLEDMEVSHTQRLGRGMPPWPPDSQISSQRSQLHCRMPKAGASPVDYS

SEQ ID NO: 3766 - protein, 351 aa, unidentified
MAPVLPLVLPLQPRIRLAQGLWLLSWLLALAGGVILLCSGHLLVQLRHLGTFLAPSCQFPVLPQAALAAGAVALGTGLVGVGASRASLNAALYPPWRGVLGPLLVAGTAGGGGLLVVGLGLALALPGSLDEALEEGLVTALAHYKDTEVPGHCQAKRLVDELQLRYHCCGRHGYKDWFGVQWVSSRYLDPGDRDVADRIQSNVEGLYLTDGVPFSCCNPHSPRPCLQNRLSDSYAHPLFDPRQPNQNLWAQGCHEVLLEHLQDLAGTLGSMLAVTFLLQALVLLGLRYLQTALEGLGGVIDAGGETQGYLFPSGLKDMLKTAWLQGGVACRPAPEEAPPGEAPPKEDLSEA

SEQ ID NO: 3767 - protein, 937 aa, unidentified
MHRPRRRGTRPPLLALLAALLLAARGAAAQETELSVSAELVPTSSWNISSELNKDSYLTLDEPMNNITTSLGQTAELHCKVSGNPPPTIRWFKNDAPVVQEPRRLSFRSTIYGSRLRIRNLDTTDTGYFQCVATNGKEVVSSTGVLFVKFGPPPTASPGYSDEYEEDGFCQPYRGIACARFIGNRTVYMESLHMQGEIENQITAAFTMIGTSSHLSDKCSQFAIPSLCHYAFPYCDETSSVPKPRDLCRDECEILENVLCQTEYIFARSNPMILMRLKLPNCEDLPQPESPEAANCIRIGIPMADPINKNHKCYNSTGVDYRGTVSVTKSGRQCQPWNSQYPHTHTFTALRFPELNGGHSYCRNPGNQKEAPWCFTLDENFKSDLCDIPACDSKDSKEKNKMEILYILVPSVAIPLAIALLFFFICVCRNNQKSSSAPVQRQPKHVRGQNVEMSMLNAYKPKSKAKELPLSAVRFMEELGECAFGKIYKGHLYLPGMDHAQLVAIKTLKDYNNPQQWTEFQQEASLMAELHHPNIVCLLGAVTQEQPVCMLFEYINQGDLHEFLIMRSPHSDVGCSSDEDGTVKSSLDHGDFLHIAIQIAAGMEYLSSHFFVHKDLAARNILIGEQLHVKISDLGLSREIYSADYYRVQSKSLLPIRWMPPEAIMYGKFSSDSDIWSFGVVLWEIFSFGLQPYYGFSNQEVIEMVRKRQLLPCSEDCPPRMYSLMTECWNEIPSRRPRFKDIHVRLRSWEGLSSHTSSTTPSGGNATTQTTSLSASPVSNLSNPRYPNYMFPSQGITPQGQIAGFIGPPIPQNQRFIPINGYPIPPGYAAFPAAHYQPTGPPRVIQHCPPPKSRSPSSASGSTSTGHVTSLPSSGSNQEANIPLLPHMSIPNHPGGMGITVFGNKSQKPYKIDSKQASLLGDANIHGHTESMISAEL

SEQ ID NO: 3768 - protein, 943 aa, unidentified
MARGSALPRRPLLCIPAVWAAAALLLSVSRTSGEVEVLDPNDPLGPLDGQDGPIPTLKGYFLNFLEPVNNITIVQGQTAILHCKVAGNPPPNVRWLKNDAPVVQEPRRIIIRKTEYGSRLRIQDLDTTDTGYYQCVATNGMKTITATGVLFVRLGPTHSPNHNFQDDYHEDGFCQPYRGIACARFIGNRTIYVDSLQMQGEIENRITAAFTMIGTSTHLSDQCSQFAIPSFCHFVFPLCDARSRTPKPRELCRDECEVLESDLCRQEYTIARSNPLILMRLQLPKCEALPMPESPDAANCMRIGIPAERLGRYHQCYNGSGMDYRGTASTTKSGHQCQPWALQHPHSHHLSSTDFPELGGGHAYCRNPGGQMEGPWCFTQNKNVRMELCDVPSCSPRDSSKMGILYILVPSIAIPLVIACLFFLVCMCRNKQKASASTPQRRQLMASPSQDMEMPLINQHKQAKLKEISLSAVRFMEELGEDRFGKVYKGHLFGPAPGEQTQAVAIKTLKDKAEGPLREEFRHEAMLRARLQHPNVVCLLGVVTKDQPLSMIFSYCSHGDLHEFLVMRSPHSDVGSTDDDRTVKSALEPPDFVHLVAQIAAGMEYLSSHHVVHKDLATRNVLVYDKLNVKISDLGLFREVYAADYYKLLGNSLLPIRWMAPEAIMYGKFSIDSDIWSYGVVLWEVFSYGLQPYCGYSNQDVVEMIRNRQVLPCPDDCPAWVYALMIECWNEFPSRRPRFKDIHSRLRAWGNLSNYNSSAQTSGASNTTQTSSLSTSPVSNVSNARYVGPKQKAPPFPQPQFIPMKGQIRPMVPPPQLYVPVNGYQPVPAYGAYLPNFYPVQIPMQMAPQQVPPQMVPKPSSHHSGSGSTSTGYVTTAPSNTSMADRAALLSEGADDTQNAPEDGAQSTVQEAEEEEEGSVPETELLGDCDTLQVDEAQVQLEA

SEQ ID NO: 3769 - protein, 2347 aa, unidentified
MKNIYCLIPKLVNFATLGCLWISVVQCTVLNSCLKSCVTNLGQQLDLGTPHNLSEPCIQGCHFWNSVDQKNCALKCRESCEVGCSSAEGAYEEEVLENADLPTAPFASSIGSHNMTLRWKSANFSGVKYIIQWKYAQLLGSWTYTKTVSRPSYVVKPLHPFTEYIFRVVWIFTAQLQLYSPPSPSYRTHPHGVPETAPLIRNIESSSPDTVEVSWDPPQFPGGPILGYNLRLISKNQKLDAGTQRTSFQFYSTLPNTIYRFSIAAVNEVGEGPEAESSITTSSSAVQQEEQWLFLSRKTSLRKRSLKHLVDEAHCLRLDAIYHNITGISVDVHQQIVYFSEGTLIWAKKAANMSDVSDLRIFYRGSGLISSISIDWLYQRMYFIMDELVCVCDLENCSNIEEITPPSISAPQKIVADSYNGYVFYLLRDGIYRADLPVPSGRCAEAVRIVESCTLKDFAIKPQAKRIIYFNDTAQVFMSTFLDGSASHLILPRIPFADVKSFACENNDFLVTDGKVIFQQDALSFNEFIVGCDLSHIEEFGFGNLVIFGSSSQLHPLPGRPQELSVLFGSHQALVQWKPPALAIGANVILISDIIELFELGPSAWQNWTYEVKVSTQDPPEVTHIFLNISGTMLNVPELQSAMKYKVSVRASSPKRPGPWSEPSVGTTLVPASEPPFIMAVKEDGLWSKPLNSFGPGEFLSSDIGNVSDMDWYNNSLYYSDTKGDVFVWLLNGTDISENYHLPSIAGAGALAFEWLGHFLYWAGKTYVIQRQSVLTGHTDIVTHVKLLVNDMVVDSVGGYLYWTTLYSVESTRLNGESSLVLQTQPWFSGKKVIALTLDLSDGLLYWLVQDSQCIHLYTAVLRGQSTGDTTITEFAAWSTSEISQNALMYYSGRLFWINGFRIITTQEIGQKTSVSVLEPARFNQFTIIQTSLKPLPGNFSFTPKVIPDSVQESSFRIEGNASSFQILWNGPPAVDWGVVFYSVEFSAHSKFLASEQHSLPVFTVEGLEPYALFNLSVTPYTYWGKGPKTSLSLRAPETVPSAPENPRIFILPSGKCCNKNEVVVEFRWNKPKHENGVLTKFEIFYNISNQSITNKTCEDWIAVNVTPSVMSFQLEGMSPRCFIAFQVRAFTSKGPGPYADVVKSTTSEINPFPHLITLLGNKIVFLDMDQNQVVWTFSAERVISAVCYTADNEMGYYAEGDSLFLLHLHNRSSSELFQDSLVFDITVITIDWISRHLYFALKESQNGMQVFDVDLEHKVKYPREVKIHNRNSTIISFSVYPLLSRLYWTEVSNFGYQMFYYSIISHTLHRILQPTATNQQNKRNQCSCNVTEFELSGAMAIDTSNLEKPLIYFAKAQEIWAMDLEGCQCWRVITVPAMLAGKTLVSLTVDGDLIYWIITAKDSTQIYQAKKGNGAIVSQVKALRSRHILAYSSVMQPFPDKAFLSLASDTVEPTILNATNTSLTIRLPLAKTNLTWYGITSPTPTYLVYYAEVNDRKNSSDLKYRILEFQDSIALIEDLQPFSTYMIQIAVKNYYSDPLEHLPPGKEIWGKTKNGVPEAVQLINTTVRSDTSLIISWRESHKPNGPKESVRYQLAISHLALIPETPLRQSEFPNGRLTLLVTRLSGGNIYVLKVLACHSEEMWCTESHPVTVEMFNTPEKPYSLVPENTSLQFNWKAPLNVNLIRFWVELQKWKYNEFYHVKTSCSQGPAYVCNITNLQPYTSYNVRVVVVYKTGENSTSLPESFKTKAGVPNKPGIPKLLEGSKNSIQWEKAEDNGCRITYYILEIRKSTSNNLQNQNLRWKMTFNGSCSSVCTWKSKNLKGIFQFRVVAANNLGFGEYSGISENIILVGDDFWIPETSFILTIIVGIFLVVTIPLTFVWHRRLKNQKSAKEGVTVLINEDKELAELRGLAAGVGLANACYAIHTLPTQEEIENLPAFPREKLTLRLLLGSGAFGEVYEGTAVDILGVGSGEIKVAVKTLKKGSTDQEKIEFLKEAHLMSKFNHPNILKQLGVCLLNEPQYIILELMEGGDLLTYLRKARMATFYGPLLTLVDLVDLCVDISKGCVYLERMHFIHRDLAARNCLVSVKDYTSPRIVKIGDFGLARDIYKNDYYRKRGEGLLPVRWMAPESLMDGIFTTQSDVWSFGILIWEILTLGHQPYPAHSNLDVLNYVQTGGRLEPPRNCPDDLWNLMTQCWAQEPDQRPTFHRIQDQLQLFRNFFLNSIYKSRDEANNSGVINESFEGEDGDVICLNSDDIMPVALMETKNREGLNYMVLATECGQGEEKSEGPLGSQESESCGLRKEEKEPHADKDFCQEKQVAYCPSGKPEGLNYACLTHSGYGDGSD

SEQ ID NO: 3770 - protein, 313 aa, unidentified
METANYTKVTEFVLTGLSQTPEVQLVLFVIFLSFYLFILPGNILIICTISLDPHLTSPMYFLLANLAFLDIWYSSITAPEMLIDFFVERKIISFDGCIAQLFFLHFAGASEMFLLTVMAFDLYTAICRPLHYATIMNQRLCCILVALSWRGGFIHSIIQVALIVRLPFCGPNELDSYFCDITQVVRIACANTFPEELVMICSSGLISVVCLIALLMSYAFLLALFKKLSGSGENTNRAMSTCYSHITIVVLMFGPSIYIYARPFDSFSLDKVVSVFNTLIFPLRNPIIYTLRNKEVKAAMRKLVTKYILCKEK

SEQ ID NO: 3771 - protein, 951 aa, unidentified
MRGRGNARSSQALGVSWCPATWHPRLDMGRLHRPRSSTSYRNLPHLFLFFLFVGPFSCLGSYSRATELLYSLNEGLPAGVLIGSLAEDLRLLPRSAGRPDPQSQLPERTGAEWNPPLSFSLASRGLSGQYVTLDNRSGELHTSAQEIDREALCVEGGGGTAWSGSVSISSSPSDSCLLLLDVLVLPQEYFRFVKVKIAIRDINDNAPQFPVSQISVWVPENAPVNTRLAIEHPAVDPDVGINGVQTYRLLDYHGMFTLDVEENENGERTPYLIVMGALDRETQDQYVSIIIAEDGGSPPLLGSATLTIGISDINDNCPLFTDSQINVTVYGNATVGTPIAAVQAVDKDLGTNAQITYSYSQKVPQASKDLFHLDENTGVIKLFSKIGGSVLESHKLTILANGPGCIPAVITALVSIIKVIFRPPEIVPRYIANEIDGVVYLKELEPVNTPIAFFTIRDPEGKYKVNCYLDGEGPFRLSPYKPYNNEYLLETTKPMDYELQQFYEVAVVAWNSEGFHVKRVIKVQLLDDNDNAPIFLQPLIELTIEENNSPNAFLTKLYATDADSEERGQVSYFLGPDAPSYFSLDSVTGILTVSTQLDREEKEKYRYTVRAVDCGKPPRESVATVALTVLDKNDNSPRFINKDFSFFVPENFPGYGEIGVISVTDADAGRNGWVALSVVNQSDIFVIDTGKGMLRAKVSLDREQQSSYTLWVEAVDGGEPALSSTAKITILLLDINDNPPLVLFPQSNMSYLLVLPSTLPGSPVTEVYAVDKDTGMNAVIAYSIIGRRGPRPESFRIDPKTGNITLEEALLQTDYGLHRLLVKVSDHGYPEPLHSTVMVNLFVNDTVSNESYIESLLRKEPEINIEEKEPQISIEPTHRKVESVSCMPTLVALSVISLGSITLVTGMGIYICLRKGEKHPREDENLEVQIPLKGKIDLHMRERKPMDISNI

SEQ ID NO: 3772 - protein, 360 aa, unidentified
MLSAAHDILSHKRTSGNQSHAVLLADILPTLVIKLLAPLGLHLLPYSPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 3773 - protein, 450 aa, unidentified
MREIVHIQAGQCGNQIGAKFWEVISDEHGIDPSGNYVGDSDLQLERISVYYNEASSHKYVPRAILVDLEPGTMDSVRSGAFGHLFRPDNFIFGQSGAGNNWAKGHYTEGAELVDSVLDVVRKECENCDCLQGFQLTHSLGGGTGSGMGTLLISKVREEYPDRIMNTFSVVPSPKVSDTVVEPYNATLSIHQLVENTDETYCIDNEALYDICFRTLKLATPTYGDLNHLVSATMSGVTTSLRFPGQLNADLRKLAVNMVPFPRLHFFMPGFAPLTARGSQQYRALTVPELTQQMFDAKNMMAACDPRHGRYLTVATVFRGRMSMKEVDEQMLAIQSKNSSYFVEWIPNNVKVAVCDIPPRGLKMSSTFIGNSTAIQELFKRISEQFTAMFRRKAFLHWYTGEGMDEMEFTEAESNMNDLVSEYQQYQDATAEEEGEMYEDDEEESEAQGPK

SEQ ID NO: 3774 - protein, 1393 aa, unidentified
MLSRPKPGESEVDLLHFQSQFLAAGAAPAVQLVKKGNRGGGDANSDRPPLQDHRDVVMLDNLPDLPPALVPSPPKRARPSPGHCLPEDEDPEERLRRHDQHITAVLTKIIERDTSSVAVNLPVPSGVAFPAVFLRSRDTQGKSATSGKRSIFAQEIAARRIAEAKGPSVGEVVPNVGPPEGAVTCETPTPRNQGCQLPGSSHSFQGPNLVTGKGLRDQEAEQEAQTIHEENIARLQAMAPEEILQEQQRLLAQLDPSLVAFLRSHSHTQEQTGETASEEQRPGGPSANVTKEEPLMSAFASEPRKRDKLEPEAPALALPVTPQKEWLHMDTVELEKLHWTQDLPPVRRQQTQERMQARFSLQGELLAPDVDLPTHLGLHHHGEEAERAGYSLQELFHLTRSQVSQQRALALHVLAQVISRAQAGEFGDRLAGSVLSLLLDAGFLFLLRFSLDDRVDGVIATAIRALRALLVAPGDEELLDSTFSWYHGALTFPLMPSQEDKEDEDEDEECPAGKAKRKSPEEESRPPPDLARHDVIKGLLATSLLPRLRYVLEVTYPGPAVVLDILAVLIRLARHSLESATRVLECPRLIETIVREFLPTSWSPVGAGPTPSLYKVPCATAMKLLRVLASAGRNIAARLLSSFDLRSRLCRIIAEAPQELALPPEEAEMLSTEALRLWAVAASYGQGGYLYRELYPVLMRALQVVPRELSTHPPQPLSMQRIASLLTLLTQLTLAAGSTPAETISDSAEASLSATPSLVTWTQVSGLQPLVEPCLRQTLKLLSRPEMWRAVGPVPVACLLFLGAYYQAWSQQPSSCPEDWLQDMQRLSEELLLPLLSQPTLGSLWDSLRHCSLLCNPLSCVPALEAPPSLVSLGCSGGCPRLSLAGSASPFPFLTALLSLLNTLAQIHKGLCGQLAAILAAPGLQNYFLQCVAPGAAPHLTPFSAWALRHEYHLQYLALALAQKAAALQPLPATHAALYHGMALALLSRLLPGSEYLTHELLLSCVFRLEFLPERTSGGPEAADFSDQLSLGSSRVPRCGQGTLLAQACQDLPSIRNCYLTHCSPARASLLASQALHRGELQRVPTLLLPMPTEPLLPTDWPFLPLIRLYHRASDTPSGLSPTDTMGTAMRVLQWVLVLESWRPQALWAVPPAARLARLMCVFLVDSELFRESPVQHLVAALLAQLCQPQVLPNLNLDCRLPGLTSFPDLYANFLDHFEAVSFGDHLFGALVLLPLQRRFSVTLRLALFGEHVGALRALSLPLTQLPVSLECYTVPPEDNLALLQLYFRTLVTGALRPRWCPVLYAVAVAHVNSFIFSQDPQSSDEVKAARRSMLQKTWLLADEGLRQHLLHYKLPNSTLPEGFELYSQLPPLRQHYLQRLTSTVLQNGVSET

SEQ ID NO: 3775 - protein, 612 aa, unidentified
MADFAGPSSAGRKAGAPRCSRKAAGTKQTSTLKQEDASKRKAELEAAVRKKIEFERKALHIVEQLLEENITEEFLMECGRFITPAHYSDVVDERSIVKLCGYPLCQKKLGIVPKQKYKISTKTNKVYDITERKSFCSNFCYQASKFFEAQIPKTPVWVREEERHPDFQLLKEEQSGHSGEEVQLCSKAIKTSDIDNPSHFEKQYESSSSSTHSDSSSDNEQDFVSSILPGNRPNSTNIRPQLHQKSIMKKKAGHKANSKHKDKEQTVVDVTEQLGDCKLDSQEKDATCELPLQKVNTQSSSNSTLPERLKASENSESEYSRSEITLVGISKKSAEHFKRKFAKSNQVSRSVSSSVQVCPEVGKRNLLKVLKETLIEWKTEETLRFLYGQNYASVCLKPEASLVKEELDEDDIISDPDSHFPAWRESQNSLDESLPFRGSGTAIKPLPSYENLKKETEKLNLRIREFYRGRYVLGEETTKSQDSEEHDSTFPLIDSSSQNQIRKRIVLEKLSKVLPGLLVPLQITLGDIYTQLKNLVRTFRLTNRNIIHKPAEWTLIAMVLLSLLTPILGIQKHSQEGMVFTRFLDTLLEELHLKNEDLESLTIIFRTSCLPE

SEQ ID NO: 3776 - protein, 1020 aa, unidentified
MREPEELMPDSGAVFTFGKSKFAENNPGKFWFKNDVPVHLSCGDEHSAVVTGNNKLYMFGSNNWGQLGLGSKSAISKPTCVKALKPEKVKLAACGRNHTLVSTEGGNVYATGGNNEGQLGLGDTEERNTFHVISFFTSEHKIKQLSAGSNTSAALTEDGRLFMWGDNSEGQIGLKNVSNVCVPQQVTIGKPVSWISCGYYHSAFVTTDGELYVFGEPENGKLGLPNQLLGNHRTPQLVSEIPEKVIQVACGGEHTVVLTENAVYTFGLGQFGQLGLGTFLFETSEPKVIENIRDQTISYISCGENHTALITDIGLMYTFGDGRHGKLGLGLENFTNHFIPTLCSNFLRFIVKLVACGGCHMVVFAAPHRGVAKEIEFDEINDTCLSVATFLPYSSLTSGNVLQRTLSARMRRRERERSPDSFSMRRTLPPIEGTLGLSACFLPNSVFPRCSERNLQESVLSEQDLMQPEEPDYLLDEMTKEAEIDNSSTVESLGETTDILNMTHIMSLNSNEKSLKLSPVQKQKKQQTIGELTQDTALTENDDSDEYEEMSEMKEGKACKQHVSQGIFMTQPATTIEAFSDEEVGNDTGQVGPQADTDGEGLQKEVYRHENNNGVDQLDAKEIEKESDGGHSQKESEAEEIDSEKETKLAEIAGMKDLREREKSTKKMSPFFGNLPDRGMNTESEENKDFVKKRESCKQDVIFDSERESVEKPDSYMEGASESQQGIADGFQQPEAIEFSSGEKEDDEVETDQNIRYGRKLIEQGNEKETKPIISKSMAKYDFKCDRLSEIPEEKEGAEDSKGNGIEEQEVEANEENVKVHGGRKEKTEILSDDLTDKAEDHEFSKTEELKLEDVDEEINAENVESKKKTVGDDESVPTGYHSKTEGAERTNDDSSAETIEKKEKANLEERAICEYNENPKGYMLDDADSSSLEILENSETTPSKDMKKTKKIFLFKRVPSINQKIVKNNNEPLPEIKSIGDQIILKSDNKDADQNHMSQNHQNIPPTNTERRSKSCTIL

SEQ ID NO: 3777 - protein, 607 aa, unidentified
MEAPAAGLFLLLLLGTWAPAPGSASSEAPPLINEDVKRTVDLSSHLAKVTAEVVLAHLGGGSTSRATSFLLALEPELEARLAHLGVQVKGEDEEENNLEVRETKIKGKSGRFFTVKLPVALDPGAKISVIVETVYTHVLHPYPTQITQSEKQFVVFEGNHYFYSPYPTKTQTMRVKLASRNVESYTKLGNPTRSEDLLDYGPFRDVPAYSQDTFKVHYENNSPFLTITSMTRVIEVSHWGNIAVEENVDLKHTGAVLKGPFSRYDYQRQPDSGISSIRSFKTILPAAAQDVYYRDEIGNVSTSHLLILDDSVEMEIRPRFPLFGGWKTHYIVGYNLPSYEYLYNLGDQYALKMRFVDHVFDEQVIDSLTVKIILPEGAKNIEIDSPYEISRAPDELHYTYLDTFGRPVIVAYKKNLVEQHIQDIVVHYTFNKVLMLQEPLLVVAAFYILFFTVIIYVRLDFSITKDPAAEARMKVACITEQVLTLVNKRIGLYRHFDETVNRYKQSRDISTLNSGKKSLETEHKALTSEIALLQSRLKTEGSDLCDRVSEMQKLDAQVKELVLKSAVEAERLVAGKLKKDTYIENEKLISGKRQELVTKIDHILDAL

SEQ ID NO: 3778 - protein, 631 aa, unidentified
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSVASAAAVLSHNRYHVPVVVVPEGSASDTHEQAILRLQVTNVLSQPLTQATVKLEHAKSVASRATVLQKTSFTPVGDVFELNFMNVKFSSGYYDFLVEVEGDNRYIANTVELRVKISTEVGITNVDLSTVDKDQSIAPKTTRVTYPAKAKGTFIADSHQNFALFFQLVDVNTGAELTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQHLFREPEKRPPTVVSNTFTALILSPLLLLFALWIRIGANVSNFTFAPSTIIFHLGHAAMLGLMYVYWTQLNMFQTLKYLAILGSVTFLAGNRMLAQQAVKRTAH

SEQ ID NO: 3779 - protein, 109 aa, unidentified
MNPALGNQTDVAGLFLANSSEALERAVRCCTQASVVTDDGFAEGGPDERSLYIMRVVQIAVMCVLSLTVVFGIFFLGCNLLIKSEGMINFLVKDRRPSKEVEAVVVGPY

SEQ ID NO: 3780 - protein, 120 aa, unidentified
MNATFLNHSGLEEVDGVGGGAGAALGNRTHGLGTWLGCCPGGAPLAASDGVPAGLAPDERSLWVSRVAQIAVLCVLSLTVVFGVFFLGCNLLIKSESMINFLVQERRPSKDVGAAILGLY

SEQ ID NO: 3781 - protein, 130 aa, unidentified [sequence omitted]

SEQ ID NO: 3782 - protein, 1335 aa, unidentified
MESEMLQSPLLGLGEEDEADLTDWNLPLAFMKKRHCEKIEGSKSLAQSWRMKDRMKTVSVALVLCLNVGVDPPDVVKTTPCARLECWIDPLSMGPQKALETIGANLQKQYENWQPRARYKQSLDPTVDEVKKLCTSLRRNAKEERVLFHYNGHGVPRPTVNGEVWVFNKNYTQYIPLSIYDLQTWMGSPSIFVYDCSNAGLIVKSFKQFALQREQELEVAAINPNHPLAQMPLPPSMKNCIQLAACEATELLPMIPDLPADLFTSCLTTPIKIALRWFCMQKCVSLVPGVTLDLIEKIPGRLNDRRTPLGELNWIFTAITDTIAWNVLPRDLFQKLFRQDLLVASLFRNFLLAERIMRSYNCTPVSSPRLPPTYMHAMWQAWDLAVDICLSQLPTIIEEGTAFRHSPFFAEQLTAFQVWLTMGVENRNPPEQLPIVLQVLLSQVHRLRALDLLGRFLDLGPWAVSLALSVGIFPYVLKLLQSSARELRPLLVFIWAKILAVDSSCQADLVKDNGHKYFLSVLADPYMPAEHRTMTAFILAVIVNSYHTGQEACLQGNLIAICLEQLNDPHPLLRQWVAICLGRIWQNFDSARWCGVRDSAHEKLYSLLSDPIPEVRCAAVFALGTFVGNSAERTDHSTTIDHNVAMMLAQLVSDGSPMVRKELVVALSHLVVQYESNFCTVALQFIEEEKNYALPSPATTEGGSLTPVRDSPCTPRLRSVSSYGNIRAVATARSLNKSLQNLSLTEESGGAVAFSPGNLSTSSSASSTLGSPENEEHILSFETIDKMRRASSYSSLNSLIGVSFNSVYTQIWRVLLHLAADPYPEVSDVAMKVLNSIAYKATVNARPQRVLDTSSLTQSAPASPTNKGVHIHQAGGSPPASSTSSSSLTNDVAKQPVSRDLPSGRPGTTGPAGAQYTPHSHQFPRTRKMFDKGPEQTADDADDAAGHKSFISATVQTGFCDWSARYFAQPVMKIPEEHDLESQIRKEREWRFLRNSRVRRQAQQVIQKGITRLDDQIFLNRNPGVPSVVKFHPFTPCIAVADKDSICFWDWEKGEKLDYFHNGNPRYTRVTAMEYLNGQDCSLLLTATDDGAIRVWKNFADLEKNPEMVTAWQGLSDMLPTTRGAGMVVDWEQETGLLMSSGDVRIVRIWDTDREMKVQDIPTGADSCVTSLSCDSHRSLIVAGLGDGSIRVYDRRMALSECRVMTYREHTAWVVKASLQKRPDGHIVSVSVNGDVRIFDPRMPESVNVLQIVKGLTALDIHPQADLIACGSVNQFTAIYNSSGELINNIKYYDGFMGQRVGAISCLAFHPHWPHLAVGSNDYYISVYSVEKRVR

SEQ ID NO: 3783 - protein, 1410 aa, unidentified
MDIYDTQTLGVVVFGGFMVVSAIGIFLVSTFSMKETSYEEALANQRKEMAKTHHQKVEKKKKEKTVEKKGKTKKKEEKPNGKIPDHDPAPNVTVLLREPVRAPAVAVAPTPVQPPIIVAPVATVPAMPQEKLASSPKDKKKKEKKVAKVEPAVSSVVNSIQVLTSKAAILETAPKEVPMVVVPPVGAKGNTPATGTTQGKKAEGTQNQSKKAEGAPNQGRKAEGTPNQGKKTEGTPNQGKKAEGTPNQGKKAEGTPNQGKKAEGAQNQGKKVDTTPNQGKKVEGAPTQGRKAEGAQNQAKKVEGAQNQGKKAEGAQNQGKKGEGAQNQGKKAEGAQNQGKKAEGAQNQGKKAEGAQNQGKKAEGAQNQGKKAEGAQNQGKKAEGAQNQGKKVEGAQNQGKKAEGAQNQGKKAEGAQNQGKKAEGAQNQGKKAEGAQNQGKKAEGAQNQGKKAEGAQNQGKKAEGAQNQGKKVEGAQNQGKKAEGAQNQGKKAEGAQNQGKKAEGAQNQGQKGEGAQNQGKKTEGAQGKKAERSPNQGKKGEGAPIQGKKADSVANQGTKVEGITNQGKKAEGSPSEGKKAEGSPNQGKKADAAANQGKKTESASVQGRNTDVAQSPEAPKQEAPAKKKSGSKKKGEPGPPDADGPLYLPYKTLVSTVGSMVFNEGEAQRLIEILSEKAGIIQDTWHKATQKGDPVAILKRQLEEKEKLLATEQEDAAVAKSKLRELNKEMAAEKAKAAAGEAKVKKQLVAREQEITAVQARMQASYREHVKEVQQLQGKIRTLQEQLENGPNTQLARLQQENSILRDALNQATSQVESKQNAELAKLRQELSKVSKELVEKSEAVRQDEQQRKALEAKAAAFEKQVLQLQASHRESEEALQKRLDEVSRELCHTQSSHASLRADAEKAQEQQQQMAELHSKLQSSEAEVRSKCEELSGLHGQLQEARAENSQLTERIRSIEALLEAGQARDAQDVQASQAEADQQQTRLKELESQVSGLEKEAIELREAVEQQKVKNNDLREKNWKAMEALATAEQACKEKLLSLTQAKEESEKQLCLIEAQTMEALLALLPELSVLAQQNYTEWLQDLKEKGPTLLKHPPAPAEPSSDLASKLREAEETQSTLQAECDQYRSILAETEGMLRDLQKSVEEEEQVWRAKVGAAEEELQKSRVTVKHLEEIVEKLKGELESSDQVREHTSHLEAELEKHMAAASAECQNYAKEVAGLRQLLLESQSQLDAAKSEAQKQSDELALVRQQLSEMKSHVEDGDIAGAPASSPEAPPAEQDPVQLKTQLEWTEAILEDEQTQRQKLTAEFEEAQTSACRLQEELEKLRTAGPLESSETEEASQLKERLEKEKKLTSDLGRAATRLQELLKTTQEQLAREKDTVKKLQEQLEKAEDGSSSKEGTSV

SEQ ID NO: 3784 - protein, 337 aa, unidentified
MLRNNLGNSSDSKNEDGSVFSQTEHNIVATYLIMAGMISIISNIIVLGIFIKYKELRTPTNAIIINLAVTDIGVSSIGYPMSAASDLYGSWKFGYAGCQVYAGLNIFFGMASIGLLTVVAVDRYLTICLPDVGRRMTTNTYIGLILGAWINGLFWALMPIIGWASYAPDPTGATCTINWRKNDRSFVSYTMTVIAINFIVPLTVMFYCYYHVTLSIKHHTTSDCTESLNRDWSDQIDVTKMSVIMICMFLVAWSPYSIVCLWASFGDPKKIPPPMAIIAPLFAKSSTFYNPCIYVVANKKFRRAMLAMFKCQTHQTMPVTSILPMDVSQNPLASGRI

SEQ ID NO: 3785 - protein, 389 aa, unidentified
MLSLRVPLAPITDPQQLQLSPLKGLSLVDKENTPPALSGTRVLASKTARRIFQEPTEPKTKAAAPGVEDEPLLRENPRRFVIFPIEYHDIWQMYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGDKEATYGERVVAFAAVEGIFFSGSFASIFWLKKRGLMPGLTFSNELISRDEGLHCDFACLMFKHLVHKPSEERVREIIINAVRIEQEFLTEALPVKLIGMNCTLMKQYIEFVADRLMLELGFSKVFRVENPFDFMENISLEGKTNFFEKRVGEYQRMGVMSSPTENSFTLDADF

SEQ ID NO: 3786 - protein, 351 aa, unidentified
MGDPERPEAAGLDQDERSSSDTNESEIKSNEEPLLRKSSRRFVIFPIQYPDIWKMYKQAQASFWTAEEVDLSKDLPHWNKLKADEKYFISHILAFFAASDGIVNENLVERFSQEVQVPEARCFYGFQILIENVHSEMYSLLIDTYIRDPKKREFLFNAIETMPYVKKKADWALRWIADRKSTFGERVVAFAAVEGVFFSGSFAAIFWLKKRGLMPGLTFSNELISRDEGLHCDFACLMFQYLVNKPSEERVREIIVDAVKIEQEFLTEALPVGLIGMNCILMKQYIEFVADRLLVELGFSKVFQAENPFDFMENISLEGKTNFFEKRVSEYQRFAVMAETTDNVFTLDADF

SEQ ID NO: 3787 - protein, 475 aa, unidentified
MPGISARGLSHEGRKQLAVNLTRVLALYRSILDAYIIEFFTDNLWDTLPCSWQEALDGLKPPQLATMLLGMPGEGEVVRYRSVWPLTLLALKSTACALAFTRMPGFQTPSEFLENPSQSSRLTAPFRKHVRPKKQHEIRRLGELVKKLSDFTGCTQVVDVGSGQGHLSRFMALGLGLMVKSIEGDQRLVERAQRLDQELLQALEKEEKRNPQVVQTSPRHSPHHVVRWVDPTALCEELLLPLENPCQGRARLLLTGLHACGDLSVALLRHFSCCPEVVALASVGCCYMKLSDPGGYPLSQWVAGLPGYELPYRLREGACHALEEYAERLQKAGPGLRTHCYRAALETVIRRARPELRRPGVQGIPRVHELKIEEYVQRGLQRVGLDPQLPLNLAALQAHVAQENRVVAFFSLALLLAPLVETLILLDRLLYLQEQGFHAELLPIFSPELSPRNLVLVATKMPLGQALSVLETEDS

SEQ ID NO: 3788 - protein, 1297 aa, unidentified
MGRSGKLPSGVSAKLKRWKKGHSSDSNPAICRHRQAARSRFFSRPSGRSDLTVDAVKLHNELQSGSLRLGKSEAPETPMEEEAELVLTEKSSGTFLSGLSDCTNVTFSKVQRFWESNSAAHKEICAVLAAVTEVIRSQGGKETETEYFAALMTTMEAVESPESLAAVAYLLNLVLKRVPSPVLIKKFSDTSKAFMDIMSAQASSGSTSVLRWVLSCLATLLRKQDLEAWGYPVTLQVYHGLLSFTVHPKPKIRKAAQHGVCSVLKGSEFMFEKAPAHHPAAISTAKFCIQEIEKSGGSKEATTTLHMLTLLKDLLPCFPEGLVKSCSETLLRVMTLSHVLVTACAMQAFHSLFHARPGLSTLSAELNAQIITALYDYVPSENDLQPLLAWLKVMEKAHINLVRLQWDLGLGHLPRFFGTAVTCLLSPHSQVLTAATQSLKEILKECVAPHMADIGSVTSSASGPAQSVAKMFRAVEEGLTYKFHAAWSSVLQLLCVFFEACGRQAHPVMRKCLQSLCDLRLSPHFPHTAALDQAVGAAVTSMGPEVVLQAVPLEIDGSEETLDFPRSWLLPVIRDHVQETRLGFFTTYFLPLANTLKSKAMDLAQAGSTVESKIYDTLQWQMWTLLPGFCTRPTDVAISFKGLARTLGMAISERPDLRVTVCQALRTLITKGCQAEADRAEVSRFAKNFLPILFNLYGQPVAAGDTPAPRRAVLETIRTYLTITDTQLVNSLLEKASEKVLDPASSDFTRLSVLDLVVALAPCADEAAISKLYSTIRPYLESKAHGVQKKAYRVLEEVCASPQGPGALFVQSHLEDLKKTLLDSLRSTSSPAKRPRLKCLLHIVRKLSAEHKEFITALIPEVILCTKEVSVGARKNAFALLVEMGHAFLRFGSNQEEALQCYLVLIYPGLVGAVTMVSCSILALTHLLFEFKGLMGTSTVEQLLENVCLLLASRTRDVVKSALGFIKVAVTVMDVAHLAKHVQLVMEAIGKLSDDMRRHFRMKLRNLFTKFIRKFGFELVKRLLPEEYHRVLVNIRKAEARAKRHRALSQAAVEEEEEEEEEEEPAQGKGDSIEEILADSEDEEDNEEEERSRGKEQRKLARQRSRAWLKEGGGDEPLNFLDPKVAQRVLATQPGPGRGRKKDHGFKVSADGRLIIREEADGNKMEEEEGAKGEDEEMADPMEDVIIRNKKHQKLKHQKEAEEEELEIPPQYQAGGSGIHRPVAKKAMPGAEYKAKKAKGDVKKKGRPDPYAYIPLNRSKLNRRKKMKLQGQFKGLVKAARRGSQVGHKNRRKDRRP

SEQ ID NO: 3789 - protein, 1358 aa, unidentified
MIEPSEDSFETMMEHKNPSSKQMESSEGSSNTTEATSGSGVRGEAGPASGPAQEKKEPPSGPLQEMEELPTDLLQDMEEPSSGPRKEIEDPPNDLLQDLEESCNGSHQARGDPLSGASDRMKEASVNPSGAREEQEAHTDLKESGREETPQEQNQTEHSTAELMAMVRSIISLYFRMQDLKEQQRVAEEILIKGINAGQLPAPKHFSGDRREFHEFIVLCQLTLQSYPRMFYNDRLRVGYVINHLSGLALEWAKALLQENSPLIGDFPAFLEAMSEVFEYRQALRVAEEAMFTIRQGGRSATEYIDEFQSLVPILGWPDEVLQAHLCQGLNEEIRHYLFRVPQPDSLDSLIVLILQIEEKLAERRAMLRLPPEARPRNLTWIDSPAPERWMVSSWLPSEVHPDINRAHLFLLLMVRVNPYHSVAVQALVDSGADGNFMDEKFAQEHYVELYEKPYPQPVQSVDGSLIGNEPVWLYTEPLVCIHQNHQESIEFDIVPSPNFSVVLGIRWLRVHAPEVDWIKGRCTFHSPYCLKNCFRPPPPCIALERHGMSLLPGLPHPYSDLADVFNPKEADDETSDQPSSDGSDDLSESEPSELQQAGDSDHSETFYECPSTAPWEPVGARMQERARLQEEYWDLQDMLTNRQDYIQMIPELFDQLHGAEWFTKLELRGTIVEESVNGHRTEDVWKAAFGLELEEMKSYQPFALSPDPIIPQNVIHFILKDMLGFFVLSYGQEVLIYSMSQEEHLHHVRQVLVRFRHHNVYCSLDKSQFHRQTVEFLGFVVTPKGVKLNKNVMTIITGYPTPGSKLSLRNFIEFVFPYRHFVERFSIIAEPLVRQLLSSYQFYWGVEEQEAFECLKRAFRKAPLLHHPKPQNPFYLETGVTGTALHASLIQIDDQTGKRACCAFYSRNISPIEVEYSQAEMKILPIRAAFMVWCRYLENTEEPIMILLNTEDLASLNNDRLTVLLPGHWVFFFSHFNFDVMELPEQDGGRALPPVRNLRWRRAFQRNTAARQTLLLASRGFPRDPSTESGEEENEEQDELNEQILRQELLAMIPIDQILNSFLAHFSMAQIRAVILHFFRGLLYWKNTLALAAILVLLRVRQCLSLRPAPAMRVARPQPQRSLRLILDSSLIAGSSITTAITQLLTQMPALVGANTIPAQELAELFLGPGRWQRNALHSQAHRGLQFTPGFWLTLCEFFGVRVTPQEGHLPALRQNRYLELHVVGDEDVVLREALQDDLQRYRQCGLHDGLQDTSQDKQDNDVQEAPPSHTAATHPPRPRHLMDPQVLEFLGSRLLHIHSADGQLHLLSREQAARALSQFLTLIYRRALPIPAWESQPREQARLEELPDEDEDANLD

SEQ ID NO: 3790 - protein, 776 aa, unidentified
MAAPGDPQDELLPLAGPGSQWLRHRGEGENEAVTPKGATPAPQAGEPSPGLGARAREAASREAGSGPARQSPVAMETASTGVAGVSSAMDHTFSTTSKDGEGSCYTSLISDICYPPQEDSTYFTGILQKENGHVTISESPEELGTPGPSLPDVPGIESRGLFSSDSGIEMTPAESTEVNKILADPLDQMKAEAYKYIDITRPEEVKHQEQHHPELEDKDLDFKNKDTDISIKPEGVREPDKPAPVEGKIIKDHLLEESTFAPYIDDLSEEQRRAPQITTPVKITLTEIEPSVETTTQEKTPEKQDICLKPSPDTVPTVTVSEPEDDSPGSITPPSSGTEPSAAESQGKGSISEDELITAIKEAKGLSYETAENPRPVGQLADRPEVKARSGPPTIPSPLDHEASSAESGDSEIELVSEDPMAAEDALPSGYVSFGHVGGPPPSPASPSIQYSILREEREAELDSELIIESCDASSASEESPKREQDSPPMKPSALDAIREETGVRAEERAPSRRGLAEPGSFLDYPSTEPQPGPELPPGDGALEPETPMLPRKPEEDSSSNQSPAATKGPGPLGPGAPPPLLFLNKQKAIDLLYWRDIKQTGIVFGSFLLLLFSLTQFSVVSVVAYLALAALSATISFRIYKSVLQAVQKTDEGHPFKAYLELEITLSQEQIQKYTDCLQFYVNSTLKELRRLFLVQDLVDSLKFAVLMWLLTYVGALFNGLTLLLMAVVSMFTLPVVYVKHQAQIDQYLGLVRTHINAVVAKIQAKIPGAKRHAE

SEQ ID NO: 3791 - protein, 545 aa, unidentified
MGQVLPVFAHCKEAPSTASSTPDSTEGGNDDSDFRELHTAREFSEEDEEETTSQDWGTPRELTFSYIAFDGVVGSGGRRDSTARRPRPQGRSVSEPRDQHPQPSLGDSLESIPSLSQSPEPGRRGDPDTAPPSERPLEDLRLRLDHLGWVARGTGSGEDSSTSSSTPLEDEEPQEPNRLETGEAGEELDLRLRLAQPSSPEVLTPQLSPGSGTPQAGTPSPSRSRDSNSGPEEPLLEEEEKQWGPLEREPVRGQCLDSTDQLEFTVEPRLLGTAMEWLKTSLLLAVYKTVPILELSPPLWTAIGWVQRGPTPPTPVLRVLLKWAKSPRSSGVPSLSLGADMGSKVADLLYWKDTRTSGVVFTGLMVSLLCLLHFSIVSVAAHLALLLLCGTISLRVYRKVLQAVHRGDGANPFQAYLDVDLTLTREQTERLSHQITSRVVSAATQLRHFFLVEDLVDSLKLALLFYILTFVGAIFNGLTLLILGVIGLFTIPLLYRQHQAQIDQYVGLVTNQLSHIKAKIRAKIPGTGALASAAAAVSGSKAKAE

SEQ ID NO: 3792 - protein, 1032 aa, unidentified
MAEPSAATQSHSISSSSFGAEPSAPGGGGSPGACPALGTKSCSSSCADSFVSSSSSQPVSLFSTSQEGLSSLCSDEPSSEIMTSSFLSSSEIHNTGLTILHGEKSHVLGSQPILAKEGKDHLDLLDMKKMEKPQGTSNNVSDSSVSLAAGVHCDRPSIPASFPEHPAFLSKKIGQVEEQIDKETKNPNGVSSREAKTALDADDRFTLLTAQKPPTEYSKVEGIYTYSLSPSKVSGDDVIEKDSPESPFEVIIDKAAFDKEFKDSYKESTDDFGSWSVHTDKESSEDISETNDKLFPLRNKEAGRYPMSALLSRQFSHTNAALEEVSRCVNDMHNFTNEILTWDLVPQVKQQTDKSSDCITKTTGLDMSEYNSEIPVVNLKTSTHQKTPVCSIDGSTPITKSTGDWAEASLQQENAITGKPVPDSLNSTKEFSIKGVQGNMQKQDDTLAELPGSPPEKCDSLGSGVATVKVVLPDDHLKDEMDWQSSALGEITEADSSGESDDTVIEDITADTSFENNKIQAEKPVSIPSAVVKTGEREIKEIPSCEREEKTSKNFEELVSDSELHQDQPDILGRSPASEAACSKVPDTNVSLEDVSEVAPEKPITTENPKLPSTVSPNVFNETEFSLNVTTSAYLESLHGKNVKHIDDSSPEDLIAAFTETRDKGIVDSERNAFKAISEKMTDFKTTPPVEVLHENESGGSEIKDIGSKYSEQSKETNGSEPLGVFPTQGTPVASLDLEQEQLTIKALKELGERQVEKSTSAQRDAELPSEEVLKQTFTFAPESWPQRSYDILERNVKNGSDLGISQKPITIRETTRVDAVSSLSKTELVKKHVLARLLTDFSVHDLIFWRDVKKTGFVFGTTLIMLLSLAAFSVISVVSYLILALLSVTISFRIYKSVIQAVQKSEEGHPFKAYLDVDITLSSEAFHNYMNAAMVHINRALKLIIRLFLVEDLVDSLKLAVFMWLMTYVGAVFNGITLLILAELLIFSVPIVYEKYKTQIDHYVGIARDQTKSIVEKIQAKLPGIAKKKAE

SEQ ID NO: 3793 - protein, 1192 aa, unidentified
MEDLDQSPLVSSSDSPPRPQPAFKYQFVREPEDEEEEEEEEEEDEDEDLEELEVLERKPAAGLSAAPVPTAPAAGAPLMDFGNDFVPPAPRGPLPAAPPVAPERQPSWDPSPVSSTVPAPSPLSAAAVSPSKLPEDDEPPARPPPPPPASVSPQAEPVWTPPAPAPAAPPSTPAAPKRRGSSGSVDETLFALPAASEPVIRSSAENMDLKEQPGNTISAGQEDFPSVLLETAASLPSLSPLSAASFKEHEYLGNLSTVLPTEGTLQENVSEASKEVSEKAKTLLIDRDLTEFSELEYSEMGSSFSVSPKAESAVIVANPREEIIVKNKDEEEKLVSNNILHNQQELPTALTKLVKEDEVVSSEKAKDSFNEKRVAVEAPMREEYADFKPFERVWEVKDSKEDSDMLAAGGKIESNLESKVDKKCFADSLEQTNHEKDSESSNDDTSFPSTPEGIKDRSGAYITCAPFNPAATESIATNIFPLLGDPTSENKTDEKKIEEKKAQIVTEKNTSTKTSNPFLVAAQDSETDYVTTDNLTKVTEEVVANMPEGLTPDLVQEACESELNEVTGTKIAYETKMDLVQTSEVMQESLYPAAQLCPSFEESEATPSPVLPDIVMEAPLNSAVPSAGASVIQPSSSPLEASSVNYESIKHEPENPPPYEEAMSVSLKKVSGIKEEIKEPENINAALQETEAPYISIACDLIKETKLSAEPAPDFSDYSEMAKVEQPVPDHSELVEDSSPDSEPVDLFSDDSIPDVPQKQDETVMLVKESLTETSFESMIEYENKEKLSALPPEGGKPYLESFKLSLDNTKDTLLPDEVSTLSKKEKIPLQMEELSTAVYSNDDLFISKEAQIRETETFSDSSPIEIIDEFPTLISSKTDSFSKLAREYTDLEVSHKSEIANAPDGAGSLPCTELPHDLSLKNIQPKVEEKISFSDDFSKNGSATSKVLLLPPDVSALATQAEIESIVKPKVLVKEAEKKLPSDTEKEDRSPSAIFSAELSKTSVVDLLYWRDIKKTGVVFGASLFLLLSLTVFSIVSVTAYIALALLSVTISFRIYKGVIQAIQKSDEGHPFRAYLESEVAISEELVQKYSNSALGHVNCTIKELRRLFLVDDLVDSLKFAVLMWVFTYVGALFNGLTLLILALISLFSVPVIYERHQAQIDHYLGLANKNVKDAMAKIQAKIPGLKRKAE

SEQ ID NO: 3794 - protein, 473 aa, unidentified
MKRASAGGSRLLAWVLWLQAWQVAAPCPGACVCYNEPKVTTSCPQQGLQAVPVGIPAASQRIFLHGNRISHVPAASFRACRNLTILWLHSNVLARIDAAAFTGLALLEQLDLSDNAQLRSVDPATFHGLGRLHTLHLDRCGLQELGPGLFRGLAALQYLYLQDNALQALPDDTFRDLGNLTHLFLHGNRISSVPERAFRGLHSLDRLLLHQNRVAHVHPHAFRDLGRLMTLYLFANNLSALPTEALAPLRALQYLRLNDNPWVCDCRARPLWAWLQKFRGSSSEVPCSLPQRLAGRDLKRLAANDLQGCAVATGPYHPIWTGRATDEEPLGLPKCCQPDAADKASVLEPGRPASAGNALKGRVPPGDSPPGNGSGPRHINDSPFGTLPGSAEPPLTAVRPEGSEPPGFPTSGPRRRPGCSRKNRTRSHCRLGQAGSGGGGTGDSEGSGALPSLTCSLTPLGLALVLWTVLGPC

SEQ ID NO: 3795 - protein, 263 aa, unidentified
MRIFRPWRLRCPALHLPSLSVFSLRWKLPSLTTDETMCKSVTTDEWKKVFYEKMEEAKPADSWDLIIDPNLKHNVLSPGWKQYLELHASGRFHCSWCWHTWQSPYVVILFHMFLDRAQRAGSVRMRVFKQLCYECGTARLDESSMLEENIEGLVDNLITSLREQCYGERGGQYRIHVASRQDNRRHRGEFCEACQEGIVHWKPSEKLLEEEATTYTFSRAPSPTKSQDQTGSGWNFCSIPWCLFWATVLLLIIYLQFSFRSSV

SEQ ID NO: 3796 - protein, 225 aa, unidentified
MCTSLTTCEWKKVFYEKMEVAKPADSWELIIDPNLKPSELAPGWKQYLEQHASGRFHCSWCWHTWQSAHVVILFHMFLDRAQRAGSVRMRVFKQLCYECGTARLDESSMLEENIEGLVDNLITSLREQCYEEDGGQYRIHVASRPDSGPHRAEFCEACQEGIVHWKPSEKLLEEEVTTYTSEASKPRAQAGSGYNFLSLRWCLFWASLCLLVVYLQFSFLSPAFF

SEQ ID NO: 3797 - protein, 232 aa, unidentified
MAGDTEVWKQMFQELMREVKPWHRWTLRPDKGLLPNVLKPGWMQYQQWTFARFQCSSCSRNWASAQVLVLFHMNWSEEKSRGQVKMRVFTQRCKKCPQPLFEDPEFTQENISRILKNLVFRILKKCYRGRFQLIEEVPMIKDISLEGPHNSDNCEACLQGFCAGPIQVTSLPPSQTPRVHSIYKVEEVVKPWASGENVYSYACQNHICRNLSIFCCCVILIVIVVIVVKTAI

SEQ ID NO: 3798 - protein, 246 aa, unidentified
MVVDFWTWEQTFQELIQEAKPRATWTLKLDGNLQLDCLAQGWKQYQQRAFGWFRCSSCQRSWASAQVQILCHTYWEHWTSQGQVRMRLFGQRCQKCSWSQYEMPEFSSDSTMRILSNLVQHILKKYYGNGTRKSPEMPVILEVSLEGSHDTANCEACTLGICGQGLKSCMTKPSKSLLPHLKTGNSSPGIGAVYLANQAKNQSAEAKEAKGSGYEKLGPSRDPDPLNICVFILLLVFIVVKCFTSE

SEQ ID NO: 3799 - protein, 572 aa, unidentified
MDRAGADMWASTFTLAMAERKPQDVWVLLPEHSLVPGCLDGGGVQYLLVGLSRLQCGHCPGTWDSAHVHVLFHLWWDRASHRGLVKMRIWGQRCRLCPAPGDCQVRPPGEQPFLSRLVLHILQDCYGDGPGPARHPREAYEGCCEACELGVCFLQKAPDPAWSANATKGNFPATAWGGTGTVSRGKPLSTPGDDLGKGGVVIAIPFSLVGTSNDQVPIAEGPAPPAGASLPVTGSCEALVIGQGSIFLSGDSVAMPGGKGFPVAIGDPLFHGPGLLGSSIQTFELKGFLFKGRGSLCSPVGVAQGWGPISLNNGLVPVGKHTPTVFYCVGLSASGEGSLTFPSSLTSIFTNTLSEPTDGPVATKEASITFPFIFTDVKDAVAEVAEGNGKEGGGQGLVPVGHDALPETNAGGLPSQVKGSLALPFPADVQGKDAFTDITEGKEKEGGLVTAGHDAPLEANAEGPITVSEGCITIPFAVFDVIKRKGGGHVAYGPQGNGCFSQGYYQKRQLRSRFHKARCGCRREEDERPGRACRRPHAEPYEDFWIWVSMTVCVFWLMCMCRLNPGIYPQQV

SEQ ID NO: 3800 - protein, 606 aa, unidentified
MATKDPTAVERANLLNMAKLSIKGLIESALSFGRTLDSDYPPLQQFFVVMEHCLKHGLKVRKSFLSYNKTIWGPLELVEKLYPEAEEIGASVRDLPGLKTPLGRARAWLRLALMQKKMADYLRCLIIQRDLLSEFYEYHALMMEEEGAVIVGLLVGLNVIDANLCVKGEDLDSQVGVIDFSMYLKNEEDIGNKERNVQIAAILDQKNYVEELNRQLNSTVSSLHSRVDSLEKSNTKLIEELAIAKNNIIKLQEENHQLRSENKLILMKTQQHLEVTKVDVETELQTYKHSRQGLDEMYNEARRQLRDESQLRQDVENELAVQVSMKHEIELAMKLLEKDIHEKQDTLIGLRQQLEEVKAINIEMYQKLQGSEDGLKEKNEIIARLEEKTNKITAAMRQLEQRLQQAEKAQMEAEDEDEKYLQECLSKSDSLQKQISQKEKQLVQLETDLKIEKEWRQTLQEDLQKEKDALSHLRNETQQIISLKKEFLNLQDENQQLKKIYHEQEQALQELGNKLSESKLKIEDIKEANKALQGLVWLKDKEATHCKLCEKEFSLSKRKHHCRNCGEIFCNACSDNELPLPSSPKPVRVCDSCHALLIQRCSSNLP

SEQ ID NO: 3801 - protein, 757 aa, unidentified
MTSGSVFFYILIFGKYFSHGGGQDVKCSLGYFPCGNITKCLPQLLHCNGVDDCGNQADEDNCGDNNGWSLQFDKYFASYYKMTSQYPFEAETPECLVGSVPVQCLCQGLELDCDETNLRAVPSVSSNVTAMSLQWNLIRKLPPDCFKNYHDLQKLYLQNNKITSISIYAFRGLNSLTKLYLSHNRITFLKPGVFEDLHRLEWLIIEDNHLSRISPPTFYGLNSLILLVLMNNVLTRLPDKPLCQHMPRLHWLDLEGNHIHNLRNLTFISCSNLTVLVMRKNKINHLNENTFAPLQKLDELDLGSNKIENLPPLIFKDLKELSQLNLSYNPIQKIQANQFDYLVKLKSLSLEGIEISNIQQRMFRPLMNLSHIYFKKFQYCGYAPHVRSCKPNTDGISSLENLLASIIQRVFVWVVSAVTCFGNIFVICMRPYIRSENKLYAMSIISLCCADCLMGIYLFVIGGFDLKFRGEYNKHAQLWMESTHCQLVGSLAILSTEVSVLLLTFLTLEKYICIVYPFRCVRPGKCRTITVLILIWITGFIVAFIPLSNKEFFKNYYGTNGVCFPLHSEDTESIGAQIYSVAIFLGINLAAFIIIVFSYGSMFYSVHQSAITATEIRNQVKKEMILAKRFFFIVFTDALCWIPIFVVKFLSLLQVEIPGTITSWVVIFILPINSALNPILYTLTTRPFKEMIHRFWYNYRQRKSMDSKGQKTYAPSFIWVEMWPLQEMPPELMKPDLFTYPCEMSLISQSTRLNSYS

SEQ ID NO: 3802 - protein, 754 aa, unidentified
MIVFLVFKHLFSLRLITMFFLLHFIVLINVKDFALTQGSMITPSCQKGYFPCGNLTKCLPRAFHCDGKDDCGNGADEENCGDTSGWATIFGTVHGNANSVALTQECFLKQYPQCCDCKETELECVNGDLKSVPMISNNVTLLSLKKNKIHSLPDKVFIKYTKLKKIFLQHNCIRHISRKAFFGLCNLQILYLNHNCITTLRPGIFKDLHQLTWLILDDNPITRISQRLFTGLNSLFFLSMVNNYLEALPKQMCAQMPQLNWVDLEGNRIKYLTNSTFLSCDSLTVLFLPRNQIGFVPEKTFSSLKNLGELDLSSNTITELSPHLFKDLKLLQKLNLSSNPLMYLHKNQFESLKQLQSLDLERIEIPNINTRMFQPMKNLSHIYFKNFRYCSYAPHVRICMPLTDGISSFEDLLANNILRIFVWVIAFITCFGNLFVIGMRSFIKAENTTHAMSIKILCCADCLMGVYLFFVGIFDIKYRGQYQKYALLWMESVQCRLMGFLAMLSTEVSVLLLTYLTLEKFLVIVFPFSNIRPGKRQTSVILICIWMAGFLIAVIPFWNKDYFGNFYGKNGVCFPLYYDQTEDIGSKGYSLGIFLGVNLLAFLIIVFSYITMFCSIQKTALQTTEVRNCFGREVAVANRFFFIVFSDAICWIPVFVVKILSLFRVEIPDTMTSWIVIFFLPVNSALNPILYTLTTNFFKDKLKQLLHKHQRKSIFKIKKKSLSTSIVWIEDSSSLKLGVLNKITLGDSIMKPVS

SEQ ID NO: 3803 - protein, 469 aa, unidentified
MQMADAATIATMNKAAGGDKLAELFSLVPDLLEAANTSGNASLQLPDLWWELGLELPDGAPPGHPPGSGGAESADTEARVRILISVVYWVVCALGLAGNLLVLYLMKSMQGWRKSSINLFVTNLALTDFQFVLTLPFWAVENALDFKWPFGKAMCKIVSMVTSMNMYASVFFLTAMSVTRYHSVASALKSHRTRGHGRGDCCGRSLGDSCCFSAKALCVWIWALAALASLPSAIFSTTVKVMGEELCLVRFPDKLLGRDRQFWLGLYHSQKVLLGFVLPLGIIILCYLLLVRFIADRRAAGTKGGAAVAGGRPTGASARRLSKVTKSVTIVVLSFFLCWLPNQALTTWSILIKFNAVPFSQEYFLCQVYAFPVSVCLAHSNSCLNPVLYCLVRREFRKALKSLLWRIASPSITSMRPFTATTKPEHEDQGLQAPAPPHAAAEPDLLYYPPGVVVYSGGRYDLLPSSSAY

SEQ ID NO: 3804 - protein, 374 aa, unidentified
MPTLNTSASPPTFFWANASGGSVLSADDAPMPVKFLALRLMVALAYGLVGAIGLLGNLAVLWVLSNCARRAPGPPSDTFVFNLALADLGLALTLPFWAAESALDFHWPFGGALCKMVLTATVLNVYASIFLITALSVARYWVVAMAAGPGTHLSLFWARIATLAVWAAAALVTVPTAVFGVEGEVCGVRLCLLRFPSRYWLGAYQLQRVVLAFMVPLGVITTSYLLLLAFLQRRQRRRQDSRVVARSVRILVASFFLCWFPNHVVTLWGVLVKFDLVPWNSTFYTIQTYVFPVTTCLAHSNSCLNPVLYCLLRREPRQALAGTFRDLRLRLWPQGGGWVQQVALKQVGRRWVASNPRESRPSTLLTNLDRGTPG

SEQ ID NO: 3805 - protein, 607 aa, unidentified
MRGAARLGRPGRSCLPGARGLRAPPPPPLLLLLALLPLLPAPGAAAAPAPRPPELQSASAGPSVSLYLSEDEVRRLIGLDAELYYVRNDLISHYALSFSLLVPSETNFLHFTWHAKSKVEYKLGFQVDNVLAMDMPQVNISVQGEVPRTLSVFRVELSCTGKVDSEVMILMQLNLTVNSSKNFTVLNFKRRKMCYKKLEEVKTSALDKNTSRTIYDPVHAAPTTSTRVFYISVGVCCAVIFLVAIILAVLHLHSMKRIELDDSISASSSSQGLSQPSTQTTQYLRADTPNNATPITSYPTLRIEKNDLRSVTLLEAKGKVKDIAISRERITLKDVLQEGTFGRIFHGILIDEKDPNKEKQAFVKTVKDQASEIQVTMMLTESCKLRGLHHRNLLPITHVCIEEGEKPMVILPYMNWGNLKLFLRQCKLVEANNPQAISQQDLVHMAIQIACGMSYLARREVIHKDLAARNCVIDDTLQVKITDNALSRDLFPMDYHCLGDNENRPVRWMALESLVNNEFSSASDVWAFGVTLWELMTLGQTPYVDIDPFEMAAYLKDGYRIAQPINCPDELFAVMACCWALDPEERPKFQQLVQCLTEFHAALGAYV

SEQ ID NO: 3806 - protein, 5038 aa, unidentified
MGDAEGEDEVQFLRTDDEVVLQCSATVLKEQLKLCLAAEGFGNRLCFLEPTSNAQNVPPDLAICCFVLEQSLSVRALQEMLANTVEAGVESSQGGGHRTLLYGHAILLRHAHSRMYLSCLTTSRSMTDKLAFDVGLQEDATGEACWWTMHPASKQRSEGEKVRVGDDIILVSVSSERYLHLSTASGELQVDASFMQTLWNMNPICSRCEEGFVTGGHVLRLFHGHMDECLTISPADSDDQRRLVYYEGGAVCTHARSLWRLEPLRISWSGSHLRWGQPLRVRHVTTGQYLALTEDQGLVVVDASKAHTKATSFCFRISKEKLDVAPKRDVEGMGPPEIKYGESLCFVQHVASGLWLTYAAPDPKALRLGVLKKKAMLHQEGHMDDALSLTRCQQEESQAARMIHSTNGLYNQFIKSLDSFSGKPRGSGPPAGTALPIEGVILSLQDLIIYFEPPSEDLQHEEKQSKLRSLRNRQSLFQEEGMLSMVLNCIDRLNVYTTAAHFAEFAGEEAAESWKEIVNLLYELLASLIRGNRSNCALFSTNLDWLVSKLDRLEASSGILEVLYCVLIESPEVLNIIQENHIKSIISLLDKHGRNHKVLDVLCSLCVCNGVAVRSNQDLITENLLPGRELLLQTNLINYVTSIRPNIFVGRAEGTTQYSKWYFEVMVDEVTPFLTAQATHLRVGWALTEGYTPYPGAGEGWGGNGVGDDLYSYGFDGLHLWTGHVARPVTSPGQHLLAPEDVISCCLDLSVPSISFRINGCPVQGVFESFNLDGLFFPVVSFSAGVKVRFLLGGRHGEFKFLPPPGYAPCHEAVLPRERLHLEPIKEYRREGPRGPHLVGPSRCLSHTDFVPCPVDTVQIVLPPHLERIREKLAENIHELWALTRIEQGWTYGPVRDDNKRLHPCLVDFHSLPEPERNYNLQMSGETLKTLLALGCHVGMADEKAEDNLKKTKLPKTYMMSNGYKPAPLDLSHVRLTPAQTTLVDRLAENGHNVWARDRVGQGWSYSAVQDIPARRNPRLVPYRLLDEATKRSNRDSLCQAVRTLLGYGYNIEPPDQEPSQVENQSRCDRVRIFRAEKSYTVQSGRWYFEFEAVTTGEMRVGWARPELRPDVELGADELAYVFNGHRGQRWHLGSEPFGRPWQPGDVVGCMIDLTENTIIFTLNGEVLMSDSGSETAFREIEIGDGFLPVCSLGPGQVGHLNLGQDVSSLRFFAICGLQEGFEPFAINMQRPVTTWFSKGLPQFEPVPLEHPHYEVSRVDGTVDTPPCLRLTHRTWGSQNSLVEMLFLRLSLPVQFHQHFRCTAGATPLAPPGLQPPAEDEARAAEPDPDYENLRRSAGGWSEAENGKEGTAKEGAPGGTPQAGGEAQPARAENEKDATTEKNKKRGFLFKAKKVAMMTQPPATPTLPRLPHDVVPADNRDDPEIILNTTTYYYSVRVFAGQEPSCVWAGWVTPDYHQHDMSFDLSKVRVVTVTMGDEQGNVHSSLKCSNCYMVWGGDFVSPGQQGRISHTDLVIGCLVDLATGLMTFTANGKESNTFFQVEPNTKLFPAVFVLPTHQNVIQFELGKQKNIMPLSAAMFQSERKNPAPQCPPRLEMQMLMPVSWSRMPNHFLQVETRRAGERLGWAVQCQEPLTMMALHIPEENRCMDILELSERLDLQRFHSHTLRLYRAVCALGNNRVAHALCSHVDQAQLLHALEDAHLPGPLRAGYYDLLISIHLESACRSRRSMLSEYIVPLTPETRAITLFPPGRSTENGHPRHGLPGVGVTTSLRPPHHFSPPCFVAALPAAGAAEAPARLSPAIPLEALRDKALRMLGEAVRDGGQHARDPVGGSVEFQFVPVLKLVSTLLVMGIFGDEDVKQILKMIEPEVFTEEEEEEDEEEEGEEEDEEEKEEDEEETAQEKEDEEKEEEEAAEGEKEEGLEEGLLQMKLPESVKLQMCHLLEYFCDQELQHRVESLAAFAERYVDKLQANQRSRYGLLIKAFSMTAAETARRTREFRSPPQEQINMLLQFKDGTDEEDCPLPEEIRQDLLDFHQDLLAHCGIQLDGEEEEPEEETTLGSRLMSLLEKVRLVKKKEEKPEEERSAEESKPRSLQELVSHMVVRWAQEDFVQSPELVRAMFSLLHRQYDGLGELLRALPRAYTISPSSVEDTMSLLECLGQIRSLLIVQMGPQEENLMIQSIGNIMNNKVFYQHPNLMRALGMHETVMEVMVNVLGGGESKEIRFPKMVTSCCRFLCYFCRISRQNQRSMFDHLSYLLENSGIGLGMQGSTPLDVAAASVIDNNELALALQEQDLEKVVSYLAGCGLQSCPMLVAKGYPDIGWNPCGGERYLDFLRFAVFVNGESVEENANVVVRLLIRKPECFGPALRGEGGSGLLAAIEEAIRISEDPARDGPGIRRDRRREHFGEEPPEENRVHLGHAIMSFYAALIDLLGRCAPEMHLIQAGKGEALRIRAILRSLVPLEDLVGIISLPLQIPTLGKDGALVQPKMSASFVPDHKASMVLFLDRVYGIENQDFLLHVLDVGFLPDMRAAASLDTATFSTTEMALALNRYLCLAVLPLITKCAPLFAGTEHRAIMVDSMLHTVYRLSRGRSLTKAQRDVIEDCLMSLCRYIRPSMLQHLLRRLVFDVPILNEFAKMPLKLLTNHYERCWKYYCLPTGWANFGVTSEEELHLTRKLFWGIFDSLAHKKYDPELYRMAMPCLCAIAGALPPDYVDASYSSKAEKKATVDAEGNFDPRPVETLNVIIPEKLDSFINKFAEYTHEKWAFDKIQNNWSYGENIDEELKTHPMLRPYKTFSEKDKEIYRWPIKESLKAMIAWEWTIEKAREGEEEKTEKKKTRKISQSAQTYDPREGYNPQPPDLSAVTLSRELQAMAEQLAENYHNTWGRKKKQELEAKGGGTHPLLVPYDTLTAKEKARDREKAQELLKFLQMNGYAVTRGLKDMELDSSSIEKRFAFGFLQQLLRWMDISQEFIAHLEAVVSSGRVEKSPHEQEIKFFAKILLPLINQYFTNHCLYFLSTPAKVLGSGGHASNKEKEMITSLFCKLAALVRHRVSLFGTDAPAVVNCLHILARSLDARTVMKSGPEIVKAGLRSFFESASEDIEKMVENLRLGKVSQARTQVKGVGQNLTYTTVALLPVLTTLFQHIAQHQFGDDVILDDVQVSCYRTLCSIYSLGTTKNTYVEKLRPALGECLARLAAAMPVAFLEPQLNEYNACSVYTTKSPRERAILGLPNSVEEMCPDIPVLERLMADIGGLAESGARYTEMPHVIEITLPMLCSYLPRWWERGPEAPPSALPAGAPPPCTAVTSDHLNSLLGNILRIIVNNLGIDEASWMKRLAVFAQPIVSRARPELLQSHFIPTIGRLRKRAGKVVSEEEQLRLEAKAEAQEGELLVRDEFSVLCRDLYALYPLLIRYVDNNRAQWLTEPNPSAEELFRMVGEIFIYWSKSHNFKREEQNFVVQNEINNMSFLTADNKSKMAKAGDIQSGGSDQERTKKKRRGDRYSVQTSLIVATLKKMLPIGLNMCAPTDQDLITLAKTRYALKDTDEEVREFLHNNLHLQGKVEGSPSLRWQMALYRGVPGREEDADDPEKIVRRVQEVSAVLYYLDQTEHPYKSKKAVWHKLLSKQRRRAVVACFRMTPLYNLPTHRACNMFLESYKAAWILTEDHSFEDRMIDDLSKAGEQEEEEEEVEEKKPDPLHQLVLHFSRTALTEKSKLDEDYLYMAYADIMAKSCHLEEGGENGEAEEEVEVSFEEKQMEKQRLLYQQARLHTRGAAEMVLQMISACKGETGAMVSSTLKLGISILNGGNAEVQQKMLDYLKDKKEVGFFQSIQALMQTCSVLDLNAFERQNKAEGLGMVNEDGTVINRQNGEKVMADDEFTQDLFRFLQLLCEGHNNDFQNYLRTQTGNTTTINIIICTVDYLLRLQESISDFYWYYSGKDVIEEQGKRNFSKAMSVAKQVFNSLTEYIQGPCTGNQQSLAHSRLWDAVVGFLHVFAHMMMKLAQDSSQIELLKELLDLQKDMVVMLLSLLEGNVVNGMIARQMVDMLVESSSNVEMILKFFDMFLKLKDIVGSEAFQDYVTDPRGLISKKDFQKAMDSQKQFSGPEIQFLLSCSEADENEMINCEEFANRFQEPARDIGFNVAVLLTNLSEHVPHDPRLHNFLELAESILEYFRPYLGRIEIMGASRRIERIYFEISETNRAQWEMPQVKESKRQFIFDVVNEGGEAEKMELFVSFCEDTIFEMQIAAQISEPEGEPETDEDEGAGAAEAGAEGAEEGAAGLEGTAATAAAGATARVVAAAGRALRGLSYRSLRRRVRRLRRLTAREAATAVAALLWAAVTRAGAAGAGAAAGALGLLWGSLFGGGLVEGAKKVTVTELLAGMPDPTSDEVHGEQPAGPGGDADGEGASEGAGDAAEGAGDEEEAVHEAGPGGADGAVAVTDGGPFRPEGAGGLGDMGDTTPAEPPTPEGSPILKRKLGVDGVEEELPPEPEPEPEPELEPEKADAENGEKEEVPEPTPEPPKKQAPPSPPPKKEEAGGEFWGELEVQRVKFLNYLSRNFYTLRFLALFLAFAINFILLFYKVSDSPPGEDDMEGSAAGDVSGAGSGGSSGWGLGAGEEAEGDEDENMVYYFLEESTGYMEPALRCLSLLHTLVAFLCIIGYNCLKVPLVIFKREKELARKLEFDGLYITEQPEDDDVKGQWDRLVLNTPSFPSNYWDKFVKRKVLDKHGDIYGRERIAELLGMDLATLEITAHNERKPNPPPGLLTWLMSIDVKYQIWKFGVIFTDNSFLYLGWYMVMSLLGHYNNFFFAAHLLDIAMGVKTLRTILSSVTHNGKQLVMTVGLLAVVVYLYTVVAFNFFRKFYNKSEDEDEPDMKCDDMMTCYLFHMYVGVRAGGGIGDEIEDPAGDEYELYRVVFDITFFFFVIVILLAIIQGLIIDAFGELRDQQEQVKEDMETKCFICGIGSDYFDTTPHGFETHTLEEHNLANYMFFLMYLINKDETEHTGQESYVWKMYQERCWDFFPAGDCFRKQYEDQLS

SEQ ID NO: 3807 - protein, 4967 aa, unidentified
MADGGEGEDEIQFLRTDDEVVLQCTATIHKEQQKLCLAAEGFGNRLCFLESTSNSKNVPPDLSICTFVLEQSLSVRALQEMLANTVEKSEGQVDVEKWKFMMKTAQGGGHRTLLYGHAILLRHSYSGMYLCCLSTSRSSTDKLAFDVGLQEDTTGEACWWTIHPASKQRSEGEKVRVGDDLILVSVSSERYLHLSYGNGSLHVDAAFQQTLWSVAPISSGSEAAQGYLIGGDVLRLLHGHMDECLTVPSGEHGEEQRRTVHYEGGAVSVHARSLWRLETLRVAWSGSHIRWGQPFRLRHVTTGKYLSLMEDKNLLLMDKEKADVKSTAFTFRSSKEKLDVGVRKEVDGMGTSEIKYGDSVCYIQHVDTGLWLTYQSVDVKSVRMGSIQRKAIMHHEGHMDDGISLSRSQHEESRTARVIRSTVFLFNRFIRGLDALSKKAKASTVDLPIESVSLSLQDLIGYFHPPDEHLEHEDKQNRLRALKNRQNLFQEEGMINLVLECIDRLHVYSSAAHFADVAGREAGESWKSILNSLYELLAALIRGNRKNCAQFSGSLDWLISRLERLEASSGILEVLHCVLVESPEALNIIKEGHIKSIISLLDKHGRNHKVLDVLCSLCVCHGVAVRSNQHLICDNLLPGRDLLLQTRLVNHVSSMRPNIFLGVSEGSAQYKKWYYELMVDHTEPFVTAEATHLRVGWASTEGYSPYPGGGEEWGGNGVGDDLFSYGFDGLHLWSGCIARTVSSPNQHLLRTDDVISCCLDLSAPSISFRINGQPVQGMFENFNIDGLFFPVVSFSAGIKVRFLLGGRHGEFKFLPPPGYAPCYEAVLPKEKLKVEHSREYKQERTYTRDLLGPTVSLTQAAFTPIPVDTSQIVLPPHLERIREKLAENIHELWVMNKIELGWQYGPVRDDNKRQHPCLVEFSKLPEQERNYNLQMSLETLKTLLALGCHVGISDEHAEDKVKKMKLPKNYQLTSGYKPAPMDLSFIKLTPSQEAMVDKLAENAHNVWARDRIRQGWTYGIQQDVKNRRNPRLVPYTLLDDRTKKSNKDSLREAVRTLLGYGYNLEAPDQDHAARAEVCSGTGERFRIFRAEKTYAVKAGRWYFEFETVTAGDMRVGWSRPGCQPDQELGSDERAFAFDGFKAQRWHQGNEHYGRSWQAGDVVGCMVDMNEHTMMFTLNGEILLDDSGSELAFKDFDVGDGFIPVCSLGVAQVGRMNFGKDVSTLKYFTICGLQEGYEPFAVNTNRDITMWLSKRLPQFLQVPSNHEHIEVTRIDGTIDSSPCLKVTQKSFGSQNSNTDIMFYRLSMPIECAEVFSKTVAGGLPGAGLFGPKNDLEDYDADSDFEVLMKTAHGHLVPDRVDKDKEATKPEFNNHKDYAQEKPSRLKQRFLLRRTKPDYSTSHSARLTEDVLADDRDDYDFLMQTSTYYYSVRIFPGQEPANVWVGWITSDFHQYDTGFDLDRVRTVTVTLGDEKGKVHESIKRSNCYMVCAGESMSPGQGRNNNGLEIGCVVDAASGLLTFIANGKELSTYYQVEPSTKLFPAVFAQATSPNVFQFELGRIKNVMPLSAGLFKSEHKNPVPQCPPRLHVQFLSHVLWSRMPNQFLKVDVSRISERQGWLVQCLDPLQFMSLHIPEENRSVDILELTEQEELLKFHYHTLRLYSAVCALGNHRVAHALCSHVDEPQLLYAIENKYMPGLLRAGYYDLLIDIHLSSYATARLMMNNEYIVPMTEETKSITLFPDENKKHGLPGIGLSTSLRPRMQFSSPSFVSISNECYQYSPEFPLDILKSKTIQMLTEAVKEGSLHARDPVGGTTEFLFVPLIKLFYTLLIMGIFHNEDLKHILQLIEPSVFKEAATPEEESDTLEKELSVDDAKLQGAGEEEAKGGKRPKEGLLQMKLPEPVKLQMCLLLQYLCDCQVRHRIEAIVAFSDDFVAKLQDNQRFRYNEVMQALNMSAALTARKTKEFRSPPQEQINMLLNFKDDKSECPCPEEIRDQLLDFHEDLMTHCGIELDEDGSLDGNSDLTIRGRLLSLVEKVTYLKKKQAEKPVESDSKKSSTLQQLISETMVRWAQESVIEDPELVRAMFVLLHRQYDGIGGLVRALPKTYTINGVSVEDTINLLASLGQIRSLLSVRMGKEEEKLMIRGLGDIMNNKVFYQHPNLMRALGMHETVMEVMVNVLGGGESKEITFPKMVANCCRFLCYFCRISRQNQKAMFDHLSYLLENSSVGLASPAMRGSTPLDVAAASVMDNNELALALREPDLEKVVRYLAGCGLQSCQMLVSKGYPDIGWNPVEGERYLDFLRFAVFCNGESVEENANVVVRLLIRRPECFGPALRGEGGNGLLAAMEEAIKIAEDPSRDGPSPNSGSSKTLDTEEEEDDTIHMGNAIMTFYSALIDLLGRCAPEMHLIHAGKGEAIRIRSILRSLIPLGDLVGVISIAFQMPTIAKDGNVVEPDMSAGFCPDHKAAMVLFLDRVYGIEVQDFLLHLLEVGFLPDLRAAASLDTAALSATDMALALNRYLCTAVLPLLTRCAPLFAGTEHHASLIDSLLHTVYRLSKGCSLTKAQRDSIEVCLLSICGQLRPSMMQHLLRRLVFDVPLLNEHAKMPLKLLTNHYERCWKYYCLPGGWGNFGAASEEELHLSRKLFWGIFDALSQKKYEQELFKLALPCLSAVAGALPPDYMESNYVSMMEKQSSMDSEGNFNPQPVDTSNITIPEKLEYFINKYAEHSHDKWSMDKLANGWIYGEIYSDSSKVQPLMKPYKLLSEKEKEIYRWPIKESLKTMLAWGWRIERTREGDSMALYNRTRRISQTSQVSVDAAHGYSPRAIDMSNVTLSRDLHAMAEMMAENYHNIWAKKKKMELESKGGGNHPLLVPYDTLTAKEKAKDREKAQDILKFLQINGYAVSRGFKDLELDTPSIEKRFAYSFLQQLIRYVDEAHQYILEFDGGSRGKGEHFPYEQEIKFFAKVVLPLIDQYFKNHRLYFLSAASRPLCSGGHASNKEKEMVTSLFCKLGVLVRHRISLFGNDATSIVNCLHILGQTLDARTVMKTGLESVKSALRAFLDNAAEDLEKTMENLKQGQFTHTRNQPKGVTQIINYTTVALLPMLSSLFEHIGQHQFGEDLILEDVQVSCYRILTSLYALGTSKSIYVERQRSALGECLAAFAGAFPVAFLETHLDKHNIYSIYNTKSSRERAALSLPTNVEDVCPNIPSLEKLMEEIVELAESGIRYTQMPHVMEVILPMLCSYMSRWWEHGPENNPERAEMCCTALNSEHMNTLLGNILKIIYNNLGIDEGAWMKRLAVFSQPIINKVKPQLLKTHFLPLMEKLKKKAATVVSEEDHLKAEARGDMSEAELLILDEFTTLARDLYAFYPLLIRFVDYNRAKWLKEPNPEAEELFRMVAEVFIYWSKSHNFKREEQNFVVQNEINNMSFLITDTKSKMSKAAVSDQERKKMKRKGDRYSMQTSLIVAALKRLLPIGLNICAPGDQELIALAKNRFSLKDTEDEVRDIIRSNIHLQGKLEDPAIRWQMALYKDLPNRTDDTSDPEKTVERVLDIANVLFHLEQKSKRVGRRHYCLVEHPQRSKKAVWHKLLSKQRKRAVVACFRMAPLYNLPRHRAVNLFLQGYEKSWIETEEHYFEDKLIEDLAKPGAEPPEEDEGTKRVDPLHQLILLFSRTALTEKCKLEEDFLYMAYADIMAKSCHDEEDDDGEEEVKSFEEKEMEKQKLLYQQARLHDRGAAEMVLQTISASKGETGPMVAATLKLGIAILNGGNSTVQQKMLDYLKEKKDVGFFQSLAGLMQSCSVLDLNAFERQNKAEGLGMVTEEGSGEKVLQDDEFTCDLFRFLQLLCEGHNSDFQNYLRTQTGNNTTVNIIISTVDYLLRVQESISDFYWYYSGKDVIDEQGQRNFSKAIQVAKQVFNTLTEYIQGPCTGNQQSLAHSRLWDAVVGFLHVFAHMQMKLSQDSSQIELLKELMDLQKDMVVMLLSMLEGNVVNGTIGKQMVDMLVESSNNVEMILKFFDMFLKLKDLTSSDTFKEYDPDGKGVISKRDFHKAMESHKHYTQSETEFLLSCAETDENETLDYEEFVKRFHEPAKDIGFNVAVLLTNLSEHMPNDTRLQTFLELAESVLNYFQPFLGRIEIMGSAKRIERVYFEISESSRTQWEKPQVKESKRQFIFDVVNEGGEKEKMELFVNFCEDTIFEMQLAAQISESDLNERSANKEESEKERPEEQGPRMAFFSILTVRSALFALRYNILTLMRMLSLKSLKKQMKKVKKMTVKDMVTAFFSSYWSIFMTLLHFVASVFRGFFRIICSLLLGGSLVEGAKKIKVAELLANMPDPTQDEVRGDGEEGERKPLEAALPSEDLTDLKELTEESDLLSDIFGLDLKREGGQYKLIPHNPNAGLSDLMSNPVPMPEVQEKFQEQKAKEEEKEEKEETKSEPEKAEGEDGEKEEKAKEDKGKQKLRQLHTHRYGEPEVPESAFWKKIIAYQQKLLNYFARNFYNMRMLALFVAFAINFILLFYKVSTSSVVEGKELPTRSSSENAKVTSLDSSSHRIIAVHYVLEESSGYMEPTLRILAILHTVISFFCIIGYYCLKVPLVIFKREKEVARKLEFDGLYITEQPSEDDIKGQWDRLVINTQSFPNNYWDKFVKRKVMDKYGEFYGRDRISELLGMDKAALDFSDAREKKKPKKDSSLSAVLNSIDVKYQMWKLGVVFTDNSFLYLAWYMTMSVLGHYNNFFFAAHLLDIAMGFKTLRTILSSVTHNGKQLVLTVGLLAVVVYLYTVVAFNFFRKFYNKSEDGDTPDMKCDDMLTCYMFHMYVGVRAGGGIGDEIEDPAGDEYEIYRIIFDITFFFFVIVILLAIIQGLIIDAFGELRDQQEQVKEDMETKCFICGIGNDYFDTVPHGFETHTLQEHNLANYLFFLMYLINKDETEHTGQESYVWKMYQERCWEFFPAGDCFRKQYEDQLN

SEQ ID NO: 3808 - protein, 4870 aa, unidentified
MAEGGEGGEDEIQFLRTEDEVVLQCIATIHKEQRKFCLAAEGLGNRLCFLEPTSEAKYIPPDLCVCNFVLEQSLSVRALQEMLANTGENGGEGAAQGGGHRTLLYGHAVLLRHSFSGMYLTCLTTSRSQTDKLAFDVGLREHATGEACWWTIHPASKQRSEGEKVRIGDDLILVSVSSERYLHLSVSNGNIQVDASFMQTLWNVHPTCSGSSIEEGYLLGGHVVRLFHGHDECLTIPSTDQNDSQHRRIFYEAGGAGTRARSLWRVEPLRISWSGSNIRWGQAFRLRHLTTGHYLALTEDQGLILQDRAKSDTKSTAFSFRASKELKEKLDSSHKRDIEGMGVPEIKYGDSVCFVQHIASGLWVTYKAQDAKTSRLGPLKRKVILHQEGHMDDGLTLQRCQREESQAARIIRNTTALFSQFVSGNNRTAAPITLPIEEVLQTLQDLIAYFQPPEEEMRHEDKQNKLRSLKNRQNLFKEEGMLALVLNCIDRLNVYNSVAHFAGIAREESGMAWKEILNLLYKLLAALIRGNRNNCAQFSNNLDWLISKLDRLESSSGILEVLHCILTESPEALNLIAEGHIKSIISLLDKHGRNHKVLDILCSLCLCNGVAVRANQNLICDNLLPRRNLLLQTRLINDVTSIRPNIFLGVAEGSAQYKKWYFELIIDQVDPFLTAEPTHLRVGWASSSGYAPYPGGGEGWGGNGVGDDLYSYGFDGLHLWSGRIPRAVASINQHLLRSDDVVSCCLDLGVPSISFRINGQPVQGMFENFNTDGLFFPVMSFSAGVKVRFLMGGRHGEFKFLPPSGYAPCYEALLPKEKMRLEPVKEYKRDADGIRDLLGTTQFLSQASFIPCPVDTSQVILPPHLEKIRDRLAENIHELWGMNKIELGWTFGKIRDDNKRQHPCLVEFSKLPETEKNYNLQMSTETLKTLLALGCHIAHVNPAAEEDLKKVKLPKNYMMSNGYKPAPLDLSDVKLLPPQEILVDKLAENAHNVWAKDRIKQGWTYGIQQDLKNKRNPRLVPYALLDERTKKSNRDSLREAVRTFVGYGYNIEPSDQELADSAVEKVSIDKIRFFRVERSYAVRSGKWYFEFEVVTGGDMRVGWARPGCRPDVELGADDQAFVFEGNRGQRWHQGSGYFGRTWQPGDVVGCMINLDDASMIFTLNGELLITNKGSELAFADYEIENGFVPICCLGLSQIGRMNLGTDASTFKFYTMCGLQEGFEPFAVNMNRDVAMWFSKRLPTFVNVPKDHPHIEVMRIDGTMDSPPCLKVTHKTFGTQNSNADMIYCRLSMPVECHSSFSHSPCLDSEAFQKRKQMQEILSHTTTQCYYAIRIFAGQDPSCVWVGWVTPDYHLYSEKFDLNKNCTVTVTLGDERGRVHESVKRSNCYMVWGGDIVASSQRSNRSNVDLEIGCLVDLAMGMLSFSANGKELGTCYQVEPNTKVFPAVFLQPTSTSLFQFELGKLKNAMPLSAAIFRSEEKNPVPQCPPRLDVQTIQPVLWSRMPNSFLKVETERVSERHGWVVQCLEPLQMMALHIPEENRCVDILELCEQEDLMRFHYHTLRLYSAVCALGNSRVAYALCSHVDLSQLFYAIDNKYLPGLLRSGFYDLLISIHLASAKERKLMMKNEYIIPITSTTRNIRLFPDESKRHGLPGVGLRTCLKPGFRFSTPCFVVTGEDHQKQSPEIPLESLRTKALSMLTEAVQCSGAHIRDPVGGSVEFQFVPVLKLIGTLLVMGVFDDDDVRQILLLIDPSVFGEHSAGTEEGAEKEEVTQVEEKAVEAGEKAGKEAPVKGLLQTRLPESVKLQMCELLSYLCDCELQHRVEAIVAFGDIYVSKLQANQKFRYNELMQALNMSAALTARKTKEFRSPPQEQINMLLNFQLGENCPCPEEIREELYDFHEDLLLHCGVPLEEEEEEEEDTSWTGKLCALVYKIKGPPKPEKEQPTEEEERCPTTLKELISQTMICWAQEDQIQDSELVRMMFNLLRRQYDSIGELLQALRKTYTISHTSVSDTINLLAALGQIRSLLSVRMGKEEELLMINGLGDIMNNKVFYQHPNLMRVLGMHETVMEVMVNVLGTEKSQIAFPKMVASCCRFLCYFCRISRQNQKAMFEHLSYLLENSSVGLASPSMRGSTPLDVAASSVMDNNELALSLEEPDLEKVVTYLAGCGLQSCPMLLAKGYPDVGWNPIEGERYLSFLRFAVFVNSESVEENASVVVKLLIRRPECFGPALRGEGGNGLLAAMQGAIKISENPALDLPSQGYKREVSTGDDEEEEEIVHMGNAIMSFYSALIDLLGRCAPEMHLIQTGKGEAIRIRSILRSLVPTEDLVGIISIPLKLPSLNKDGSVSEPDMAANFCPDHKAPMVLFLDRVYGIKDQTFLLHLLEVGFLPDLRASASLDTVSLSTTEAALALNRYICSAVLPLLTRCAPLFAGTEHCTSLIDSTLQTIYRLSKGRSLTKAQRDTIEECLLAICNHLRPSMLQQLLRRLVFDVPQLNEYCKMPLKLLTNHYEQCWKYYCLPSGWGSYGLAVEEELHLTEKLFWGIFDSLSHKKYDPDLFRMALPCLSAIAGALPPDYLDTRITATLEKQISVDADGNFDPKPINTMNFSLPEKLEYIVTKYAEHSHDKWACDKSQSGWKYGISLDENVKTHPLIRPFKTLTEKEKEIYRWPARESLKTMLAVGWTVERTKEGEALVQQRENEKLRSVSQANQGNSYSPAPLDLSNVVLSRELQGMVEVVAENYHNIWAKKKKLELESKGGGSHPLLVPYDTLTAKEKFKDREKAQDLFKFLQVNGIIVSRGMKDMELDASSMEKRFAYKFLKKILKYVDSAQEFIAHLEAIVSSGKTEKSPRDQEIKFFAKVLLPLVDQYFTSHCLYFLSSPLKPLSSSGYASHKEKEMVAGLFCKLAALVRHRISLFGSDSTTMVSCLHILAQTLDTRTVMKSGSELVKAGLRAFFENAAEDLEKTSENLKLGKFTHSRTQIKGVSQNINYTTVALLPILTSIFEHVTQHQFGMDLLLGDVQISCYHILCSLYSLGTGKNIYVERQRPALGECLASLAAAIPVAFLEPTLNRYNPLSVFNTKTPRERSILGMPDTVEDMCPDIPQLEGLMKEINDLAESGARYTEMPHVIEVILPMLCNYLSYWWERGPENLPPSTGPCCTKVTSEHLSLILGNILKIINNNLGIDEASWMKRIAVYAQPIISKARPDLLRSHFIPTLEKLKKKAVKTVQEEEQLKADGKGDTQEAELLILDEFAVLCRDLYAFYPMLIRYVDNNRSNWLKSPDADSDQLFRMVAEVFILWCKSHNFKREEQNFVIQNEINNLAFLTGDSKSKMSKAMQVKSGGQDQERKKTKRRGDLYSIQTSLIVAALKKMLPIGLNMCTPGDQELISLAKSRYSHRDTDEEVREHLRNNLHLQEKSDDPAVKWQLNLYKDVLKSEEPFNPEKTVERVQRISAAVFHLEQVEQPLRSKKAVWHKLLSKQRKRAVVACFRMAPLYNLPRHRSINLFLHGYQRFWIETEEYSFEEKLVQDLAKSPKVEEEEEEETEKQPDPLHQIILYFSRNALTERSKLEDDPLYTSYSSMMAKSCQSGEDEEEDEDKEKTFEEKEMEKQKTLYQQARLHERGAAEMVLQMISASKGEMSPMVVETLKLGIAILNGGNAGVQQKMLDYLKEKKDAGFFQSLSGLMQSCSVLDLNAFERQNKAEGLGMVTEEGTLIVRERGEKVLQNDEFTRDLFRFLQLLCEGHNSDFQNFLRTQMGNTTTVNVIISTVDYLLRLQESISDFYWYYSGKDIIDESGQHNFSKALAVTKQIFNSLTEYIQGPCIGNQQSLAHSRLWDAVVGFLHVFANMQMKLSQDSSQIELLKELLDLLQDMVVMLLSLLEGNVVNGTIGKQMVDTLVESSTNVEMILKFFDMFLKLKDLTSSDTFKEYDPDGKGIISKKEFQKAMEGQKQYTQSEIDFLLSCAEADENDMFNYVDFVDRFHEPAKDIGFNVAVLLTNLSEHMPNDSRLKCLLDPAESVLNYFEPYLGRIEIMGGAKKIERVYFEISESSRTQWEKPQVKESKRQFIFDVVNEGGEQEKMELFVNFCEDTIFEMQLASQISESDSADRPEEEEEDEDSSYVLEIAGEEEEDGSLEPASAFAMACASVKRNVTDFLKRATLKNLRKQYRNVKKMTAKELVKVLFSFFWMLFVGLFQLLFTILGGIFQILWSTVFGGGLVEGAKNIRVTKILGDMPDPTQFGIHDDTMEAERAEVMEPGITTELVHFIKGEKGDTDIMSDLFGLHPKKEGSLKHGPEVGLGDLSEIIGKDEPPTLESTVQKKRKAQAAEMKAANEAEGKVESEKADMEDGEKEDKDKEEEQAEYLWTEVTKKKKRRCGQKVEKPEAFTANFFKGLEIYQTKLLHYLARNFYNLRFLALFVAFAINFILLFYKVTEEPLEEETEDVANLWNSFNDEEEEEAMVFFVLQESTGYMAPTLRALAIIHTIISLVCVVGYYCLKVPLVVFKREKEIARKLEFDGLYITEQPSEDDIKGQWDRLVINTPSFPNNYWDKFVKRKVINKYGDLYGAERIAELLGLDKNALDFSPVEETKAEAASLVSWLSSIDMKYHIWKLGVVFTDNSFLYLAWYTTMSVLGHYNNFFFAAHLLDIAMGFKTLRTILSSVTHNGKQLVLTVGLLAVVVYLYTVVAFNFFRKFYNKSEDDDEPDMKCDDMMTCYLFHMYVGVRAGGGIGDEIEDPAGDPYEMYRIVFDITFFFFVIVILLAIIQGLIIDAFGELRDQQEQVREDMETKCFICGIGNDYFDTTPHGFETHTLQEHNLANYLFFLMYLINKDETEHTGQESYVWKMYQERCWDFFPAGDCFRKQYEDQLG

SEQ ID NO: 3809 - protein, 97 aa, unidentified
MPSQMEHAMETMMFTFHKFAGDKGYLTKEDLRVLMEKEFPGFLENQKDPLAVDKIMKDLDQCRDGKVGFQSFFSLIAGLTIACNDYFVVHMKQKGKK

SEQ ID NO: 3810 - protein, 382 aa, unidentified
MGPTSVPLVKAHRSSVSDYVNYDIIVRHYNYTGKLNISADKENSIKLTSVVFILICCFIILENIFVLLTIWKTKKFHRPMYYFIGNLALSDLLAGVAYTANLLLSGATTYKLTPAQWFLREGSMFVALSASVFSLLAIAIERYITMLKMKLHNGSNNFRLFLLISACWVISLILGGLPIMGWNCISALSSCSTVLPLYHKHYILFCTTVFTLLLLSIVILYCRIYSLVRTRSRRLTFRKNISKASRSSEKSLALLKTVIIVLSVFIACWAPLFILLLLDVGCKVKTCDILFRAEYFLVLAVLNSGTNPIIYTLTNKEMRRAFIRIMSCCKCPSGDSAGKFKRPIIAGMEFSRSKSDNSSHPQKDEGDNPETIMSSGNVNSSS

SEQ ID NO: 3811 - protein, 353 aa, unidentified
MGSLYSEYLNPNKVQEHYNYTKETLETQETTSRQVASAFIVILCCAIVVENLLVLIAVARNSKFHSAMYLFLGNLAASDLLAGVAFVANTLLSGSVTLRLTPVQWFAREGSAFITLSASVFSLLAIAIERHVAIAKVKLYGSDKSCRMLLLIGASWLISLVLGGLPILGWNCLGHLEACSTVLPLYAKHYVLCVVTIFSIILLAIVALYVRIYCVVRSSHADMAAPQTLALLKTVTIVLGVFIVCWLPAFSILLLDYACPVHSCPILYKAHYFFAVSTLNSLLNPVIYTWRSRDLRREVLRPLQCWRPGVGVQGRRRGGTPGHHLLPLRSSSSLERGMHMPTSPTFLEGNTVV

SEQ ID NO: 3812 - protein, 378 aa, unidentified
MATALPPRLQPVRGNETLREHYQYVGKLAGRLKEASEGSTLTTVLFLVICSFIVLENLMVLIAIWKNNKFHNRMYFFIGNLALCDLLAGIAYKVNILMSGKKTFSLSPTVWFLREGSMFVALGASTCSLLAIAIERHLTMIKMRPYDANKRHRVFLLIGMCWLIAFTLGALPILGWNCLHNLPDCSTILPLYSKKYIAFCISIFTAILVTIVILYARIYFLVKSSSRKVANHNNSERSMALLRTVVIVVSVFIACWSPLFILFLIDVACRVQACPILFKAQWFIVLAVLNSAMNPVIYTLASKEMRRAFFRLVCNCLVRGRGARASPIQPALDPSRSKSSSSNNSSHSPKVKEDLPHTAPSSCIMDKNAALQNGIFCN

SEQ ID NO: 3813 - protein, 384 aa, unidentified
MNATGTPVAPESCQQLAAGGHSRLIVLHYNHSGRLAGRGGPEDGGLGALRGLSVAASCLVVLENLLVLAAITSHMRSRRWVYYCLVNITLSDLLTGAAYLANVLLSGARTFRLAPAQWFLREGLLFTALAASTFSLLFTAGERFATMVRPVAESGATKTSRVYGFIGLCWLLAALLGMLPLLGWNCLCAFDRCSSLLPLYSKRYILFCLVIFAGVLATIMGLYGAIFRLVQASGQKAPRPAARRKARRLLKTVLMILLAFLVCWGPLFGLLLADVFGSNLWAQEYLRGMDWILALAVLNSAVNPIIYSFRSREVCRAVLSFLCCGCLRLGMRGPGDCLARAVEAHSGASTTDSSLRPRDSFRGSRSLSFRMREPLSSISSVRSI

SEQ ID NO: 3814 - protein, 398 aa, unidentified
MESGLLRPAPVSEVIVLHYNYTGKLRGARYQPGAGLRADAVVCLAVCAFIVLENLAVLLVLGRHPRFHAPMFLLLGSLTLSDLLAGAAYAANILLSGPLTLKLSPALWFAREGGVFVALTASVLSLLAIALERSLTMARRGPAPVSSRGRTLAMAAAAWGVSLLLGLLPALGWNCLGRLDACSTVLPLYAKAYVLFCVLAFVGILAAICALYARIYCQVRANARRLPARPGTAGTTSTRARRKPRSLALLRTLSVVLLAFVACWGPLFLLLLLDVACPARTCPVLLQADPFLGLAMANSLLNPIIYTLTNRDLRHALLRLVCCGRHSCGRDPSGSQQSASAAEASGGLRRCLPPGLDGSFSGSERSSPQRDGLDTSGSTGSPGAPTAARTLVSEPAAD

SEQ ID NO: 3815 - protein, 587 aa, unidentified
MATAAYEQLKLHITPEKFYVEACDDGADDVLTIDRVSTEVTLAVKKDVPPSAVTRPIFGILGTIHLVAGNYLIVITKKIKVGEFFSHVVWKATDFDVLSYKKTMLHLTDIQLQDNKTFLAMLNHVLNVDGFYFSTTYDLTHTLQRLSNTSPEFQEMSLLERADQRFVWNGHLLRELSAQPEVHRFALPVLHGFITMHSCSINGKYFDWILISRRSCFRAGVRYYVRGIDSEGHAANFVETEQIVHYNGSKASFVQTRGSIPVFWSQRPNLKYKPLPQISKVANHMDGFQRHFDSQVIIYGKQVIINLINQKGSEKPLEQTFATMVSSLGSGMMRYIAFDFHKECKNMRWDRLSILLDQVAEMQDELSYFLVDSAGQVVANQEGVFRSNCMDCLDRTNVIQSLLARRSLQAQLQRLGVLHVGQKLEEQDEFEKIYKNAWADNANACAKQYAGTGALKTDFTRTGKRTHLGLIMDGWNSMIRYYKNNFSDGFRQDSIDLFLGNYSVDELESHSPLSVPRDWKFLALPIIMVVAFSMCIICLLMAGDTWTETLAYVLFWGVASIGTFFIILYNGKDFVDAPRLVQKEKID

SEQ ID NO: 3816 - protein, 173 aa, unidentified
MCTNIVYEWLKALQLPQYAESFVDNGYDDLEVCKQIGDPDLDAIGVLAPAHRRRILEAVRRLREQDANAAGLYFTLEPQPAPPGPPADAVPTGRRGEPCGGPAQGTRGDSRGHTTAPRSRELVSYPKLKLKIMIRDKLVRDGIHLSKPPYSRKVPMAGILEYLMNWPKSSQSR

SEQ ID NO: 3817 - protein, 415 aa, unidentified
MAGPNQLCIRRWTTKHVAVWLKDEGFFEYVDILCNKHRLDGITLLTLTEYDLRSPPLEIKVLGDIKRLMLSVRKLQKIHIDVLEEMGYNSDSPMGSMTPFISALQSTDWLCNGELSHDCDGPITDLNSDQYQYMNGKNKHSVRRLDPEYWKTILSCIYVFIVFGFTSFIMVIVHERVPDMQTYPPLPDIFLDSVPRIPWAFAMTEVCGMILCYIWLLVLLLHKHRSILLRRLCSLMGTVFLLRCFTMFVTSLSVPGQHLQCTGKIYGSVWEKLHRAFAIWSGFGMTLTGVHTCGDYMFSGHTVVLTMLNFFVTEYTPRSWNFLHTLSWVLNLFGIFFILAAHEHYSIDVFIAFYITTRLFLYYHTLANTRAYQQSRRARIWFPMFSFFECNVNGTVPNEYCWPFSKPAIMKRLIG

SEQ ID NO: 3818 - protein, 339 aa, unidentified
MAAACGPGAAGYCLLLGLHLFLLTAGPALGWNDPDRMLLRDVKALTLHYDRYTTSRRLDPIPQLKCVGGTAGCDSYTPKVIQCQNKGWDGYDVQWECKTDLDIAYKFGKTVVSCEGYESSEDQYVLRGSCGLEYNLDYTELGLQKLKESGKQHGFASFSDYYYKWSSADSCNMSGLITIVVLLGIAFVVYKLFLSDGQYSPPPYSEYPPFSHRYQRFTNSAGPPPPGFKSEFTGPQNTGHGATSGFGSAFTGQQGYENSGPGFWTGLGTGGILGYLFGSNRAATPFSDSWYYPSYPPSYPGTWNRAYSPLHGGSGSYSVCSNSDTKTRTASGYGGTRRR

SEQ ID NO: 3819 - protein, 183 aa, unidentified
MEQRLAEFRAARKRAGLAAQPPAASQGAQTPGEKAEAAATLKAAPGWLKRFLVWKPRPASARAQPGLVQEAAQPQGSTSETPWNTAIPLPSCWDQSFLTNITFLKVLLWLVLLGLFVELEFGLAYFVLSLFYWMYVGTRGPEEKKEGEKSAYSVFNPGCEAIQGTLTAEQLERELQLRPLAGR

SEQ ID NO: 3820 - protein, 424 aa, unidentified
MSVGCPEPEPPRSLTCCGPGTAPGPGAGVPLLTEDMQALTLRTLAASDVTKHYELVRELGKGTYGKVDLVVYKGTGTKMALKFVNKSKTKLKNFLREVSITNSLSSSPFIIKVFDVVFETEDCYVFAQEYAPAGDLFDIIPPQVGLPEDTVKRCVQQLGLALDFMHGRQLVHRDIKPENVLLFDRECRRVKLADFGMTRRVGCRVKRVSGTIPYTAPEVCQAGRADGLAVDTGVDVWAFGVLIFCVLTGNFPWEAASGADAFFEEFVRWQRGRLPGLPSQWRRFTEPALRMFQRLLALEPERRGPAKEVFRFLKHELTSELRRRPSHRARKPPGDRPPAAGPLRLEAPGPLKRTVLTESGSGSRPAPPAVGSVPLPVPVPVPVPVPVPVPEPGLAPQGPPGRTDGRADKSKGQVVLATAIEICV

SEQ ID NO: 3821 - protein, 348 aa, unidentified
MPGKQSEEGPAEAGASEDSEEEGLGGLTLEELQQGQEAARALEDMMTLSAQTLVRAEVDELYEEVRPLGQGCYGRVLLVTHRQKGTPLALKQLPKPRTSLRGFLYEFCVGLSLGAHSAIVTAYGIGIESAHSYSFLTEPVLHGDLMAFIQPKVGLPQPAVHRCAAQLASALEYIHARGLVYRDLKPENVLVCDPACRRFKLTDFGHTRPRGTLLRLAGPPIPYTAPELCAPPPLPEGLPIQPALDAWALGVLLFCLLTGYFPWDRPLAEADPFYEDFLIWQASGQPRDRPQPWFGLAAAADALLRGLLDPHPRRRSAVIAIREHLGRPWRQREGEAEAVGAVEEEAGQ

SEQ ID NO: 3822 - protein, 299 aa, unidentified
MDLVLRVADYYFFTPYVYPATWPEDDIFRQAISLLIVTNVGAYILYFFCATLSYYFVFDHALMKHPQFLKNQVRREIKFTVQALPWISILTVALFLLEIRGYSKLHDDLGEFPYGLFELVVSIISFLFFTDMFIYWIHRGLHHRLVYKRLHKPHHIWKIPTPFASHAFHPIDGFLQSLPYHIYPFIFPLHKVVYLSLYILVNIWTISIHDGDFRVPQILQPFINGSAHHTDHHMFFDYNYGQYFTLWDRIGGSFKNPSSFEGKGPLSYVKEMTEGKRSSHSGNGCKNEKLFNGEFTKTE

SEQ ID NO: 3823 - protein, 1463 aa, unidentified
MKKKTVCTLNMGDKKYEDMEGEENGDNTISTGLLYSEADRCPICLNCLLEKEVGFPESCNHVFCMTCILKWAETLASCPIDRKPFQAVFKFSALEGYVKVQVKKQLRETKDKKNENSFEKQVSCHENSKSCIRRKAIVREDLLSAKVCDLKWIHRNSLYSETGGKKNAAIKINKPQRSNWSTNQCFRNFFSNMFSSVSHSGESSFTYRAYCTEFIEASEISALIRQKRHELELSWFPDTLPGIGRIGFIPWNVETEVLPLISSVLPRTIFPTSTISFEHFGTSCKGYALAHTQEGEEKKQTSGTSNTRGSRRKPAMTTPTRRSTRNTRAETASQSQRSPISDNSGCDAPGNSNPSLSVPSSAESEKQTRQAPKRKSVRRGRKPPLLKKKLRSSVAAPEKSSSNDSVDEETAESDTSPVLEKEHQPDVDSSNICTVQTHVENQSANCLKSCNEQIEESEKHTANYDTEERVGSSSSESCAQDLPVLVGEEGEVKKLENTGIEANVLCLESEISENILEKGGDPLEKQDQISGLSQSEVKTDVCTVHLPNDFPTCLTSESKVYQPVSCPLSDLSENVESVVNEEKITESSLVEITEHKDFTLKTEELIESPKLESSEGEIIQTVDRQSVKSPEVQLLGHVETEDVEIIATCDTFGNEDFNNIQDSENNLLKNNLLNTKLEKSLEEKNESLTEHPRSTELPKTHIEQIQKHFSEDNNEMIPMECDSFCSDQNESEVEPSVNADLKQMNENSVTHCSENNMPSSDLADEKVETVSQPSESPKDTIDKTKKPRTRRSRFHSPSTTWSPNKDTPQEKKRPQSPSPRRETGKESRKSQSPSPKNESARGRKKSRSQSPKKDIARERRQSQSRSPKRDTTRESRRSESLSPRRETSRENKRSQPRVKDSSPGEKSRSQSRERESDRDGQRRERERRTRKWSRSRSHSRSPSRCRTKSKSSSFGRIDRDSYSPRWKGRWANDGWRCPRGNDRYRKNDPEKQNENTRKEKNDIHLDADDPNSADKHRNDCPNWITEKINSGPDPRTRNPEKLKESHWEENRNENSGNSWNKNFGSGWVSNRGRGRGNRGRGTYRSSFAYKDQNENRWQNRKPLSGNSNSSGSESFKFVEQQSYKRKSEQEFSFDTPADRSGWTSASSWAVRKTLPADVQNYYSRRGRNSSGPQSGWMKQEEETSGQDSSLKDQTNQQVDGSQLPINMMQPQMNVMQQQMNAQHQPMNIFPYPVGVHAPLMNIQRNPFNIHPQLPLHLHTGVPLMQVATPTSVSQGLPPPPPPPPPSQQVNYIASQPDGKQLQGIPSSSHVSNNMSTPVLPAPTAAPGNTGMVQGPSSGNTSSSSHSKASNAAVKLAESKVSVAVEASADSSKTDKKLQIQEKAAQEVKLAIKPFYQNKDITKEEYKEIVRKAVDKVCHSKSGEVNSTKVANLVKAYVDKYKYSRKGSQKKTLEEPVSTEKNIG

SEQ ID NO: 3824 - protein, 329 aa, unidentified
MSAFDTNPFADPVDVNPFQDPSVTQLTNAPQGGLAEFNPFSETNAATTVPVTQLPGSSQPAVLQPSVEPTQPTPQAVVSAAQAGLLRQQEELDRKAAELERKERELQNTVANLHVRQNNWPPLPSWCPVKPCFYQDFSTEIPADYQRICKMLYYLWMLHSVTLFLNLLACLAWFSGNSSKGVDFGLSILWFLIFTPCAFLCWYRPIYKAFRSDNSFSFFVFFFVFFCQIGIYIIQLVGIPGLGDSGWIAALSTLDNHSLAISVIMMVVAGFFTLCAVLSVFLLQRVHSLYRRTGASFQQAQEEFSQGIFSSRTFHRAASSAAQGAFQGN

SEQ ID NO: 3825 - protein, 347 aa, unidentified
MAQSRDGGNPFAEPSELDNPFQDPAVIQHRPSRQYATLDVYNPFETREPPPAYEPPAPAPLPPPSAPSLQPSRKLSPTEPKNYGSYSTQASAAAATAELLKKQEELNRKAEELDRRERELQHAALGGTATRQNNWPPLPSFCPVQPCFFQDISMEIPQEFQKTVSTMYYLWMCSTLALLLNFLACLASFCVETNNGAGFGLSILWVLLFTPCSFVCWYRPMYKAFRSDSSFNFFVFFFIFFVQDVLFVLQAIGIPGWGFSGWISALVVPKGNTAVSVLMLLVALLFTGIAVLGIVMLKRIHSLYRRTGASFQKAQQEFAAGVFSNPAVRTAAANAAAGAAENAFRAP

SEQ ID NO: 3826 - protein, 229 aa, unidentified
MSEKENNFPPLPKFIPVKPCFYQNFSDEIPVEHQVLVKRIYRLWMFYCATLGVNLIACLAWWIGGGSGTNFGLAFVWLLLFTPCGYVCWFRPVYKAFRADSSFNFMAFFFIFGAQFVLTVIQAIGFSGWGACGWLSAIGFFQYSPGAAVVMLLPAIMFSVSAAMMAIAIMKVHRIYRGAGGSFQKAQTEWNTGTWRNPPSREAQYNNFSGNSLPEYPTVPSYPGSGQWP

SEQ ID NO: 3827 - protein, 235 aa, unidentified
MAEKVNNFPPLPKFIPLKPCFYQDFEADIPPQHVSMTKRLYYLWMLNSVTLAVNLVGCLAWLIGGGGATNFGLAFLWLILFTPCSYVCWFRPIYKAFKTDSSFSFMAFFFTFMAQLVISIIQAVGIPGWGVCGWIATISFFGTNIGSAVVMLIPTVMFTVMAVFSFIALSMVHKFYRGSGGSFSKAQEEWTTGAWKNPHVQQAAQNAAMGAAQGAMNQPQTQYSATPNYTYSNEM

SEQ ID NO: 3828 - protein, 1279 aa, unidentified
MTLTERLREKISRAFYNHGLLCASYPIPIILFTGFCILACCYPLLKLPLPGTGPVEFTTPVKDYSPPPVDSDRKQGEPTEQPEWYVGAPVAYVQQIFVKSSVFPWHKNLLAVDVFRSPLSRAFQLVEEIRNHVLRDSSGIRSLEELCLQVTDLLPGLRKLRNLLPEHGCLLLSPGNFWQNDWERFHADPDIIGTIHQHEPKTLQTSATLKDLLFGVPGKYSGVSLYTRKRMVSYTITLVFQHYHAKFLGSLRARLMLLHPSPNCSLRAESLVHVHFKEEIGVAELIPLVTTYIILFAYIYFSTRKIDMVKSKWGLALAAVVTVLSSLLMSVGLCTLFGLTPTLNGGEIFPYLVVVIGLENVLVLTKSVVSTPVDLEVKLRIAQGLSSESWSIMKNMATELGIILIGYFTLVPAIQEFCLFAVVGLVSDFFLQMLFFTTVLSIDIRRMELADLNKRLPPEACLPSAKPVGQPTRYERQLAVRPSTPHTITLQPSSFRNLRLPKRLRVVYFLARTRLAQRLIMAGTVVWIGILVYTDPAGLRNYLAAQVTEQSPLGEGALAPMPVPSGMLPPSHPDPAFSIFPPDAPKLPENQTSPGESPERGGPAEVVHDSPVPEVTWGPEDEELWRKLSFRHWPTLFSYYNITLAKRYISLLPVIPVTLRLNPREALEGRHPQDGRSAWPPPGPIPAGHWEAGPKGPGGVQAHGDVTLYKVAALGLATGIVLVLLLLCLYRVLCPRNYGQLGGGPGRRRRGELPCDDYGYAPPETEIVPLVLRGHLMDIECLASDGMLLVSCCLAGHVCVWDAQTGDCLTRIPRPGRQRRDSGVGSGLEAQESWERLSDGGKAGPEEPGDSPPLRHRPRGPPPPSLFGDQPDLTCLIDTNFSAQPRSSQPTQPEPRHRAVCGRSRDSPGYDFSCLVQRVYQEEGLAAVCTPALRPPSPGPVLSQAPEDEGGSPEKGSPSLAWAPSAEGSIWSLELQGNLIVVGRSSGRLEVWDAIEGVLCCSSEEVSSGITALVFLDKRIVAARLNGSLDFFSLETHTALSPLQFRGTPGRGSSPASPVYSSSDTVACHLTHTVPCAHQKPITALKAAAGRLVTGSQDHTLRVFRLEDSCCLFTLQGHSGAITTVYIDQTMVLASGGQDGAICLWDVLTGSRVSHVFAHRGDVTSLTCTTSCVISSGLDDLISIWDRSTGIKFYSIQQDLGCGASLGVISDNLLVTGGQGCVSFWDLNYGDLLQTVYLGKNSEAQPARQILVLDNAAIVCNFGSELSLVYVPSVLEKLD

SEQ ID NO: 3829 - protein, 606 aa, unidentified
MKVRSAGGDGDALCVTEEDLAGDDEDMPTFPCTQKGRPGPRCSRCQKNLSLHTSVRILYLFLALLLVAVAVLASLVFRKVDSLSEDISLTQSIYDKKLVLMQKNLQGLDPKALNNCSFCHEAGQLGPEIRKLQEELEGIQKLLLAQEVQLDQTLQAQEVLSTTSRQISQEMGSCSFSIHQVNQSLGLFLAQVRGWQATTAGLDLSLKDLTQECYDVKAAVHQINFTVGQTSEWIHGIQRKTDEETLTLQKIVTDWQNYTRLFSGLRTTSTKTGEAVKNIQATLGASSQRISQNSESMHDLVLQVMGLQLQLDNISSFLDDHEENMHDLQYHTHYAQNRTVERFESLEGRMASHEIEIGTIFTNINATDNHVHSMLKYLDDVRLSCTLGFHTHAEELYYLNKSVSIMLGTTDLLRERFSLLSARLDLNVRNLSMIVEEMKAVDTQHGEILRNVTILRGAPGPPGPRGFKGDMGVKGPVGGRGPKGDPGSLGPLGPQGPQGQPGEAGPVGERGPVGPRGFPGLKGSKGSFGTGGPRGQPGPKGDIGPPGPEGPPGSPGPSGPQGKPGIAGKTGSPGQRGAMGPKGEPGIQGPPGLPGPPGPPGSQSFY

SEQ ID NO: 3830 - protein, 495 aa, unidentified
MENKAMYLHTVSDCDTSSICEDSFDGRSLSKLNLCEDGPCHKRRASICCTQLGSLSALKHAVLGLYLLVFLILVGIFILAVSRPRSSPDDLKALTRNVNRLNESFRDLQLRLLQAPLQADLTEQVWKVQDALQNQSDSLLALAGAVQRLEGALWGLQAQAVQTEQAVALLRDRTGQQSDTAQLELYQLQVESNSSQLLLRRHAGLLDGLARRVGILGEELADVGGVLRGLNHSLSYDVALHRTRLQDLRVLVSNASEDTRRLRLAHVGMELQLKQELAMLNAVTEDLRLKDWEHSIALRNISLAKGPPGPKGDQGDEGKEGRPGIPGLPGLRGLPGERGTPGLPGPKGDDGKLGATGPMGMRGFKGDRGPKGEKGEKGDRAGDASGVEAPMMIRLVNGSGPHEGRVEVYHDRRWGTVCDDGWDKKDGDVVCRMLGFRGVEEVYRTARFGQGTGRIWMDDVACKGTEETIFRCSFSKWGVTNCGHAEDASVTCNRH

SEQ ID NO: 3831 - protein, 552 aa, unidentified
MGCSAKARWAAGALGVAGLLCAVLGAVMIVMVPSLIKQQVLKNVRIDPSSLSFNMWKEIPIPFYLSVYFFDVMNPSEILKGEKPQVRERGPYVYREFRHKSNITFNNNDTVSFLEYRTFQFQPSKSHGSESDYIVMPNILVLGAAVMMENKPMTLKLIMTLAFTTLGERAFMNRTVGEIMWGYKDPLVNLINKYFPGMFPFKDKFGLFAELNNSDSGLFTVFTGVQNISRIHLVDKWNGLSKVDFWHSDQCNMINGTSGQMWPPFMTPESSLEFYSPEACRSMKLMYKESGVFEGIPTYRFVAPKTLFANGSIYPPNEGFCPCLESGIQNVSTCRFSAPLFLSHPHFLNADPVLAEAVTGLHPNQEAHSLFLDIHPVTGIPMNCSVKLQLSLYMKSVAGIGQTGKIEPVVLPLLWFAESGAMEGETLHTFYTQLVLMPKVMHYAQYVLLALGCVLLLVPVICQIRSQVGAGQRAARADSHSLACWGKGASDRTLWPTAAWSPPPAAVLRLCRSGSGHCWGLRSTLASFACRVATTLPVLEGLGPSLGGGTGS

SEQ ID NO: 3832 - protein, 478 aa, unidentified
MGRCCFYTAGTLSLLLLVTSVTLLVARVFQKAVDQSIEKKIVLRNGTEAFDSWEKPPLPVYTQFYFFNVTNPEEILRGETPRVEEVGPYTYRELRNKANIQFGDNGTTISAVSNKAYVFERDQSVGDPKIDLIRTLNIPVLTVIEWSQVHFLREIIEAMLKAYQQKLFVTHTVDELLWGYKDEILSLIHVFRPDISPYFGLFYEKNGTNDGDYVFLTGEDSYLNFTKIVEWNGKTSLDWWITDKCNMINGTDGDSFHPLITKDEVLYVFPSDFCRSVYITFSDYESVQGLPAFRYKVPAEILANTSDNAGFCIPEGNCLGSGVLNVSICKNGAPIIMSFPHFYQADERFVSAIEGMHPNQEDHETFVDINPLTGIILKAAKRFQINIYVKKLDDFVETGDIRTMVFPVMYLNESVHIDKETASRLKSMINTTLIITNIPYIIMALGVFFGLVFTWLACKGQGSMDEGTADERAPLIRT

SEQ ID NO: 3833 - protein, 871 aa, unidentified
MEGAGPRGAGPARRRGAGGPPSPLLPSLLLLLLLWMLPDTVAPQELNPRGRNVCRAPGSQVPTCCAGWRQQGDECGIAVCEGNSTCSENEVCVRPGECRCRHGYFGANCDTKCPRQFWGPDCKELCSCHPHGQCEDVTGQCTCHARRWGARCEHACQCQHGTCHPRSGACRCEPGWWGAQCASACYCSATSRCDPQTGACLCHAGWWGRSCNNQCACNSSPCEQQSGRCQCRERTFGARCDRYCQCFRGRCHPVDGTCACEPGYRGKYCREPCPAGFYGLGCRRRCGQCKGQQPCTVAEGRCLTCEPGWNGTKCDQPCATGFYGEGCSHRCPPCRDGHACNHVTGKCTRCNAGWIGDRCETKCSNGTYGEDCAFVCADCGSGHCDFQSGRCLCSPGVHGPHCNVTCPPGLHGADCAQACSCHEDTCDPVTGACHLETNQRKGVMGAGALLVLLVCLLLSLLGCCCACRGKDPTRRPRPRRELSLGRKKAPHRLCGRFSRISMKLPRIPLRRQKLPKVVVAHHDLDNTLNCSFLEPPSGLEQPSPSWSSRASFSSFDTTDEGPVYCVPHEEAPAESRDPEVPTVPAEAPAPSPVPLTTPASAEEAIPLPASSDSERSASSVEGPGGALYARVARREARPARARGEIGGLSLSPSPERRKPPPPDPATKPKVSWIHGKHSAAAAGRAPSPPPPGSEAAPSPSKRKRTPSDKSAHTVEHGSPRTRDPTPRPPGLPEEATALAAPSPPRARARGRGPGLLEPTDAGGPPRSAPEAASMLAAELRGKTRSLGRAEVALGAQGPREKPAPPQKAKRSVPPASPARAPPATETPGPEKAATDLPAPETPRKKTPIQKPPRKKSREAAGELGRAGAPTL

SEQ ID NO: 3834 - protein, 429 aa, unidentified
MATEQRPFHLVVFGASGFTGQFVTEEVAREQVDPERSSRLPWAVAGRSREKLQRVLEKAALKLGRPTLSSEVGIIICDIANPASLDEMAKQATVVLNCVGPYRFYGEPVIKACIENGASCIDISGEPQFLELMQLKYHEKAADKGVYIIGSSGFDSIPADLGVIYTRNKMNGTLTAVESFLTIHSGPEGLSIHDGTWKSAIYGFGDQSNLRKLRNVSNLKPVPLIGPKLKRRWPISYCRELKGYSIPFMGSDVSVVRRTQRYLYENLEESPVQYAAYVTVGGITSVIKLMFAGLFFLFFVRFGIGRQLLIKFPWFFSFGYFSKQGPTQKQIDAASFTLTFFGQGYSQGTGTDKNKPNIKICTQVKGPEAGYVATPIAMVQAAMTLLSDASHLPKAGGVFTPGAAFSKTKLIDRLNKHGIEFSVISSSEV

SEQ ID NO: 3835 - protein, 359 aa, unidentified
MPAHLLQDDISSSYTTTTTITAPPSRVLQNGGDKLETMPLYLEDDIRPDIKDDIYDPTYKDKEGPSPKVEYVWRNIILMSLLHLGALYGITLIPTCKFYTWLWGVFYYFVSALGITAGAHRLWSHRSYKARLPLRLFLIIANTMAFQNDVYEWARDHRAHHKFSETHADPHNSRRGFFFSHVGWLLVRKHPAVKEKGSTLDLSDLEAEKLVMFQRRYYKPGLLMMCFILPTLVPWYFWGETFQNSVFVATFLRYAVVLNATWLVNSAAHLFGYRPYDKNISPRENILVSLGAVGEGFHNYHHSFPYDYSASEYRWHINFTTFFIDCMAALGLAYDRKKVSKAAILARIKRTGDGNYKSG

SEQ ID NO: 3836 - protein, 330 aa, unidentified
MPGPATDAGKIPFCDAKEEIRAGLESSEGGGGPERPGARGQRQNIVWRNVVLMSLLHLGAVYSLVLIPKAKPLTLLWAYFCFLLAALGVTAGAHRLWSHRSYRAKLPLRIFLAVANSMAFQNDIFEWSRDHRAHHKYSETDADPHNARRGFFFSHIGWLFVRKHRDVIEKGRKLDVTDLLADPVVRIQRKYYKISVVLMCFVVPTLVPWYIWGESLWNSYFLASILRYTISLNISWLVNSAAHMYGNRPYDKHISPRQNPLVALGAIGEGFHNYHHTFPFDYSASEFGLNFNPTTWFIDFMCWLGLATDRKRATKPMIEARKARTGDSSA

SEQ ID NO: 3837 - protein, 145 aa, unidentified
MDTFTVQDSTAMSWWRNNFWIILAVAIIVVSVGLGLILYCVCKWQLRRGKKWEIAKPLKHKQVDEEKMYENVLNESPVQLPPLPPRNWPSLEDSSPQEAPSQPPATYSLVNKVKNKKTVSIPSYIEPEDDYDDVEIPANTEKASF

SEQ ID NO: 3838 - protein, 1956 aa, unidentified
MEFPIGSLETNNFRRFTPESLVEIEKQIAAKQGTKKAREKHREQKDQEEKPRPQLDLKACNQLPKFYGELPAELIGEPLEDLDPFYSTHRTFMVLNKGRTISRFSATRALWLFSPFNLIRRTAIKVSVHSWFSLFITVTILVNCVCMTRTDLPEKIEYVFTVIYTFEALIKILARGFCLNEFTYLRDPWNWLDFSVITLAYVGTAIDLRGISGLRTFRVLRALKTVSVIPGLKVIVGALIHSVKKLADVTILTIFCLSVFALVGLQLFKGNLKNKCVKNDMAVNETTNYSSHRKPDIYINKRGTSDPLLCGNGSDSGHCPDGYICLKTSDNPDFNYTSFDSFAWAFLSLFRLMTQDSWERLYQQTLRTSGKIYMIFFVLVIFLGSFYLVNLILAVVTMAYEEQNQATTDEIEAKEKKFQEALEMLRKEQEVLAALGIDTTSLHSHNGSPLTSKNASERRHRIKPRVSEGSTEDNKSPRSDPYNQRRMSFLGLASGKRRASHGSVFHFRSPGRDISLPEGVTDDGVFPGDHESHRGSLLLGGGAGQQGPLPRSPLPQPSNPDSRHGEDEHQPPPTSELAPGAVDVSAFDAGQKKTFLSAEYLDEPFRAQRAMSVVSIITSVLEELEESEQKCPPCLTSLSQKYLIWDCCPMWVKLKTILFGLVTDPFAELTITLCIVVNTIFMAMEHHGMSPTFEAMLQIGNIVFTIFFTAEMVFKIIAFDPYYYFQKKWNIFDCIIVTVSLLELGVAKKGSLSVLRSFRLLRVFKLAKSWPTLNTLIKIIGNSVGALGNLTIILAIIVFVFALVGKQLLGENYRNNRKNISAPHEDWPRWHMHDFFHSFLIVFRILCGEWIENMWACMEVGQKSICLILFLTVMVLGNLVVLNLFIALLLNSFSADNLTAPEDDGEVNNLQVALARIQVFGHRTKQALCSFFSRSCPFPQPKAEPELVVKLPLSSSKAENHIAANTARGSSGGLQAPRGPRDEHSDFIANPTVWVSVPIAEGESDLDDLEDDGGEDAQSFQQEVIPKGQQEQLQQVERCGDHLTPRSPGTGTSSEDLAPSLGETWKDESVPQVPAEGVDDTSSSEGSTVDCLDPEEILRKIPELADDLEEPDDCFTEGCIRHCPCCKLDTTKSPWDVGWQVRKTCYRIVEHSWFESFIIFMILLSSGSLAFEDYYLDQKPTVKALLEYTDRVFTFIFVFEMLLKWVAYGFKKYFTNAWCWLDFLIVNISLISLTAKILEYSEVAPIKALRTLRALRPLRALSRFEGMRVVVDALVGAIPSIMNVLLVCLIFWLIFSIMGVNLFAGKFWRCINYTDGEFSLVPLSIVNNKSDCKIQNSTGSFFWVNVKVNFDNVAMGYLALLQVATFKGWMDIMYAAVDSREVNMQPKWEDNVYMYLYFVIFIIFGGFFTLNLFVGVIIDNFNQQKKKLGGQDIFMTEEQKKYYNAMKKLGSKKPQKPIPRPLNKFQGFVFDIVTRQAFDITIMVLICLNMITMMVETDDQSEEKTKILGKINQFFVAVFTGECVMKMFALRQYYFTNGWNVFDFIVVVLSIASLIFSAILKSLQSYFSPTLFRVIRLARIGRILRLIRAAKGIRTLLFALMMSLPALFNIGLLLFLVMFIYSIFGMSSFPHVRWEAGIDDMFNFQTFANSMLCLFQITTSAGWDGLLSPILNTGPPYCDPNLPNSNGTRGDCGSPAVGIIFFTTYIIISFLIMVNMYIAVILENFNVATEESTEPLSEDDFDMFYETWEKFDPEATQFITFSALSDFADTLSGPLRIPKPNRNILIQMDLPLVPGDKIHCLDILFAFTKNVLGESGELDSLKANMEEKFMATNLSKSSYEPIATTLRWKQEDISATVIQKAYRSYVLHRSMALSNTPCVPRAEEEAASLPDEGFVAFTANENCVLPDKSETASATSFPPSYESVTRGLSDRVNMRTSSSIQNEDEATSMELIAPGP

SEQ ID NO: 3839 - protein, 1791 aa, unidentified
MDDRCYPVIFPDERNFRPFTSDSLAAIEKRIAIQKEKKKSKDQTGEVPQPRPQLDLKASRKLPKLYGDIPRELIGKPLEDLDPFYRNHKTFMVLNRKRTIYRFSAKHALFIFGPFNSIRSLAIRVSVHSLFSMFIIGTVIINCVFMATGPAKNSNSNNTDIAECVFTGIYIFEALIKILARGFILDEFSFLRDPWNWLDSIVIGIAIVSYIPGITIKLLPLRTFRVFRALKAISVVSRLKVIVGALLRSVKKLVNVIILTFFCLSIFALVGQQLFMGSLNLKCISRDCKNISNPEAYDHCFEKKENSPEFKMCGIWMGNSACSIQYECKHTKINPDYNYTNFDNFGWSFLAMFRLMTQDSWEKLYQQTLRTTGLYSVFFFIVVIFLGSFYLINLTLAVVTMAYEEQNKNVAAEIEAKEKMFQEAQQLLKEEKEALVAMGIDRSSLTSLETSYFTPKKRKLFGNKKRKSFFLRESGKDQPPGSDSDEDCQKKPQLLEQTKRLSQNLSLDHFDEHGDPLQRQRALSAVSILTITMKEQEKSQEPCLPCGENLASKYLVWNCCPQWLCVKKVLRTVMTDPFTELAITICIIINTVFLAMEHHKMEASFEKMLNIGNLVFTSIFIAEMCLKIIALDPYHYFRRGWNIFDSIVALLSFADVMNCVLQKRSWPFLRSFRVLRVFKLAKSWPTLNTLIKIIGNSVGALGSLTVVLVIVIFIFSVVGMQLFGRSFNSQKSPKLCNPTGPTVSCLRHWHMGDFWHSFLVVFRILCGEWIENMWECMQEANASSSLCVIVFILITVIGKLVVLNLFIALLLNSFSNEERNGNLEGEARKTKVQLALDRFRRAFCFVRHTLEHFCHKWCRKQNLPQQKEVAGGCAAQSKDIIPLVMEMKRGSETQEELGILTSVPKTLGVRHDWTWLAPLAEEEDDVEFSGEDNAQRITQPEPEQQAYELHQENKKPTSQRVQSVEIDMFSEDEPHLTIQDPRKKSDVTSILSECSTIDLQDGFGWLPEMVPKKQPERCLPKGFGCCFPCCSVDKRKPPWVIWWNLRKTCYQIVKHSWFESFIIFVILLSSGALIFEDVHLENQPKIQELLNCTDIIFTHIFILEMVLKWVAFGFGKYFTSAWCCLDFIIVIVSVTTLINLMELKSFRTLRALRPLRALSQFEGMKVVVNALIGAIPAILNVLLVCLIFWLVFCILGVYFFSGKFGKCINGTDSVINYTIITNKSQCESGNFSWINQKVNFDNVGNAYLALLQVATFKGWMDIIYAAVDSTEKEQQPEFESNSLGYIYFVVFIIFGSFFTLNLFIGVIIDNFNQQQKKLGGQDIFMTEEQKKYYNAMKKLGSKKPQKPIPRPLNKCQGLVFDIVTSQIFDIIIISLIILNMISMMAESYNQPKAMKSILDHLNWVFVVIFTLECLIKIFALRQYYFTNGWNLFDCVVVLLSIVSTMISTLENQEHIPFPPTLFRIVRLARIGRILRLVRAARGIRTLLFALMMSLPSLFNIGLLLFLIMFIYAILGMNWFSKVNPESGIDDIFNFKTFASSMLCLFQISTSAGWDSLLSPMLRSKESCNSSSENCHLPGIATSYFVSYIIISFLIVVNMYIAVILENFNTATEESEDPLGEDDFDIFYEVWEKFDPEATQFIKYSALSDFADALPEPLRVAKPNKYQFLVMDLPMVSEDRLHCMDILFAFTARVLGGSDGLDSMKAMMEEKFMEANPLKKLYEPIVTTTKRKEEERGAAIIQKAFRKYMMKVTKGDQGDQNDLENGPHSPLQTLCNGDLSSFGVAKGKVHCD

SEQ ID NO: 3840 - protein, 2009 aa, unidentified
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKGKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTAEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEESLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 3841 - protein, 218 aa, unidentified
MGRLLALVVGAALVSSACGGCVEVDSETEAVYGMTFKILCISCKRRSETNAETFTEWTFRQKGTEEFVKILRYENEVLQLEEDERFEGRVVWNGSRGTKDLQDLSIFITNVTYNHSGDYECHVYRLLFFENYEHNTSVVKKIHIEVVDKANRDMASIVSEIMMYVLIVVLTIWLVAEMIYCYKKIAAATETAAQENASEYLAITSESKENCTGVQVAE

SEQ ID NO: 3842 - protein, 2005 aa, unidentified
MAQSVLVPPGPDSFRFFTRESLAAIEQRIAEEKAKRPKQERKDEDDENGPKPNSDLEAGKSLPFIYGDIPPEMVSVPLEDLDPYYINKKTFIVLNKGKAISRFSATPALYILTPFNPIRKLAIKILVHSLFNMLIMCTILTNCVFMTMSNPPDWTKNVEYTFTGIYTFESLIKILARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCLQWPPDNSSFEINITSFFNNSLDGNGTTFNRTVSIFNWDEYIEDKSHFYFLEGQNDALLCGNSSDAGQCPEGYICVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMLEQLKKQQEEAQAAAAAASAESRDFSGAGGIGVFSESSSVASKLSSKSEKELKNRRKKKKQKEQSGEEEKNDRVRKSESEDSIRRKGFRFSLEGSRLTYEKRFSSPHQSLLSIRGSLFSPRRNSRASLFSFRGRAKDIGSENDFADDEHSTFEDNDSRRDSLFVPHRHGERRHSNVSQASRASRVLPILPMNGKMHSAVDCNGVVSLVGGPSTLTSAGQLLPEGTTTETEIRKRRSSSYHVSMDLLEDPTSRQRAMSIASILTNTMEELEESRQKCPPCWYKFANMCLIWDCCKPWLKVKHLVNLVVMDPFVDLAITICIVLNTLFMAMEHYPMTEQFSSVLSVGNLVFTGIFTAEMFLKIIAMDPYYYFQEGWNIFDGFIVSLSLMELGLANVEGLSVLRSFRLLRVFKLAKSWPTLNMLIKIIGNSVGALGNLTLVLAIIVFIFAVVGMQLFGKSYKECVCKISNDCELPRWHMHDFFHSFLIVFRVLCGEWIETMWDCMEVAGQTMCLTVFMMVMVIGNLVVLNLFLALLLSSFSSDNLAATDDDNEMNNLQIAVGRMQKGIDFVKRKIREFIQKAFVRKQKALDEIKPLEDLNNKKDSCISNHTTIEIGKDLNYLKDGNGTTSGIGSSVEKYVVDESDYMSFINNPSLTVTVPIAVGESDFENLNTEEFSSESDMEESKEKLNATSSSEGSTVDIGAPAEGEQPEVEPEESLEPEACFTEDCVRKFKCCQISIEEGKGKLWWNLRKTCYKIVEHNWFETFIVFMILLSSGALAFEDIYIEQRKTIKTMLEYADKVFTYIFILEMLLKWVAYGFQVYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINYTTGEMFDVSVVNNYSECKALIESNQTARWKNVKVNFDNVGLGYLSLLQVATFKGWMDIMYAAVDSRNVELQPKYEDNLYMYLYFVIFIIFGSFFTLNLFIGVIIDNFNQQKKKFGGQDIFMTEEQKKYYNAMKKLGSKKPQKPIPRPANKFQGMVFDFVTKQVFDISIMILICLNMVTMMVETDDQSQEMTNILYWINLVFIVLFTGECVLKLISLRYYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSGPPDCDPDKDHPGSSVKGDCGNPSVGIFFFVSYIIISFLVVVNMYIAVILENFSVATEESAEPLSEDDFEMFYEVWEKFDPDATQFIEFAKLSDFADALDPPLLIAKPNKVQLIAMDLPMVSGDRIHCLDILFAFTKRVLGESGEMDALRIQMEERFMASNPSKVSYEPITTTLKRKQEEVSAIIIQRAYRRYLLKQKVKKVSSIYKKDKGKECDGTPIKEDTLIDKLNENSTPEKTDMTPSTTSPPSYDSVTKPEKEKFEKDKSEKEDKGKDIRESKK

SEQ ID NO: 3843 - protein, 215 aa, unidentified
MHRDAWLPRPAFSLTGLSLFFSLVPPGRSMEVTVPATLNVLNGSDARLPCTFNSCYTVNHKQFSLNWTYQECNNCSEEMFLQFRMKIINLKLERFQDRVEFSGNPSKYDVSVMLRNVQPEDEGIYNCYIMNPPDRHRGHGKIHLQVLMEEPPERDSTVAVIVGASVGGFLAVVILVLMVVKCVRRKKEQKLSTDDLKTEEEGKTDGEGNPDDGAK

SEQ ID NO: 3844 - protein, 2000 aa, unidentified
MAQALLVPPGPESFRLFTRESLAAIEKRAAEEKAKKPKKEQDNDDENKPKPNSDLEAGKNLPFIYGDIPPEMVSEPLEDLDPYYINKKTFIVMNKGKAIFRFSATSALYILTPLNPVRKIAIKILVHSLFSMLIMCTILTNCVFMTLSNPPDWTKNVEYTFTGIYTFESLIKILARGFCLEDFTFLRDPWNWLDFSVIVMAYVTEFVSLGNVSALRTFRVLRALKTISVIPGLKTIVGALIQSVKKLSDVMILTVFCLSVFALIGLQLFMGNLRNKCLQWPPSDSAFETNTTSYFNGTMDSNGTFVNVTMSTFNWKDYIGDDSHFYVLDGQKDPLLCGNGSDAGQCPEGYICVKAGRNPNYGYTSFDTFSWAFLSLFRLMTQDYWENLYQLTLRAAGKTYMIFFVLVIFLGSFYLVNLILAVVAMAYEEQNQATLEEAEQKEAEFQQMLEQLKKQQEEAQAVAAASAASRDFSGIGGLGELLESSSEASKLSSKSAKEWRNRRKKRRQREHLEGNNKGERDSFPKSESEDSVKRSSFLFSMDGNRLTSDKKFCSPHQSLLSIRGSLFSPRRNSKTSIFSFRGRAKDVGSENDFADDEHSTFEDSESRRDSLFVPHRHGERRNSNVSQASMSSRMVPGLPANGKMHSTVDCNGVVSLVGGPSALTSPTGQLPPEGTTTETEVRKRRLSSYQISMEMLEDSSGRQRAVSIASILTNTMEELEESRQKCPPCWYRFANVFLIWDCCDAWLKVKHLVNLIVMDPFVDLAITICIVLNTLFMAMEHYPMTEQFSSVLTVGNLVFTGIFTAEMVLKIIAMDPYYYFQEGWNIFDGIIVSLSLMELGLSNVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQTMCLIVFMLVMVIGNLVVLNLFLALLLSSFSSDNLAATDDDNEMNNLQIAVGRMQKGIDYVKNKMRECFQKAFFRKPKVIEIHEGNKIDSCMSNNTGIEISKELNYLRDGNGTTSGVGTGSSVEKYVIDENDYMSFINNPSLTVTVPIAVGESDFENLNTEEFSSESELEESKEKLNATSSSEGSTVDVVLPREGEQAETEPEEDLKPEACFTEGCIKKFPFCQVSTEEGKGKIWWNLRKTCYSIVEHNWFETFIVFMILLSSGALAFEDIYIEQRKTIKTMLEYADKVFTYIFILEMLLKWVAYGFQTYFTNAWCWLDFLIVDVSLVSLVANALGYSELGAIKSLRTLRALRPLRALSRFEGMRVVVNALVGAIPSIMNVLLVCLIFWLIFSIMGVNLFAGKFYHCVNMTTGNMFDISDVNNLSDCQALGKQARWKNVKVNFDNVGAGYLALLQVATFKGWMDIMYAAVDSRDVKLQPVYEENLYMYLYFVIFIIFGSFFTLNLFIGVIIDNFNQQKKKFGGQDIFMTEEQKKYYNAMKKLGSKKPQKPIPRPANKFQGMVFDFVTRQVFDISIMILICLNMVTMMVETDDQGKYMTLVLSRINLVFIVLFTGEFVLKLVSLRHYYFTIGWNIFDFVVVILSIVGMFLAEMIEKYFVSPTLFRVIRLARIGRILRLIKGAKGIRTLLFALMMSLPALFNIGLLLFLVMFIYAIFGMSNFAYVKKEAGIDDMFNFETFGNSMICLFQITTSAGWDGLLAPILNSAPPDCDPDTIHPGSSVKGDCGNPSVGIFFFVSYIIISFLVVVNMYIAVILENFSVATEESAEPLSEDDFEMFYEVWEKFDPDATQFIEFSKLSDFAAALDPPLLIAKPNKVQLIAMDLPMVSGDRIHCLDILFAFTKRVLGESGEMDALRIQMEDRFMASNPSKVSYEPITTTLKRKQEEVSAAIIQRNFRCYLLKQRLKNISSNYNKEAIKGRIDLPIKQDMIIDKLNGNSTPEKTDGSSSTTSPPSYDSVTKPDKEKFEKDKPEKESKGKEVRENQK

SEQ ID NO: 3845 - protein, 215 aa, unidentified
MPAFNRLFPLASLVLIYWVSVCFPVCVEVPSETEAVQGNPMKLRCISCMKREEVEATTVVEWFYRPEGGKDFLIYEYRNGHQEVESPFQGRLQWNGSKDLQDVSITVLNVTLNDSGLYTCNVSREFEFEAHRPFVKTTRLIPLRVTEEAGEDFTSVVSEIMMYILLVFLTLWLLIEMIYCYRKVSKAEEAAQENASDYLAIPSENKENSAVPVEE

SEQ ID NO: 3846 - protein, 1836 aa, unidentified
MARPSLCTLVPLGPECLRPFTRESLAAIEQRAVEEEARLQRNKQMEIEEPERKPRSDLEAGKNLPMIYGDPPPEVIGIPLEDLDPYYSNKKTFIVLNKGKAIFRFSATPALYLLSPFSVVRRGAIKVLIHALFSMFIMITILTNCVFMTMSDPPPWSKNVEYTFTGIYTFESLIKILARGFCVDDFTFLRDPWNWLDFSVIMMAYLTEFVDLGNISALRTFRVLRALKTITVIPGLKTIVGALIQSVKKLSDVMILTVFCLSVFALVGLQLFMGNLRQKCVRWPPPFNDTNTTWYSNDTWYGNDTWYGNEMWYGNDSWYANDTWNSHASWATNDTFDWDAYISDEGNFYFLEGSNDALLCGNSSDAGHCPEGYECIKTGRNPNYGYTSYDTFSWAFLALFRLMTQDYWENLFQLTLRAAGKTYMIFFVVIIFLGSFYLINLILAVVAMAYAEQNEATLAEDKEKEEEFQQMLEKFKKHQEELEKAKAAQALEGGEADGDPAHGKDCNGSLDTSQGEKGAPRQSSSGDSGISDAMEELEEAHQKCPPWWYKCAHKVLIWNCCAPWLKFKNIIHLIVMDPFVDLGITICIVLNTLFMAMEHYPMTEHFDNVLTVGNLVFTGIFTAEMVLKLIAMDPYEYFQQGWNIFDSIIVTLSLVELGLANVQGLSVLRSFRLLRVFKLAKSWPTLNMLIKIIGNSVGALGNLTLVLAIIVFIFAVVGMQLFGKSYKECVCKIALDCNLPRWHMHDFFHSFLIVFRILCGEWIETMWDCMEVAGQAMCLTVFLMVMVIGNLVVLNLFLALLLSSFSADSLAASDEDGEMNNLQIAIGRIKLGIGFAKAFLLGLLHGKILSPKDIMLSLGEADGAGEAGEAGETAPEDEKKEPPEEDLKKDNHILNHMGLADGPPSSLELDHLNFINNPYLTIQVPIASEESDLEMPTEEETDTFSEPEDSKKPPQPLYDGNSSVCSTADYKPPEEDPEEQAEENPEGEQPEECFTEACVQRWPCLYVDISQGRGKKWWTLRRACFKIVEHNWFETFIVFMILLSSGALAFEDIYIEQRRVIRTILEYADKVFTYIFIMEMLLKWVAYGFKVYFTNAWCWLDFLIVDVSIISLVANWLGYSELGPIKSLRTLRALRPLRALSRFEGMRVVVNALLGAIPSIMNVLLVCLIFWLIFSIMGVNLFAGKFYYCINTTTSERFDISEVNNKSECESLMHTGQVRWLNVKVNYDNVGLGYLSLLQVATFKGWMDIMYAAVDSREKEEQPQYEVNLYMYLYFVIFIIFGSFFTLNLFIGVIIDNFNQQKKKLGGKDIFMTEEQKKYYNAMKKLGSKKPQKPIPRPQNKIQGMVYDLVTKQAFDITIMILICLNMVTMMVETDNQSQLKVDILYNINMIFIIIFTGECVLKMLALRQYYFTVGWNIFDFVVVILSIVGLALSDLIQKYFVSPTLFRVIRLARIGRVLRLIRGAKGIRTLLFALMMSLPALFNIGLLLFLVMFIYSIFGMSNFAYVKKESGIDDMFNFETFGNSIICLFEITTSAGWDGLLNPILNSGPPDCDPNLENPGTSVKGDCGNPSIGICFFCSYIIISFLIVVNMYIAIILENFNVATEESSEPLGEDDFEMFYETWEKFDPDATQFIAYSRLSDFVDTLQEPLRIAKPNKIKLITLDLPMVPGDKIHCLDILFALTKEVLGDSGEMDALKQTMEEKFMAANPSKVSYEPITTTLKRKHEEVCAIKIQRAYRRHLLQRSMKQASYMYRHSHDGSGDDAPEKEGLLANTMSKMYGHENGNSSSPSPEEKGEAGDAGPTMGLMPISPSDTAWPPAPPPGQTVRPGVKESLV

SEQ ID NO: 3847 - protein, 228 aa, unidentified
MPGAGDGGKAPARWLGTGLLGLFLLPVTLSLEVSVGKATDIYAVNGTEILLPCTFSSCFGFEDLHFRWTYNSSDAFKILIEGTVKNEKSDPKVTLKDDDRITLVGSTKEKMNNISIVLRDLEFSDTGKYTCHVKNPKENNLQHHATIFLQVVDRLEEVDNTVTLIILAVVGGVIGLLILILLIKKLIIFILKKTREKKKECLVSSSGNDNTENGLPGSKAEEKPPSKV

SEQ ID NO: 3848 - protein, 2016 aa, unidentified [sequence omitted]

SEQ ID NO: 3849 - protein, 1682 aa, unidentified
MLASPEPKGLVPFTKESFELIKQHIAKTHNEDHEEEDLKPTPDLEVGKKLPFIYGNLSQGMVSEPLEDVDPYYYKKKNTFIVLNKNRTIFRFNAASILCTLSPFNCIRRTTIKVLVHPFFQLFILISVLIDCVFMSLTNLPKWRPVLENTLLGIYTFEILVKLFARGVWAGSFSFLGDPWNWLDFSVTVFEVIIRYSPLDFIPTLQTARTLRILKIIPLNQGLKSLVGVLIHCLKQLIGVIILTLFFLSIFSLIGMGLFMGNLKHKCFRWPQENENETLHNRTGNPYYIRETENFYYLEGERYALLCGNRTDAGQCPEGYVCVKAGINPDQGFTNFDSFGWALFALFRLMAQDYPEVLYHQILYASGKVYMIFFVVVSFLFSFYMASLFLGILAMAYEEEKQRVGEISKKIEPKFQQTGKELQEGNETDEAKTIQIEMKKRSPISTDTSLDVLEDATLRHKEELEKSKKICPLYWYKFAKTFLIWNCSPCWLKLKEFVHRIIMAPFTDLFLIICIILNVCFLTLEHYPMSKQTNTLLNIGNLVFIGIFTAEMIFKIIAMHPYGYFQVGWNIFDSMIVFHGLIELCLANVAGMALLRLFRMLRIFKLGKYWPTFQILMWSLSNSWVALKDLVLLLFTFIFFSAAFGMKLFGKNYEEFVCHIDKDCQLPRWHMHDFFHSFLNVFRILCGEWVETLWDCMEVAGQSWCIPFYLMVILIGNLLVLYLFLALVSSFSSCKDVTAEENNEAKNLQLAVARIKKGINYVLLKILCKTQNVPKDTMDHVNEVYVKEDISDHTLSELSNTQDFLKDKEKSSGTEKNATENESQSLIPSPSVSETVPIASGESDIENLDNKEIQSKSGDGGSKEKIKQSSSSECSTVDIAISEEEEMFYGGERSKHLKNGCRRGSSLGQISGASKKGKIWQNIRKTCCKIVENNWFKCFIGLVTLLSTGTLAFEDIYMDQRKTIKILLEYADMIFTYIFILEMLLKWMAYGFKAYFSNGWYRLDFVVVIVFCLSLIGKTREELKPLISMKFLRPLRVLSQFERMKVVVRALIKTTLPTLNVFLVCLMIWLIFSIMGVDLFAGRFYECIDPTSGERFPSSEVMNKSRCESLLFNESMLWENAKMNFDNVGNGFLSLLQVATFNGWITIMNSAIDSVAVNIQPHFEVNIYMYCYFINFIIFGVFLPLSMLITVIIDNFNKHKIKLGGSNIFITVKQRKQYRRLKKLMYEDSQRPVPRPLNKLQGFIFDVVTSQAFNVIVMVLICFQAIAMMIDTDVQSLQMSIALYWINSIFVMLYTMECILKLIAFRCFYFTIAWNIFDFMVVIFSITGLCLPMTVGSYLVPPSLVQLILLSRIIHMLRLGKGPKVFHNLMLPLMLSLPALLNIILLIFLVMFIYAVFGMYNFAYVKKEAGINDVSNFETFGNSMLCLFQVAIFAGWDGMLDAIFNSKWSDCDPDKINPGTQVRGDCGNPSVGIFYFVSYILISWLIIVNMYIVVVMEFLNIASKKKNKTLSEDDFRKFFQVWKRFDPDRTQYIDSSKLSDFAAALDPPLFMAKPNKGQLIALDLPMAVGDRIHCLDILLAFTKRVMGQDVRMEKVVSEIESGFLLANPFKITCEPITTTLKRKQEAVSATIIQRAYKNYRLRRNDKNTSDIHMIDGDRDVHATKEGAYFDKAKEKSPIQSQI

SEQ ID NO: 3850 - protein, 1980 aa, unidentified
MAARLLAPPGPDSFKPFTPESLANIERRIAESKLKKPPKADGSHREDDEDSKPKPNSDLEAGKSLPFIYGDIPQGLVAVPLEDFDPYYLTQKTFVVLNRGKTLFRFSATPALYILSPFNLIRRIAIKILIHSVFSMIIMCTILTNCVFMTFSNPPDWSKNVEYTFTGIYTFESLVKIIARGFCIDGFTFLRDPWNWLDFSVIMMAYITEFVNLGNVSALRTFRVLRALKTISVIPGLKTIVGALIQSVKKLSDVMILTVFCLSVFALIGLQLFMGNLRNKCVVWPINFNESYLENGTKGFDWEEYINNKTNFYTVPGMLEPLLCGNSSDAGQCPEGYQCMKAGRNPNYGYTSFDTFSWAFLALFRLMTQDYWENLYQLTLRAAGKTYMIFFVLVIFVGSFYLVNLILAVVAMAYEEQNQATLEEAEQKEAEFKAMLEQLKKQQEEAQAAAMATSAGTVSEDAIEEEGEEGGGSPRSSSEISKLSSKSAKERRNRRKKRKQKELSEGEEKGDPEKVFKSESEDGMRRKAFRLPDNRIGRKFSIMNQSLLSIPGSPFLSRHNSKSSIFSFRGPGRFRDPGSENEFADDEHSTVEESEGRRDSLFIPIRARERRSSYSGYSGYSQGSRSSRIFPSLRRSVKRNSTVDCNGVVSLIGGPGSHIGGRLLPEATTEVEIKKKGPGSLLVSMDQLASYGRKDRINSIMSVVTNTLVEELEESQRKCPPCWYKFANTFLIWECHPYWIKLKEIVNLIVMDPFVDLAITICIVLNTLFMAMEHHPMTPQFEHVLAVGNLVFTGIFTAEMFLKLIAMDPYYYFQEGWNIFDGFIVSLSLMELSLADVEGLSVLRSFRLLRVFKLAKSWPTLNMLIKIIGNSVGALGNLTLVLAIIVFIFAVVGMQLFGKSYKECVCKINQDCELPRWHMHDFFHSFLIVFRVLCGEWIETMWDCMEVAGQAMCLIVFMMVMVIGNLVVLNLFLALLLSSFSADNLAATDDDGEMNNLQISVIRIKKGVAWTKLKVHAFMQAHFKQREADEVKPLDELYEKKANCIANHTGADIHRNGDFQKNGNGTTSGIGSSVEKYIIDEDHMSFINNPNLTVRVPIAVGESDFENLNTEDVSSESDPEGSKDKLDDTSSSEGSTIDIKPEVEEVPVEQPEEYLDPDACFTEGCVQRFKCCQVNIEEGLGKSWWILRKTCFLIVEHNWFETFIIFMILLSSGALAFEDIYIEQRKTIRTILEYADKVFTYIFILEMLLKWTAYGFVKFFTNAWCWLDFLIVAVSLVSLIANALGYSELGAIKSLRTLRALRPLRALSRFEGMRVVVNALVGAIPSIMNVLLVCLIFWLIFSIMGVNLFAGKYHYCFNETSEIRFEIEDVNNKTECEKLMEGNNTEIRWKNVKINFDNVGAGYLALLQVATFKGWMDIMYAAVDSRKPDEQPKYEDNIYMYIYFVIFIIFGSFFTLNLFIGVIIDNFNQQKKKFGGQDIFMTEEQKKYYNAMKKLGSKKPQKPIPRPLNKIQGIVFDFVTQQAFDIVIMMLICLNMVTMMVETDTQSKQMENILYWINLVFVIFFTCECVLKMFALRHYYFTIGWNIFDFVVVILSIVGMFLADIIEKYFVSPTLFRVIRLARIGRILRLIKGAKGIRTLLFALMMSLPALFNIGLLLFLVMFIFSIFGMSNFAYVKHEAGIDDMFNFETFGNSMICLFQITTSAGWDGLLLPILNRPPDCSLDKEHPGSGFKGDCGNPSVGIFFFVSYIIISFLIVVNMYIAIILENFSVATEESADPLSEDDFETFYEIWEKFDPDATQFIEYCKLADFADALEHPLRVPKPNTIELIAMDLPMVSGDRIHCLDILFAFTKRVLGDSGELDILRQQMEERFVASNPSKVSYEPITTTLRRKQEEVSAVVLQRAYRGHLARRGFICKKTTSNKLENGGTHREKKESTPSTASLPSYDSVTKPEKEKQQRAEEGRRERAKRQKEVRESKC

SEQ ID NO: 3851 - protein, 1988 aa, unidentified
MAMLPPPGPQSFVHFTKQSLALIEQRIAERKSKEPKEEKKDDDEEAPKPSSDLEAGKQLPFIYGDIPPGMVSEPLEDLDPYYADKKTFIVLNKGKTIFRFNATPALYMLSPFSPLRRISIKILVHSLFSMLIMCTILTNCIFMTMNNPPDWTKNVEYTFTGIYTFESLVKILARGFCVGEFTFLRDPWNWLDFVVIVFAYLTEFVNLGNVSALRTFRVLRALKTISVIPGLKTIVGALIQSVKKLSDVMILTVFCLSVFALIGLQLFMGNLKHKCFRNSLENNETLESIMNTLESEEDFRKYFYYLEGSKDALLCGFSTDSGQCPEGYTCVKIGRNPDYGYTSFDTFSWAFLALFRLMTQDYWENLYQQTLRAAGKTYMIFFVVVIFLGSFYLINLILAVVAMAYEEQNQANIEEAKQKELEFQQMLDRLKKEQEEAEAIAAAAAEYTSIRRSRIMGLSESSSETSKLSSKSAKERRNRRKKKNQKKLSSGEEKGDAEKLSKSESEDSIRRKSFHLGVEGHRRAHEKRLSTPNQSPLSIRGSLFSARRSSRTSLFSFKGRGRDIGSETEFADDEHSIFGDNESRRGSLFVPHRPQERRSSNISQASRSPPMLPVNGKMHSAVDCNGVVSLVDGRSALMLPNGQLLPEVIIDKATSDDSGTTNQIHKKRRCSSYLLSEDMLNDPNLRQRAMSRASILTNTVEELEESRQKCPPWWYRFAHKFLIWNCSPYWIKFKKCIYFIVMDPFVDLAITICIVLNTLFMAMEHHPMTEEFKNVLAIGNLVFTGIFAAEMVLKLIAMDPYEYFQVGWNIFDSLIVTLSLVELFLADVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQAMCLIVYMMVMVIGNLVVLNLFLALLLSSFSSDNLTAIEEDPDANNLQIAVTRIKKGINYVKQTLREFILKAFSKKPKISREIRQAEDLNTKKENYISNHTLAEMSKGHNFLKEKDKISGFGSSVDKHLMEDSDGQSFIHNPSLTVTVPIAPGESDLENMNAEELSSDSDSEYSKVRLNRSSSSECSTVDNPLPGEGEEAEAEPMNSDEPEACFTDGCVWRFSCCQVNIESGKGKIWWNIRKTCYKIVEHSWFESFIVLMILLSSGALAFEDIYIERKKTIKIILEYADKIFTYIFILEMLLKWIAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYECINTTDGSRFPASQVPNRSECFALMNVSQNVRWKNLKVNFDNVGLGYLSLLQVATFKGWTIIMYAAVDSVNVDKQPKYEYSLYMYIYFVVFIIFGSFFTLNLFIGVIIDNFNQQKKKLGGQDIFMTEEQKKYYNAMKKLGSKKPQKPIPRPGNKIQGCIFDLVTNQAFDISIMVLICLNMVTMMVEKEGQSQHMTEVLYWINVVFIILFTGECVLKLISLRHYYFTVGWNIFDFVVVIISIVGMFLADLIETYFVSPTLFRVIRLARIGRILRLVKGAKGIRTLLFALMMSLPALFNIGLLLFLVMFIYAIFGMSNFAYVKKEDGINDMFNFETFGNSMICLFQITTSAGWDGLLAPILNSKPPDCDPKKVHPGSSVEGDCGNPSVGIFYFVSYIIISFLVVVNMYIAVILENFSVATEESTEPLSEDDFEMFYEVWEKFDPDATQFIEFSKLSDFAAALDPPLLIAKPNKVQLIAMDLPMVSGDRIHCLDILFAFTKRVLGESGEMDSLRSQMEERFMSANPSKVSYEPITTTLKRKQEDVSATVIQRAYRRYRLRQNVKNISSIYIKDGDRDDDLLNKKDMAFDNVNENSSPEKTDATSSTTSPPSYDSVTKPDKEKYEQDRTEKEDKGKDSKESKK

SEQ ID NO: 3852 - protein, 669 aa, unidentified
MEGNKLEEQDSSPPQSTPGLMKGNKREEQGLGPEPAAPQQPTAEEEALIEFHRSYRELFEFFCNNTTIHGAIRLVCSQHNRMKTAFWAVLWLCTFGMMYWQFGLLFGEYFSYPVSLNINLNSDKLVFPAVTICTLNPYRYPEIKEELEELDRITEQTLFDLYKYSSFTTLVAGSRSRRDLRGTLPHPLQRLRVPPPPHGARRARSVASSLRDNNPQVDWKDWKIGFQLCNQNKSDCFYQTYSSGVDAVREWYRFHYINILSRLPETLPSLEEDTLGNFIFACRFNQVSCNQANYSHFHHPMYGNCYTFNDKNNSNLWMSSMPGINNGLSLMLRAEQNDFIPLLSTVTGARVMVHGQDEPAFMDDGGFNLRPGVETSISMRKETLDRLGGDYGDCTKNGSDVPVENLYPSKYTQQVCIHSCFQESMIKECGCAYIFYPRPQNVEYCDYRKHSSWGYCYYKLQVDFSSDHLGCFTKCRKPCSVTSYQLSAGYSRWPSVTSQEWVFQMLSRQNNYTVNNKRNGVAKVNIFFKELNYKTNSESPSVTMVTLLSNLGSQWSLWFGSSVLSVVEMAELVFDLLVIMFLMLLRRFRSRYWSPGRGGRGAQEVASTLASSPPSHFCPHPMSLSLSQPGPAPSPALTAPPPAYATLGPRPSPGGSAGASSSTCPLGGP

SEQ ID NO: 3853 - protein, 640 aa, unidentified
MHVKKYLLKGLHRLQKGPGYTYKELLVWYCDNTNTHGPKRIICEGPKKKAMWFLLTLLFAALVCWQWGIFIRTYLSWEVSVSLSVGFKTMDFPAVTICNASPFKYSKIKHLLKDLDELMEAVLERILAPELSHANATRNLNFSIWNHTPLVLIDERNPHHPMVLDLFGDNHNGLTSSSASEKICNAHGCKMAMRLCSLNRTQCTFRNFTSATQALTEWYILQATNIFAQVPQQELVEMSYPGEQMILACLFGAEPCNYRNFTSIFYPHYGNCYIFNWGMTEKALPSANPGTEFGLKLILDIGQEDYVPFLASTAGVRLMLHEQRSYPFIRDEGIYAMSGTETSIGVLVDKLQRMGEPYSPCTVNGSEVPVQNFYSDYNTTYSIQACLRSCFQDHMIRNCNCGHYLYPLPRGEKYCNNRDFPDWAHCYSDLQMSVAQRETCIGMCKESCNDTQYKMTISMADWPSEASEDWIFHVLSQERDQSTNITLSRKGIVKLNIYFQEFNYRTIEESAANNIVWLLSNLGGQFGFWMGGSVLCLIEFGEIIIDFVWITIIKLVALAKSLRQRRAQASYAGPPPTVAELVEAHTNFGFQPDTAPRSPNTGPYPSEQALPIPGTPPPNYDSLRLQPLDVIESDSEGDAI

SEQ ID NO: 3854 - protein, 802 aa, unidentified
MRAVLSQKTTPLPRYLWPGHLSGPRRLTWSWCSDHRTPTCRELGSPHPTPCTGPARGWPRRGGGPCGFTSAGHVLCGYPLCLLSGPIQGCGTGLGDSSMAFLSRTSPVAAASFQSRQEARGSILLQSCQLPPQWLSTEAWTGEWKQPHGGALTSRSPGPVAPQRPCHLKGWQHRPTQHNAACKQGQAAAQTPPRPGPPSAPPPPPKEGHQEGLVELPASFRELLTFFCTNATIHGAIRLVCSRGNRLKTTSWGLLSLGALVALCWQLGLLFERHWHRPVLMAVSVHSERKLLPLVTLCDGNPRRPSPVLRHLELLDEFARENIDSLYNVNLSKGRAALSATVPRHEPPFHLDREIRLQRLSHSGSRVRVGFRLCNSTGGDCFYRGYTSGVAAVQDWYHFHYVDILALLPAAWEDSHGSQDGHFVLSCSYDGLDCQARQFRTFHHPTYGSCYTVDGVWTAQRPGITHGVGLVLRVEQQPHLPLLSTLAGIRVMVHGRNHTPFLGHHSFSVRPGTEATISIREDEVHRLGSPYGHCTAGGEGVEVELLHNTSYTRQACLVSCFQQLMVETCSCGYYLHPLPAGAEYCSSARHPAWGHCFYRLYQDLETHRLPCTSRCPRPCRESAFKLSTGTSRWPSAKSAGWTLATLGEQGLPHQSHRQRSSLAKINIVYQELNYRSVEEAPVYSVPQLLSAMGSLCSLWFGASVLSLLELLELLLDASALTLVLGGRRLRRAWFSWPRASPASGASSIKPEASQMPPPAGGTSDDPEPSGPHLPRVMLPGVLAGVSAEESWAGPQPLETLDT

SEQ ID NO: 3855 - protein, 649 aa, unidentified
MAPGEKIKAKIKKNLPVTGPQAPTIKELMRWYCLNTNTHGCRRIVVSRGRLRRLLWIGFTLTAVALILWQCALLVFSFYTVSVSIKVHFRKLDFPAVTICNINPYKYSTVRHLLADLEQETREALKSLYGFPESRKRREAESWNSVSEGKQPRFSHRIPLLIFDQDEKGKARDFFTGRKRKVGGSIIHKASNVMHIESKQVVGFQLCSNDTSDCATYTFSSGINAIQEWYKLHYMNIMAQVPLEKKINMSYSAEELLVTCFFDGVSCDARNFTLFHHPMHGNCYTFNNRENETILSTSMGGSEYGLQVILYINEEEYNPFLVSSTGAKVIIHRQDEYPFVEDVGTEIETAMVTSIGMHLTESFKLSEPYSQCTEDGSDVPIRNIYNAAYSLQICLHSCFQTKMVEKCGCAQYSQPLPPAANYCNYQQHPNWMYCYYQLHRAFVQEELGCQSVCKEACSFKEWTLTTSLAQWPSVVSEKWLLPVLTWDQGRQVNKKLNKTDLAKLLIFYKDLNQRSIMESPANSIEMLLSNFGGQLGLWMSCSVVCVIEIIEVFFIDFFSIIARRQWQKAKEWWAWKQAPPCPEAPRSPQGQDNPALDIDDDLPTFNSALHLPPALGTQVPGTPPPKYNTLRLERAFSNQLTDTQMLDEL

SEQ ID NO: 3856 - protein, 301 aa, unidentified
MAMLVLVPGRVMRPLGGQLWRFLPRGLEFWGPAEGTARVLLRQFCARQAEAWRASGRPGYCLGTRPLSTARPPPPWSQKGPGDSTRPSKPGPVSWKSLAITFAIGGALLAGMKHVKKEKAEKLEKERQRHIGKPLLGGPFSLTTHTGERKTDKDYLGQWLLIYFGFTHCPDVCPEELEKMIQVVDEIDSITTLPDLTPLFISIDPERDTKEAIANYVKEFSPKLVGLTGTREEVDQVARAYRVYYSPGPKDEDEDYIVDHTIIMYLIGPDGEFLDYFGQNKRKGEIAASIATHMRPYRKKS

SEQ ID NO: 3857 - protein, 266 aa, unidentified
MLLLTRSPTAWHRLSQLKPRVLPGTLGGQALHLRSWLLSRQGPAETGGQGQPQGPGLRTRLLITGLFGAGLGGAWLALRAEKERLQQQKRTEALRQAAVGQGDFHLLDHRGRARCKADFRGQWVLMYFGFTHCPDICPDELEKLVQVVRQLEAEPGLPPVQPVFITVDPERDDVEAMARYVQDFHPRLLGLTGSTKQVAQASHSYRVYYNAGPKDEDQDYIVDHSIAIYLLNPDGLFTDYYGRSRSAEQISDSVRRHMAAFRSVLS

SEQ ID NO: 3858 - protein, 440 aa, unidentified
MRPHLSPPLQQLLLPVLLACAAHSTGALPRLCDVLQVLWEEQDQCLQELSREQTGDLGTEQPVPGCEGMWDNISCWPSSVPGRMVEVECPRFLRMLTSRNGSLFRNCTQDGWSETFPRPNLACGVNVNDSSNEKRHSYLLKLKVMYTVGYSSSLVMLLVALGILCAFRRLHCTRNYIHMHLFVSFILRALSNFIKDAVLFSSDDVTYCDAHRAGCKLVMVLFQYCIMANYSWLLVEGLYLHTLLAISFFSERKYLQGFVAFGWGSPAIFVALWAIARHFLEDVGCWDINANASIWWIIRGPVILSILINFILFINILRILMRKLRTQETRGNEVSHYKRLARSTLLLIPLFGIHYIVFAFSPEDAMEIQLFFELALGSFQGLVVAVLYCFLNGEVQLEVQKKWQQWHLREFPLHPVASFSNSTKASHLEQSQGTCRTSII

SEQ ID NO: 3859 - protein, 310 aa, unidentified
MRRAALWLWLCALALSLQPALPQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHLASTTTATTAQEPATSHPHRDMQPGHHETSTPAGPSQADLHTPHTEDGGPSATERAAEDGASSQLPAAEGSGEQDFTFETSGENTAVVAVEPDRRNQSPVDQGATGASQGLLDRKEVLGGVIAGGLVGLIFAVCLVGFMLYRMKKKDEGSYSLEEPKQANGGAYQKPTKQEEFYA

SEQ ID NO: 3860 - protein, 201 aa, unidentified
MRRAWILLTLGLVACVSAESRAELTSDKDMYLDNSSIEEASGVYPIDDDDYASASGSGADEDVESPELTTSRPLPKILLTSAAPKVETTTLNIQNKIPAQTKSPEETDKEKVHLSDSERKMDPAEEDTNVYTEKHSDSLFKRTEVLAAVIAGGVIGFLFAIFLILLLVYRMRKKDEGSYDLGERKPSSAAYQKAPTKEFYA

SEQ ID NO: 3861 - protein, 442 aa, unidentified
MKPGPPHRAGAAHGAGAGAGAAAGPGARGLLLPPLLLLLLAGRAAGAQRWRSENFERPVDLEGSGDDDSFPDDELDDLYSGSGSGYFEQESGIETAMRFSPDVALAVSTTPAVLPTTNIQPVGTPFEELPSERPTLEPATSPLVVTEVPEEPSQRATTVSTTMATTAATSTGDPTVATVPATVATATPSTPAAPPFTATTAVIRTTGVRRLLPLPLTTVATARATTPEAPSPPTTAAVLDTEAPTPRLVSTATSRPRALPRPATTQEPDIPERSTLPLGTTAPGPTEVAQTPTPETFLTTIRDEPEVPVSGGPSGDFELPEEETTQPDTANEVVAVGGAAAKASSPPGTLPKGARPGPGLLDNAIDSGSSAAQLPQKSILERKEVLVAVIVGGVVGALFAAFLVTLLIYRMKKKDEGSYTLEEPKQASVTYQKPDKQEEFYA

SEQ ID NO: 3862 - protein, 169 aa, unidentified
MAALLLRHVGRHCLRAHFSPQLCIRNAVPLGTTAKEEMERFWNKNIGSNRPLSPHITIYSWSLPMAMSICHRGTGIALSAGVSLFGMSALLLPGNFESYLELVKSLCLGPALIHTAKFALVFPLMYHTWNGIRHLMWDLGKGLKIPQLYQSGVVVLVLTVLSSMGLAAM

SEQ ID NO: 3863 - protein, 159 aa, unidentified
MAVLWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGHWGLGQVVTDYVHGDALQKAAKAGLLALSALTFAGLCYFNYHDVGICKAVAMLWKL

SEQ ID NO: 3864 - protein, 2213 aa, unidentified
MARGARPSAAGGGGGGAEPPERAGPGRPRGSPPGRARPSLAPRPGPEPSRPRAAPETSGGDTAGAGRCGGRRAAKLGPGRRGWWALLALQLHLLRALAQDDVAPYFKTEPGLPQIHLEGNRLVLTCLAEGSWPLEFKWMRDDSELTTYSSEYKYIIPSLQKLDAGFYRCVVRNRMGALLQRKSEVQVAYMGSFMDTDQRKTVSQGRAAILNLLPITSYPRPQVTWFREGHKIIPSNRIAITLENQLVILATTTSDAGAYYVQAVNEKNGENKTSPFIHLSIARDVGTPETMAPTIVVPPGNRSVVAGSSETTLECIASARPVEDLSVTWKRNGVRITSGLHSFGRRLTISNPTSADTGPYVCEAALPGSAFEPARATAFLFIIEPPYFTAEPESRISAEVEETVDIGCQAMGVPLPTLQWYKDAISISRLQNPRYKVLASGGLRIQKLRPEDSGIFQCFASNEGGEIQTHTYLDVTNIAPVFTQRPVDTTVTDGMTAILRCEVSGAPKPAITWKRENHILASGSVRIPRFMLLESGGLQIAPVFIQDAGNYTCYAANTEGSLNASATLTVWNRTSIVHPPEDHVVIKGTTATLHCGATHDPRVSLRYVWKKDNVALTPSSTSRIVVEKDGSLLISQTWSGDIGDYSCEIVSEGGNDSRMARLEVIELPHSPQNLLVSPNSSHSHAVVLSWVRPFDGNSPILYYIVELSENNSPWKVHLSNVGPEMTGVTVSGLTPARTYQFRVCAVNEVGRGQYSAETSRLMLPEEPPSAPPKNIVASGRTNQSIMVQWQPPPETEHNGVLRGYILRYRLAGLPGEYQQRNITSPEVNYCLVTDLIIWTQYEIQVAAYNGAGLGVFSRAVTEYTLQGVPTAPPQNVQTEAVNSTTIQFLWNPPPQQFINGINQGYKLLAWPADAPEAVTVVTIAPDFHGVHHGHITNLKKFTAYFTSVLCFTTPGDGPPSTPQLVWTQEDKPGAVGHLSFTEILDTSLKVSWQEPLEKNGIITGYQISWEVYGRNDSRLTHTLNSTTHEYKIQGLSSLTTYTIDVAAVTAVGTGLVTSSTISSGVPPDLPGAPSNLVISNISPRSATLQFRPGYDGKTSISRWIVEGQVGAIGDEEEWVTLYEEENEPDAQMLEIPNLTPYTHYRFRMKQVNIVGPSPYSPSSRVIQTLQAPPDVAPTSVTVRTASETSLRLRWVPLPDSQYNGNPESVGYRIKYWRSDLQSSAVAQVVSDRLEREFTIEELEEWMEYELQMQAFNAVGAGPWSEVVRGRTRESVPSAAPENVSAEAVSSTQILLTWTSVPEQDQNGLILGYKILFRAKDLDPEPRSHIVRGNHTQSALLAGLRKFVLYELQVLAFTRIGNGVPSTPLILERTKDDAPGPPVRLVFPEVRLTSVRIVWQPPEEPNGIILGYQIAYRLASSSPHTFTTVEVGATVRQFTATDLAPESAYIFRLSAKTRQGWGEPLEATVITTEKRERPAPPRELLVPQAEVTARSLRLQWVPGSDGASPIRYFTMQVRELPRGEWQTYSSSISHEATACVVDRLRPFTSYKLRLKATNDIGDSDFSSETEAVTTLQDVPGEPPGSVSATPHTTSSVLIQWQPPRDESLNGLLQGYRIYYRELEYEAGSGTEAKTLKNPIALHAELTAQSSFKTVNSSSTSTMCELTHLKKYRRYEVIMTAYNIIGESPASAPVEVFVGEAAPAMAPQNVQVTPLTASQLEVTWDPPPPESQNGNIQGYKIYYWEADSQNETEKMKVLFLPEPVVRLKNLTSHTKYLVSISAFNAAGDGPKSDPQQGRTHQAAPGAPSFLAFSEITSTTLNVSWGEPAAANGILQGYRVVYEPLAPVQGVSKVVTVEVRGNWQRWLKVRDLTKGVTYFFRVQARTITYGPELQANITAGPAEGSPGSPRDVLVTKSASELTLQWTEGHSGDTPTTGYVIEARPSDEGLWDMFVKDIPRSATSYTLSLDKLRQGVTYEFRVVAVNEAGYGEPSNPSTAVSAQVEAPFYEEWWFLLVMALSSLIVILLVVFALVLHGQNKKYKNCSTGKGISTMEESVTLDNGGFAALELSSRHLNVKSTFSKKNGTRSPPRPSPGGLHYSDEDICNKYNGAVLTESVSLKEKSADASESEATDSDYEDALPKHSFVNHYMSDPTYYNSWKRRAQGRAPAPHRYEAVAGSEAGAQLHPVITTQSAGGVYTPAGPGARTPLTGFSSFV

SEQ ID NO: 3865 - protein, 2172 aa, unidentified
MWGLLIWTLLALHQIRAARAQDDVSPYFKTEPVRTQVHLEGNRLVLTCMAEGSWPLEFKWLHNNRELTKFSLEYRYMITSLDRTHAGFYRCIVRNRMGALLQRQTEVQVAYMGSFEEGEKHQSVSHGEAAVIRAPRIASFPQPQVTWFRDGRKIPPSSRIAITLENTLVILSTVAPDAGRYYVQAVNDKNGDNKTSQPITLTVENVGGPADPIAPTIIIPPKNTSVVAGTSEVTLECVANARPLIKLHIIWKKDGVLLSGGISDHNRRLTIPNPTGSDAGYYECEAVLRSSSVPSVVRGAYLSVLEPPQFVKEPERHITAEMEKVVDIPCQAKGVPPPSITWYKDAAVVEVEKLTRFRQRNDGGLQISGLVPDDTGMFQCFARNAAGEVQTSTYLAVTSIAPNITRGPLDSTVIDGMSVVLACETSGAPRPAITWQKGERILASGSVQLPRFTPLESGSLLISPTHISDAGTYTCLATNSRGVDEASADLVVWARTRITKPPQDQSVIKGTQASMVCGVTHDPRVTIRYIWEKDGATLGTESHPRIRLDRNGSLHISQTWSGDIGTYTCRVISAGGNDSRSAHLRVRQLPHAPEHPVATLSTVERRAINLTWTKPFDGNSPLIRYILEMSENNAPWTVLLASVDPKATSVTVKGLVPARSYQFRLCAVNDVGKGQFSKDTERVSLPEEPPTAPPQNVIASGRTNQSIMIQWQPPPESHQNGILKGYIIRYCLAGLPVGYQFKNITDADVNNLLLEDLIIWTNYEIEVAAYNSAGLGVYSSKVTEWTLQGVPTVPPGNVHAEATNSTTIRFTWNAPSPQFINGINQGYKLIAWEPEQEEEVTMVTARPNFQDSIHVGFVSGLKKFTEYFTSVLCFTTPGDGPRSTPQLVRTHEDVPGPVGHLSFSEILDTSLKVSWQEPGEKNGILTGYRISWEEYNRTNTRVTHYLPNVTLEYRVTGLTALTTYTIEVAAMTSKGQGQVSASTISSGVPPELPGPPTNLGISNIGPRSVTLQFRPGYDGKTSISRWLVEAQVGVVGEGEEWLLIHQLSNEPDARSMEVPDLNPFTCYSFRMRQVNIVGTSPPSQPSRKIQTLQAPPDMAPANVSLRTASETSLWLRWMPLPEMEYNGNPESVGYKIKYSRSDGHGKTLSHVVQDRVERDYTIEDLEEWTEYRVQVQAFNAIGSGPWSQTVVGRTRESVPSSGPTNVSALATTSSSMLVRWSEVPEADRNGLVLGYKVMYKEKDSDTQPRFWLVEGNSSRSAQLTGLGKYVLYEVQVLAFTRIGDGSPSHPPILERTLDDVPGPPMGILFPEVRTTSVRLIWQPPAAPNGIILAYQITHRLNTTTANTATVEVLAPSARQYTATGLKPESVYLFRITAQTRKGWGEAAEALVVTTEKRDRPQPPSRPMVQQEDVRARSVLLSWEPGSDGLSPVRYYTIQTRELPSGRWALHSASVSHNASSFIVDRLKPFTSYKFRVKATNDIGDSEFSEESESLTTLQAAPDEAPTILSVTPHTTTSVLIRWQPPAEDKINGILLGFRIRYRELLYEGLRGFTLRGINNPGATWAELTSMYSMRNLSRPSLTQYELDNLNKHRRYEIRMSVYNAVGEGPSSPPQEVFVGEAVPTAAPRNVVVHGATATQLDVTWEPPPLDSQNGDIQGYKIYFWEAQRGNLTERVKTLFLAENSVKLKNLTGYTAYMVSVAAFNAAGDGPRSTPTQGQTQQAAPSAPSSVKFSELTTTSVNVSWEAPQFPNGILEGYRLVYEPCSPVDGVSKIVTVDVKGNSPLWLKVKDLAEGVTYRFRIRAKTFTYGPEIEANVTTGPGEGAPGPPGVPIIVRYSSAIAIHWSSGDPGKGPITRYVIEARPSDEGLWDILIKDIPKEVSSYTFSMDILKPGVSYDFRVIAVNDYGFGTPSSPSQSVPAQKANPFYEEWWFLVVIALVGLIFILLLVFVLIIRGQSKKYAKKTDSGNSAKSGALGHSEMMSLDESSFPALELNNRRLSVKNSFCRKNGLYTRSPPRPSPGSLHYSDEDVTKYNDLIPAESSSLTEKPSEISDSQGSDSEYEVDSNHQKAHSFVNHYISDPTYYNSWRRQQKGISRAQAYSYTESDSGEPDHTTVTNSTSTQQGSLFRPKASRTPTPQNPPNPPSQQSTLYRPPSSLAPGSRAPIAGFSSFV

SEQ ID NO: 3866 - protein, 309 aa, unidentified
MSFNLQSSKKLFIFLGKSLFSLLEAMIFALLPKPRKNVAGEIVLITGAGSGLGRLLALQFARLGSVLVLWDINKEGNEETCKMAREAGATRVHAYTCDCSQKEGVYRVADQVKKEVGDVSILINNAGIVTGKKFLDCPDELMEKSFDVNFKAHLWTYKAFLPAMIANDHGHLVCISSSAGLSGVNGLADYCASKFAAFGFAESVFVETFVQKQKGIKTTIVCPFFIKTGMFEGCTTGCPSLLPILEPKYAVEKIVEAILQEKMYLYMPKLLYFMMFLKSFLPLKTGLLIADYLGILHAMDGFVDQKKKL

SEQ ID NO: 3867 - protein, 393 aa, unidentified
MDPKRSQKESVLITGGSGYFGFRLGCALNQNGVHVILFDISSPAQTIPEGIKFIQGDIRHLSDVEKAFQDADVTCVFHIASYGMSGREQLNRNLIKEVNVRGTDNILQVCQRRRVPRLVYTSTFNVIFGGQVIRNGDESLPYLPLHLHPDHYSRTKSIAEQKVLEANATPLDRGDGVLRTCALRPAGIYGPGEQRHLPRIVSYIEKGLFKFVYGDPRSLVEFVHVDNLVQAHILASEALRADKGHIASGQPYFISDGRPVNNFEFFRPLVEGLGYTFPSTRLPLTLVYCFAFLTEMVHFILGRLYNFQPFLTRTEVYKTGVTHYFSLEKAKKELGYKAQPFDLQEAVEWFKAHGHGRSSGSRDSECFVWDGLLVFLLIIAVLMWLPSSVILSL

SEQ ID NO: 3868 - protein, 329 aa, unidentified
MDGPVAEHAKQEPFHVVTPLLESWALSQVAGMPVFLKCENVQPSGSFKIRGIGHFCQEMAKKGCRHLVCSSGGNAGIAAAYAARKLGIPATIVLPESTSLQVVQRLQGEGAEVQLTGKVWDEANLRAQELAKRDGWENVPPFDHPLIWKGHASLVQELKAVLRTPPGALVLAVGGGGLLAGVVAGLLEVGWQHVPIIAMETHGAHCFNAAITAGKLVTLPDITSVAKSLGAKTVAARALECMQVCKIHSEVVEDTEAVSAVQQLLDDERMLVEPACGAALAAIYSGLLRRLQAEGCLPPSLTSVVVIVCGGNNINSRELQALKTHLGQV

SEQ ID NO: 3869 - protein, 179 aa, unidentified
MLSLDFLDDVRRMNKRQLYYQVLNFGMIVSSALMIWKGLMVITGSESPIVVVLSGSMEPAFHRGDLLFLTNRVEDPIRVGEIVVFRIEGREIPIVHRVLKIHEKQNGHIKFLTKGDNNAVDDRGLYKQGQHWLEKKDVVGRARGFVPYIGIVTILMNDYPKFKYAVLFLLGLFVLVHRE

SEQ ID NO: 3870 - protein, 192 aa, unidentified
MVRAGAVGAHLPASGLDIFGDLKKMNKRQLYYQVLNFAMIVSSALMIWKGLIVLTGSESPIVVVLSGSMEPAFHRGDLLFLTNFREDPIRAGEIVVFKVEGRDIPIVHRVIKVHEKDNGDIKFLTKGDNNEVDDRGLYKEGQNWLEKKDVVGRARGFLPYVGMVTIIMNDYPKFKYALLAVMGAYVLLKRES

SEQ ID NO: 3871 - protein, 307 aa, unidentified
MSMILSASVIRVRDGLPLSASTDYEQSTGMQECRKYFKMLSRKLAQLPDRCTLKTGHYNINFISSLGVSYMMLCTENYPNVLAFSFLDELQKEFITTYNMMKTNTAVRPYCFIEFDNFIQRTKQRYNNPRSLSTKINLSDMQTEIKLRPPYQISMCELGSANGVTSAFSVDCKGAGKISSAHQRLEPATLSGIVGFILSLLCGALNLIRGFHAIESLLQSDGDDFNYIIAFFLGTAACLYQCYLLVYYTGWRNVKSFLTFGLICLCNMYLYELRNLWQLFFHVTVGAFVTLQIWLRQAQGKAPDYDV

SEQ ID NO: 3872 - protein, 303 aa, unidentified
MSVIFFACVVRVRDGLPLSASTDFYHTQDFLEWRRRLKSLALRLAQYPGRGSAEGCDFSIHFSSFGDVACMAICSCQCPAAMAFCFLETLWWEFTASYDTTCIGLASRPYAFLEFDSIIQKVKWHFNYVSSSQMECSLEKIQEELKLQPPAVLTLEDTDVANGVMNGHTPMHLEPAPNFRMEPVTALGILSLILNIMCAALNLIRGVHLAEHSLQVAHEEIGNILAFLVPFVACIFQCYLYLFYSPARTMKVVLMLLFICLGNMYLHGLRNLWQILFHIGVAFLSSYQILTRQLQEKQSDCGV

SEQ ID NO: 3873 - protein, 476 aa, unidentified
MAIKFLEVIKPFCVILPEIQKPERKIQFKEKVLWTAITLFIFLVCCQIPLFGIMSSDSADPFYWMRVILASNRGTLMELGISPIVTSGLIMQLLAGAKIIEVGDTPKDRALFNGAQKLFGMIITIGQSIVYVMTGMYGDPSEMGAGICLLITIQLFVAGLIVLLLDELLQKGYGLGSGISLFIATNICETIVWKAFSPTTVNTGRGMEFEGAIIALFHLLATRTDKVRALREAFYRQNLPNLMNLIATIFVFAVVIYFQGFRVDLPIKSARYRGQYNTYPIKLFYTSNIPIILQSALVSNLYVISQMLSARFSGNLLVSLLGTWSDTSSGGPARAYPVGGLCYYLSPPESFGSVLEDPVHAVVYIVFMLGSCAFFSKTWIEVSGSSAKDVAKQLKEQQMVMRGHRETSMVHELNRYIPTAAAFGGLCIGALSVLADFLGAIGSGTGILLAVTIIYQYFEIFVKEQSEVGSMGALLF

SEQ ID NO: 3874 - protein, 418 aa, unidentified
MGIKFLEVIKPFCAVLPEIQKPERKIQFREKVLWTAITLFIFLVCCQIPLFGIMSSDSADPFYWMRVILASNRGTLMELGISPIVTSGLIMQLLAGAKIIEVGDTPKDRALFNGAQKLFGMIITIGQAIVYVMTGMYGDPAEMGAGICLLIIIQLFVAGLIVLLLDELLQKGYGLGSGISLFIATNICETIVWKAFSPTTINTGRGTEFEGAVIALFHLLATRTDKVRALREAFYRQNLPNLMNLIATVFVFAVVIYFQGFRVDLPIKSARYRGQYSSYPIKLFYTSNIPIILQSALVSNLYVISQMLSVRFSGNFLVNLLGQWADVSGGGPARSYPVGGLCYYLSPPESMGAIFEDPVHVVVYIIFMLGSCAFFSKTWIEVSGSSAKDVAKQLKEQQMVMRGHRDTSMVHELNSARA

SEQ ID NO: 3875 - protein, 96 aa, unidentified
MPGPTPSGTNVGSSGRSPSKAVAARAAGSTVRQRKNASCGTRSAGRTTSAGTGGMWRFYTEDSPGLKVGPVPVLVMSLLFIASVFMLHIWGKYTRS

SEQ ID NO: 3876 - protein, 68 aa, unidentified
MDQVMQFVEPSRQFVKDSIRLVKRCTKPDRKEFQKIAMATAIGFAIMGFIGFFVKLIHIPINNIIVGG

SEQ ID NO: 3877 - protein, 399 aa, unidentified
MAERRRHKKRIQEVGEPSKEEKAVAKYLRFNCPTKSTNMMGHRVDYFIASKAVDCLLDSKWAKAKKGEEALFTTRESVVDYCNRLLKKQFFHRALKVMKMKYDKDIKKEKDKGKAESGKEEDKKSKKENIKDEKTKKEKEKKKDGEKEESKKEETPGTPKKKETKKKFKLEPHDDQVFLDGNEVYVWIYDPVHFKTFVMGLILVIAVIAATLFPLWPAEMRVGVYYLSVGAGCFVASILLLAVARCILFLIIWLITGGRHHFWFLPNLTADVGFIDSFRPLYTHEYKGPKADLKKDEKSETKKQQKSDSEEKSDSEKKEDEEGKVGPGNHGTEGSGGERHSDTDSDRREDDRSQHSSGNGNDFEMITKEELEQQTDGDCEEDEEEENDGETPKSSHEKS

SEQ ID NO: 3878 - protein, 760 aa, unidentified
MAGQQFQYDDSGNTFFYFLTSFVGLIVIPATYYLWPRDQNAEQIRLKNIRKVYGRCMWYRLRLLKPQPNIIPTVKKIVLLAGWALFLFLAYKVSKTDREYQEYNPYEVLNLDPGATVAEIKKQYRLLSLKYHPDKGGDEVMFMRIAKAYAALTDEESRKNWEEFGNPDGPQATSFGIALPAWIVDQKNSILVLLVYGLAFMVILPVVVGSWWYRSIRYSGDQILIRTTQIYTYFVYKTRNMDMKRLIMVLAGASEFDPQYNKDATSRPTDNILIPQLIREIGSINLKKNEPPLTCPYSLKARVLLLSHLARMKIPETLEEDQQFMLKKCPALLQEMVNVICQLIVMARNREEREFRAPTLASLENCMKLSQMAVQGLQQFKSPLLQLPHIEEDNLRRVSNHKKYKIKTIQDLVSLKESDRHTLLHFLEDEKYEEVMAVLGSFPYVTMDIKSQVLDDEDSNNITVGSLVTVLVKLTRQTMAEVFEKEQSICAAEEQPAEDGQGETNKNRTKGGWQQKSKGPKKTAKSKKKKPLKKKPTPVLLPQSKQQKQKQANGVVGNEAAVKEDEEEVSDKGSDSEEEETNRDSQSEKDDGSDRDSDREQDEKQNKDDEAEWQELQQSIQRKERALLETKSKITHPVYSLYFPEEKQEWWWLYIADRKEQTLISMPYHVCTLKDTEEVELKFPAPGKPGNYQYTVFLRSDSYMGLDQIKPLKLEVHEAKPVPENHPQWDTAIEGDEDQEDSEGFEDSFEEEEEEEEDDD

SEQ ID NO: 3879 - protein, 248 aa, unidentified
MQTCPLAFPGHVSQALGTLLFLAASLSAQNEGWDSPICTEGVVSVSWGENTVMSCNISNAFSHVNIKLRAHGQESAIFNEVAPGYFSRDGWQLQVQGGVAQLVIKGARDSHAGLYMWHLVGHQRNNRQVTLEVSGAEPQSAPDTGFWPVPAVVTAVFILLVALVMFAWYRCRCSQQRREKKFFLLEPQMKVAALRAGAQQGLSRASAELWTPDSEPTPRPLALVFKPSPLGALELLSPQPLFPYAADP

SEQ ID NO: 3880 - protein, 794 aa, unidentified
MRVRIGLTLLLCAVLLSLASASSDEEGSQDESLDSKTTLTSDESVKDHTTAGRVVAGQIFLDSEESELESSIQEEEDSLKSQEGESVTEDISFLESPNPENKDYEEPKKVRKPALTAIEGTAHGEPCHFPFLFLDKEYDECTSDGREDGRLWCATTYDYKADEKWGFCETEEEAAKRRQMQEAEMMYQTGMKILNGSNKKSQKREAYRYLQKAASMNHTKALERVSYALLFGDYLPQNIQAAREMFEKLTEEGSPKGQTALGFLYASGLGVNSSQAKALVYYTFGALGGNLIAHMVLGYRYWAGIGVLQSCESALTHYRLVANHVASDISLTGGSVVQRIRLPDEVENPGMNSGMLEEDLIQYYQFLAEKGDVQAQVGLGQLHLHGGRGVEQNHQRAFDYFNLAANAGNSHAMAFLGKMYSEGSDIVPQSNETALHYFKKAADMGNPVGQSGLGMAYLYGRGVQVNYDLALKYFQKAAEQGWVDGQLQLGSMYYNGIGVKRDYKQALKYFNLASQGGHILAFYNLAQMHASGTGVMRSCHTAVELFKNVCERGRWSERLMTAYNSYKDGDYNAAVIQYLLLAEQGYEVAQSNAAFILDQREASIVGENETYPRALLHWNRAASQGYTVARIKLGDYHFYGFGTDVDYETAFIHYRLASEQQHSAQAMFNLGYMHEKGLGIKQDIHLAKRFYDMAAEASPDAQVPVFLALCKLGVVYFLQYIRETNIRDMFTQLDMDQLLGPEWDLYLMTIIALLLGTVIAYRQRQHQDMPAPRPPGPRPAPPQQEGPPEQQPPQ

SEQ ID NO: 3881 - protein, 688 aa, unidentified
MKPLSLLIEILIILGVTIKTIKAEEHNKRQKERNVTTQVSVNEIKQYLSHILEQRTSSNVINKRENLLEKKKNQRKIRIKGIQNKDILKRNKNHLQKQAEKNFTDEGDQLFKMGIKVLQQSKSQKQKEEAYLLFAKAADMGNLKAMEKMADALLFGNFGVQNITAAIQLYESLAKEGSCKAQNALGFLSSYGIGMEYDQAKALIYYTFGSAGGNMMSQMILGYRYLSGINVLQNCEVALSYYKKVADYIADTFEKSEGVPVEKVRLTERPENLSSNSEILDWDIYQYYKFLAERGDVQIQVSLGQLHLIGRKGLDQDYYKALHYFLKAAKAGSANAMAFIGKMYLEGNAAVPQNNATAFKYFSMAASKGNAIGLHGLGLLYFHGKGVPLNYAEALKYFQKAAEKGWPDAQFQLGFMYYSGSGIWKDYKLAFKYFYLASQSGQPLAIYYLAKMYATGTGVVRSCRTAVELYKGVCELGHWAEKFLTAYFAYKDGDIDSSLVQYALLAEMGYEVAQSNSAFILESKKANILEKEKMYPMALLLWNRAAIQGNAFARVKIGDYHYYGYGTKKDYQTAATHYSIAANKYHNAQAMFNLAYMYEHGLGITKDIHLARRLYDMAAQTSPDAHIPVLFAVMKLETTHLLRDILFFNFTTRWNWLKLDNTIGPHWDLFVIGLIVPGLILLLRNHHG

SEQ ID NO: 3882 - protein, 1132 aa, unidentified
MQRRGAGLGWPRQQQQQPPPLAVGPRAAAMVPSGGVPQGLGGRSACALLLLCYLNVVPSLGRQTSLTTSVIPKAEQSVAYKDFIYFTVFEGNVRNVSEVSVEYLCSQPCVVNLEAVVSSEFRSSIPVYKKRWKNEKHLHTSRTQIVHVKFPSIMVYRDDYFIRHSISVSAVIVRAWITHKYSGRDWNVKWEENLLHAVAKNYTLLQTIPPFERPFKDHQVCLEWNMGYIWNLRANRIPQCPLENDVVALLGFPYASSGENTGIVKKFPRFRNRELEATRRQRMDYPVFTVSLWLYLLHYCKANLCGILYFVDSNEMYGTPSVFLTEEGYLHIQMHLVKGEDLAVKTKFIIPLKEWFRLDISFNGGQIVVTTSIGQDLKSYHNQTISFREDFHYNDTAGYFIIGGSRYVAGIEGFFGPLKYYRLRSLHPAQIFNPLLEKQLAEQIKLYYERCAEVQEIVSVYASAAKHGGERQEACHLHNSYLDLQRRYGRPSMCRAFPWEKELKDKHPSLFQALLEMDLLTVPRNQNESVSEIGGKIFEKAVKRLSSIDGLHQISSIVPFLTDSSCCGYHKASYYLAVFYETGLNVPRDQLQGMLYSLVGGQGSERLSSMNLGYKHYQGIDNYPLDWELSYAYYSNIATKTPLDQHTLQGDQAYVETIRLKDDEILKVQTKEDGDVFMWLKHEATRGNAAAQQRLAQMLFWGQQGVAKNPEAAIEWYAKGALETEDPALIYDYAIVLFKGQGVKKNRRLALELMKKAASKGLHQAVNGLGWYYHKFKKNYAKAAKYWLKAEEMGNPDASYNLGVLHLDGIFPGVPGRNQTLAGEYFHKAAQGGHMEGTLWCSLYYITGNLETFPRDPEKAVVWAKHVAEKNGYLGHVIRKGLNAYLEGSWHEALLYYVLAAETGIEVSQTNLAHICEERPDLARRYLGVNCVWRYYNFSVFQIDAPSFAYLKMGDLYYYGHQNQSQDLELSVQMYAQAALDGDSQGFFNLALLIEEGTIIPHHILDFLEIDSTLHSNNISILQELYERCWSHSNEESFSPCSLAWLYLHLRLLWGAILHSALIYFLGTFLLSILIAWTVQYFQSVSASDPPPRPSQASPDTATSTASPAVTPAADASDQDQPTVTNNPEPRG

SEQ ID NO: 3883 - protein, 610 aa, unidentified
MIASQFLSALTLVLLIKESGAWSYNTSTEAMTYDEASAYCQQRYTHLVAIQNKEEIEYLNSILSYSPSYYWIGIRKVNNVWVWVGTQKPLTEEAKNWAPGEPNNRQKDEDCVEIYIKREKDVGMWNDERCSKKKLALCYTAACTNTSCSGHGECVETINNYTCKCDPGFSGLKCEQIVNCTALESPEHGSLVCSHPLGNFSYNSSCSISCDRGYLPSSMETMQCMSSGEWSAPIPACNVVECDAVTNPANGFVECFQNPGSFPWNTTCTFDCEEGFELMGAQSLQCTSSGNWDNEKPTCKAVTCRAVRQPQNGSVRCSHSPAGEFTFKSSCNFTCEEGFMLQGPAQVECTTQGQWTQQIPVCEAFQCTALSNPERGYMNCLPSASGSFRYGSSCEFSCEQGFVLKGSKRLQCGPTGEWDNEKPTCEAVRCDAVHQPPKGLVRCAHSPIGEFTYKSSCAFSCEEGFELHGSTQLECTSQGQWTEEVPSCQVVKCSSLAVPGKINMSCSGEPVFGTVCKFACPEGWTLNGSAARTCGATGHWSGLLPTCEAPTESNIPLVAGLSAAGLSLLTLAPFLLWLRKCLRKAKKFVPASSCQSLESDGSYQKPSYIL

SEQ ID NO: 3884 - protein, 397 aa, unidentified
MAGYEYVSPEQLAGFDKYKYSAVDTNPLSLYVMHPFWNTIVKVFPTWLAPNLITFSGFLLVVFNFLLMAYFDPDFYASAPGHKHVPDWVWIVVGILNFVAYTLDGVDGKQARRTNSSTPLGELFDHGLDSWSCVYFVVTVYSIFGRGSTGVSVFVLYLLLWVVLFSFILSHWEKYNTGILFLPWGYDISQVTISFVYIVTAVVGVEAWYEPFLFNFLYRDLFTAMIIGCALCVTLPMSLLNFFRSYKNNTLKLNSVYEAMVPLFSPCLLFILSTAWILWSPSDILELHPRVFYFMVGTAFANSTCQLIVCQMSSTRCPTLNWLLVPLFLVVLVVNLGVASYVESILLYTLTTAFTLAHIHYGVRVVKQLSSHFQIYPFSLRKPNSDULGMEEKNIGL

SEQ ID NO: 3885 - protein, 381 aa, unidentified
MWRSLGLALALCLLPSGGTESQDQSSLCKQPPAWSIRDQDPMLNSNGSVTVVALLQASUYLCILQASKLEDLRVKLKKEGYSNISYIVVNHQGISSRLKYTHLKNKVSEHIPVYQQEENQTDVWTLLNGSKDDFLIYDRCGRLVYHLGLPFSFLTFPYVEEAIKIAYCEKKCGNCSLTTLKDEDFCKRVSLATVDKTVETPSPHYHHEHHHNHGHQHLGSSELSENQQPGAPNAPTHPAPPGLHHHHKHKGQHRQGHPENRDMPASEDLQDLQKKLCRKRCINQLLCKLPTDSELAPRSUCCHCRHLIFEKTGSAITUQCKENLPSLCSUQGLRAEENITESCQURLPPAAUQISQQLIPTEASASURUKNQAKKUEUPSN

SEQ ID NO: 3886 - protein, 189 aa, unidentified
MERQEESLSARPALETEGLRFLHTTVGSLLATYGWYIVFSCILLYVVFQKLSARLRALRQRQLDRAAAAVEPDVVVKRQEALAAARLKMQEELNAQVEKHKEKLKQLEEEKRRQKIEMWDSMQEGKSYKGNAKKPQEEDSPGPSTSSVLKRKSDRKPLRGGGYNPLSGEGGGACSWRPGRRGPSSGGUG

SEQ ID NO: 3887 - protein, 137 aa, unidentified
MRVISQRYPDIRIEGENYLPQPIYRHIASFLSVFKLVLIGLIIVGKDPFAFFGMQAPSIWQWGQENKVYACMMVFFLSNMIENQCMSTGAFEITLNDVPVWSKLESGHLPSMQQLVQILDNEMKLNVHMDSIPHHRS

SEQ ID NO: 3888 - protein, 372 aa, unidentified [sequence omitted]

SEQ ID NO: 3889 - protein, 830 aa, unidentified
MANCQIAILYQRFQRVVFGISQLLCFSALISELTNQKEVAAWTYHYSTKAYSWNISRKYCQNRYTDLVAIQNKNEIDYLNKVLPYYSSYYWIGIRKNNKTWTWVGTKKALTNEAENWADNEPNNKRNNEDCVEIYIKSPSAPGKWNDEHCLKKKHALCYTASCQDMSCSKQGECLETIGNYTCSCYPGFYGPECEYVRECGELELPQHVLMNCSHPLGNFSFNSQCSFHCTDGYQVNGPSKLECLASGIWTNKPPQCLAAQCPPLKIPERGNMTCLHSAKAFQHQSSCSFSCEEGFALVGPEVVQCTASGVWTAPAPVCKAVQCQHLEAPSEGTMDCVHPLTAFAYGSSCKFECQPGYRVRGLDMLRCIDSGHWSAPLPTCEAISCEPLESPVHGSMDCSPSLRAFQYDTNCSFRCAEGFMLRGADIVRCDNLGQWTAPAPVCQALQCQDLPVPNEARVNCSHPFGAFRYQSVCSFTCNEGLLLVGASVLQCLATGNWNSVPPECQAIPCTPLLSPQNGTMTCVQPLGSSSYKSTCQFICDEGYSLSGPERLDCTRSGRWTDSPPMCEAIKCPELFAPEQGSLDCSDTRGEFNVGSTCHFSCDNGFKLEGPNNVECTTSGRWSATPPTCKGIASLPTPGLQCPALTTPGQGTMYCRHHPGTFGFNTTCYFGCNAGFTLIGDSTLSCRPSGQWTAVTPACRAVKCSELHVNKPIAMNCSNLWGNFSYGSICSFHCLEGQLLNGSAQTACQENGHWSTTVPTCQAGPLTIQEALTYFGGAVASTIGLIMGGTLLALLRKRFRQKDDGKCPLNPHSHLGTYGVFTNAAFDPSP

SEQ ID NO: 3890 - protein, 412 aa, unidentified
MPLQLLLLLILLGPGNSLQLWDTWADEAEKALGPLLARDRRQATEYEYLDYDFLPETEPPEMLRNSTDTTPLTGPGTPESTTVEPAARRSTGLDAGGAVTELTTELANMGNLSTDSAAMEIQTTQPAATEAQTTQPVPTEAQTTPLAATEAQTTRLTATEAQTTPLAATEAQTTPPAATEAQTTQPTGLEAQTTAPAAMEAQTTAPAAMEAQTTPPAAMEAQTTQTTAMEAQTTAPEATEAQTTQPTATEAQTTPLAAMEALSTEPSATEALSMEPTTKRGLFIPFSVSSVTHKGIPMAASNLSVNYPVGAPDHISVKQCLLAILILALVATIFFVCTVVLAVRLSRKGHMYPVRNYSPTEMVCISSLLPDGGEGPSATANGGLSKAKSPGLTPEPREDREGDDLTLHSFLP

SEQ ID NO: 3891 - protein, 761 aa, unidentified
MALPALGLDPWSLLGLFLFQLLQLLLPTTTAGGGGQGPMPRVRYYAGDERRALSFFHQKGLQDFDTLLLSGDGNTLYVGAREAILALDIQDPGVPRLKNMIPWPASDRKKSECAFKKKSNETQCFNFIRVLVSYNVTHLYTCGTFAFSPACTFIELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVCKNDVGGEKLLQKKWTTFLKAQLLCTQPGQLPFNVIRHAVLLPADSPTAPHIYAVFTSQWQVGGTRSSAVCAFSLLDIERVFKGKYKELNKETSRWTTYRGPETNPRPGSCSVGPSSDKALTFMKDHFLMDEQVVGTPLLVKSGVEYTRLAVETAQGLDGHSHLVMYLGTTTGSLHKAVVSGDSSAHLVEEIQLFPDPEPVRNLQLAPTQGAVFVGFSGGVWRVPRANCSVYESCVDCVLARDPHCAWDPESRTCCLLSAPNLNSWKQDMERGNPEWACASGPMSRSLRPQSRPQIIKEVLAVPNSILELPCPHLSALASYYWSHGPAAVPEASSTVYNGSLLLIVQDGVGGLYQCWATENGFSYPVISYWVDSQDQTLALDPELAGIPREHVKVPLTRVSGGAALAAQQSYWPHFVTVTVLFALVLSGALIILVASPLRALRARGKVQGCETLRPGEKAPLSREQHLQSPKECRTSASDVDADNNCLGTEVA

SEQ ID NO: 3892 - protein, 833 aa, unidentified
MAPHWAVWLLAARLWGLGIGAEVWWNLVPRKTVSSGELATVVRRFSQTGIQDFLTLTLTEPTGLLYVGAREALFAFSMEALELQGAISWEAPVEKKTECIQKGKNNQTECFNFIRFLQPYNASHLYVCGTYAFQPKCTYVNMLTFTLEHGEFEDGKGKCPYDPAKGHAGLLVDGELYSATLNNFLGTEPIILRNMGPHHSMKTEYLAFWLNEPHFVGSAYVPESVGSFTGDDDKVYFFFRERAVESDCYAEQVVARVARVCKGDMGGARTLQRKWTTFLKARLACSAPNWQLYFNQLQAMHTLQDTSWHNTTFFGVFQAQWGDMYLSAICEYQLEEIQRVFEGPYKEYHEEAQKWDRYTDPVPSPRPGSCINNWHRRHGYTSSLELPDNILNFVKKHPLMEEQVGPRWSRPLLVKKGTNFTHLVADRVTGLDGATYTVLFIGTGDGWLLKAVSLGPWVHLIEELQLFDQEPMRSLVLSQSKKLLFAGSRSQLVQLPVADCMKYRSCADCVLARDPYCAWSVNTSRCVAVGGHSGSLLIQHVMTSDTSGICNLRGSKKVRPTPKNITVVAGTDLVLPCHLSSNLAHARWTFGGRDLPAEQPGSFLYDARLQALVVMAAQPRHAGAYHCFSEEQGARLAAEGYLVAVVAGPSVTLEARAPLENLGLVWLAVVALGAVCLVLLLLVLSLRRRLREELEKGAKATERTLVYPLELPKEPTSPPFRPCPEPDEKLWDPVGYYYSDGSLKIVPGHARCQPGGGPPSPPPGIPGQPLPSPTRLHLGGGRNSNANGYVRLQLGGEDRGGLGHPLPELADELRRKLQQRQPLPDSNPEESSV

SEQ ID NO: 3893 - protein, 862 aa, unidentified
MRMCTPIRGLLMALAVMFGTAMAFAPIPRITWEHREVHLVQFHEPDIYNYSALLLSEDKDTLYIGAREAVFAVNALNISEKQHEVYWKVSEDKKAKCAEKGKSKQTECLNYIRVLQPLSATSLYVCGTNAFQPACDHLNLTSFKFLGKNEDGKGRCPFDPAHSYTSVMVDGELYSGTSYNFLGSEPIISRNSSHSPLRTEYAIPWLNEPSFVFADVIRKSPDSPDGEDDRVYFFFTEVSVEYEFVFRVLIPRIARVCKGDQGGLRTLQKKWTSFLKARLICSRPDSGLVFNVLRDVFVLRSPGLKVPVFYALFTPQLNNVGLSAVCAYNLSTAEEVFSHGKYMQSTTVEQSHTKWVRYNGPVPKPRPGACIDSEARAANYTSSLNLPDKTLQFVKDHPLMDDSVTPIDNRPRLIKKDVNYTQIVVDRTQALDGTVYDVMFVSTDRGALHKAISLEHAVHIIEETQLFQDFEPVQTLLLSSKKGNRFVYAGSNSGVVQAPLAFCGKHGTCEDCVLARDPYCAWSPPTATCVALHQTESPSRGLIQEMSGDASVCPDKSKGSYRQHFFKHGGTAELKCSQKSNLARVFWKFQNGVLKAESPKYGLMGRKNLLIFNLSEGDSGVYQCLSEERVKNKTVFQVVAKHVLEVKVVPKPVVAPTLSVVQTEGSRIATKVLVASTQGSSPPTPAVQATSSGAITLPPKPAPTGTSCEPKIVINTVPQLHSEKTMYLKSSDNRLLMSLFLFFFVLFLCLFFYNCYKGYLPRQCLKFRSALLIGKKKPKSDFCDREQSLKETLVEPGSFSQQNGEHPKPALDTGYETEQDTITSKVPTDREDSQRIDDLSARDKPFDVKCELKFADSDADGD

SEQ ID NO: 3894 - protein, 770 aa, unidentified
MPASAARPRPGPGQPTASPFPLLLLAVLSGPVSGRVPRSVPRTSLPISEADSCLTRFAVPHTYNYSVLLVDPASHTLYVGARDTIFALSLPFSGERPRRIDWMVPEAHRQNCRKKGKKEDECHNFVQILAIANASHLLTCGTFAFDPKCGVIDVSRFQQVERLESGRGKCPFEPAQRSAAVMAGGVLYAATVKNYLGTEPIITRAVGRAEDWIRTDTLPSWLNAPAFVAAVALSPAEWGDEDGDDEIYFFFTETSRAFDSYERIKVPRVARVCAGDLGGRKTLQQRWTTFLKADLLCPGPEHGRASSVLQDVAVLRPELGAGTPIFYGIFSSQWEGATISAVCAFRPQDIRTVLNGPFRELKHDCNRGLPVVDNDVPQPRPGECITNNMKLRHFGSSLSLPDRVLTFIRDHPLMDRPVFPADGHPLLVTTDTAYLRVVAHRVTSLSGKEYDVLYLGTEDGHLHRAVRIGAQLSVLEDLALFPEPQPVENMKLYHSWLLVGSRTEVTQVNTTNCGRLQSCSECILAQDPVCAWSFRLDECVAHAGEHRGLVQDIESADVSSLCPKEPGERPVVFEVPVATAAHVVLPCSPSSAWASCVWHQPSGVTALTPRRDGLEVVVTPGAMGAYACECQEGGAAHVVAAYSLVWGSQRDAPSRAHTVGAGLAGFFLGILAASLTLILIGRRQQRRRQRELLARDKVGLDLGAPPSGTTSYSQDPPSPSPEDERLPLALAKRGSGFGGFSPPFLLDPCPSPAHIRLTGAPLATCDETSI

SEQ ID NO: 3895 - protein, 838 aa, unidentified
MWGRLWPLLLSILTATAVPGPSLRRPSRELDATPRMTIPYEELSGTRHFKGQAQNYSTLLLEEASARLLVGARGALFSLSANDIGDGAHKEIHWEASPEMQSKCHQKGKNNQTECFNHVRFLQRLNSTHLYACGTHAFQPLCAAIDAEAFTLPTSFEEGKEKCPYDPARGFTGLIIDGGLYTATRYEFRSIPDIRRSRHPHSLRTEETPMHWLNDAEFVFSVLVRESKASAVGDDDKVYYFFTERATEEGSGSFTQSRSSHRVARVARVCKGDLGGKKILQKKWTSFLKARLICHIPLYETLRGVCSLDAETSSRTHFYAAFTLSTQWKTLEASAICRYDLAEIQAVFAGPYMEYQDGSRRWGRYEGGVPEPRPGSCITDSLRSQGYNSSQDLPSLVLDFVKLHPLMARPVVPTRGRPLLLKRNIRYTHLTGTPVTTPAGPTYDLLFLGTADGWIHKAVVLGSGMHIIEETQVFRESQSVENLVISLLQHSLYVGAPSGVIQLPLSSCSRYRSCYDCILARDPYCGWDPGTHACAAATTIANRTALIQDIERGNRGCESSRDTGPPPPLKTRSVLRGDDVLLPCDQPSNLARALWLLNGSMGLSDGQGGYRVGVDGLLVTDAQPEHSGNYGCYAEENGLRTLLASYSLTVRPATPAPAPKAPATPGAQLAPDVRLLYVLAIAALGGLCLILASSLLYVACLREGRRGRRRKYSLGRASRAGGSAVQLQTVSGQCPGEEDEGDDEGAGGLEGSCLQIIPGEGAPAPPPPPPPPPPAELTNGLVALPSRLRRMNGNSYVLLRQSNNGVPAGPCSFAEELSRILEKRKHTQLVEQLDESSV

SEQ ID NO: 3896 - protein, 1074 aa, unidentified
MKGTCVIAWLFSSLGLWRLAHPEAQGTTQCQRTEHPVISYKEIGPWLREFRAKNAVDFSQLTFDPGQKELVVGARNYLFRLQLEDLSLIQAVEWECDEATKKACYSKGKSKEECQNYIRVLLVGGDRLFTCGTNAFTPVCTNRSLSNLTEIHDQISGMARCPYSPQHNSTALLTAGGELYAATAMDFPGRDPAIYRSLGILPPLRTAQYNSKWLNEPNFVSSYDIGNFTYFFFRENAVEHDCGKTVFSRAARVCKNDIGGRFLLEDTWTTFMKARLNCSRPGEVPFYYNELQSTFFLPELDLIYGIFTTNVNSIAASAVCVFNLSAIAQAFSGPFKYQENSRSAWLPYPNPNPHFQCGTVDQGLYVNLTERNLQDAQKFILMHEVVQPVTTVPSFMEDNSRFSHVAVDVVQGREALVHIIYLATDYGTIKKVRVPLNQTSSSCLLEEIELFPERRREPIRSLQILHSQSVLFVGLREHVVKIPLKRCQFYRTRSTCIGAQDPYCGWDVVMKKCTSLEESLSMTQWEQSISACPTRNLTVDGHFGVWSPWTPCTHTDGSAVGSCLCRTRSCDSPAPQCGGWQCEGPGMEIANCSRNGGWTPWTSWSPCSTTCGIGFQVRQRSCSNPTPRHGGRVCVGQNREERYCNEHLLCPPHMFWTGWGPWERCTAQCGGGIQARRRICENGPDCAGCNVEYQSCNTNPCPELKKTTPWTPWTPVNISDNGGHYEQRFRYTCKARLADPNLLEVGRQRIEMRYCSSDGTSGCSTDGLSGDFLRAGRYSAHTVNGAWSAWTSWSQCSRDCSRGIRNRKRVCNNPEPKYGGMPCLGPSLEYQECNILPCPVDGVWSCWSPWTKCSATCGGGHYMRTRSCSNPAPAYGGDICLGLHTEEALCNTQPCPESWSEWSDWSECEASGVQVRARQCILLFPMGSQCSGNTTESRPCVFDSNFIPEVSVARSSSVEEKRCGEFNMFHMIAVGLSSSILGCLLTLLVYTYCQRYQQQSHDATVIHPVSPAPLNTSITNHINKLDKYDSVEAIKAFNKNNLILEERNKYFNPHLTGKTYSNAYFTDLNNYDEY

SEQ ID NO: 3897 - protein, 1151 aa, unidentified
MPCGFSPSPVAHHLVPGPPDTPAQQLRCGWTVGGWLLSLVRGLLPCLPPGARTAEGPIMVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTIEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGAWTPWSSWALCSTSCGIGFQVRQRSCSNPAPRHGGRICVGKSREERFCNENTPCPVPIFWASWGSWSKCSSNCGGGMQSRRRACENGNSCLGCGVEFKTCNPEGCPEVRRNTPWTPWLPVNVTQGGARQEQRFRFTCRAPLADPHGLQFGRRRTETRTCPADGSGSCDTDALVEVLLRSGSTSPHTVSGGWAAWGPWSSCSRDCELGFRVRKRTCTNPEPRNGGLPCVGDAAEYQDCNPQACPVRGAWSCWTSWSPCSASCGGGHYQRTRSCTSPAPSPGEDICLGLHTEEALCATQACPEGWSPWSEWSKCTDDGAQSRSRHCEELLPGSSACAGNSSQSRPCPYSEIPVILPASSMEEATDCAGFNLIHLVATGISCFLGSGLLTLAVYLSCQHCQRQSQESTLVHPATPNHLHYKGGGTPKNEKYTPMEFKTLNKNNLIPDDRANFYPLQQTNVYTTTYYPSPLNKHSFRPEASPGQRCFPNS

SEQ ID NO: 3898 - protein, 1030 aa, unidentified
MRSEALLLYFTLLHFAGAGFPEDSEPISISHGNYTKQYPVFVGHKPGRNTTQRHRLDIQMIMIMNGTLYIAARDHIYTVDIDTSHTEEIYCSKKLTWKSRQADVDTCRMKGKHKDECHNFIKVLLKKNDDALFVCGTNAFNPSCRNYKMDTLEPFGDEFSGMARCPYDAKHANVALFADGKLYSATVTDFLAIDAVIYRSLGESPTLRTVKHDSKWLKEPYFVQAVDYGDYIYFFFREIAVEYNTMGKVVFPRVAQVCKNDMGGSQRVLEKQWTSFLKARLNCSVPGDSHFYFNILQAVTDVIRINGRDVVLATFSTPYNSIPGSAVCAYDMLDIASVFTGRFKEQKSPDSTWTPVPDERVPKPRPGCCAGSSSLERYATSNEFPDDTLNFIKTHPLMDEAVPSIFNRPWFLRTMVRYRLTKIAVDTAAGPYQNHTVVFLGSEKGIILKFLARIGNSGFLNDSLFLEEMSVYNSEKCSYDGVEDKRIMGMQLDRASSSLYVAFSTCVIKVPLGRCERYGKCKKTCIASRDPYCGWIKEGGACSHLSPNSRLTFEQDIERGNTDGLGDCHNSFVALNGHSSSLLPSTTTSDSTAQEGYESRGGMLDWKHLLDSPDSTDPLGAVSSHNHQDKKGVIRESYLKGHDQLVPVTLLAIAVILAFVMGAVFSGITVYCVCDHRRKDVAVVQRKEKELTHSRRGSMSSVTKLSGLFGDTQSKDPKPEAILTPLMHNGKLATPGNTAKMLIKADQHHLDLTALPTPESTPTLQQKRKPSRGSREWERNQNLINACTKDMPPMGSPVIPTDLPLRASPSHIPSVVVLPITQQGYQHEYVDQPKMSEVAQMALEDQAATLEYKTIKEHLSSKSPNHGVNLVENLDSLPPKVPQREASLGPPGASLSQTGLSKRLEMHHSSSYGVDYKRSYPTNSLTRSHQATTLKRNNTNSSNSSHLSRNQSFGRGDNPPPAPQRVDSIQVHSSQPSGQAVTVSRQPSLNAYNSLTRSGLKRTPSLKPDVPPKPSFAPLSTSMKPNDACT

SEQ ID NO: 3899 - protein, 888 aa, unidentified
MQTPRASPPRPALLLLLLLLGGAHGLFPEEPPPLSVAPRDYLNHYPVFVGSGPGRLTPAEGADDLNIQRVLRVNRTLFIGDRDNLYRVELEPPTSTELRYQRKLTWRSNPSDINVCRMKGKQEGECRNFVKVLLLRDESTLFVCGSNAFNPVCANYSIDTLQPVGDNISGMARCPYDPKHANVALFSDGMLFTATVTDFLAIDAVIYRSLGDRPTLRTVKHDSKWFKEPYFVHAVEWGSHVYFFFREIAMEFNYLEKVVVSRVARVCKNDVGGSPRVLEKQWTSFLKARLNCSVPGDSHFYFNVLQAVTGVVSLGGRPVVLAVFSTPSNSIPGSAVCAFDLTQVAAVFEGRFREQKSPESIWTPVPEDQVPRPRPGCCAAPGMQYNASSALPDDILNFVKTHPLMDEAVPSLGHAPWILRTLMRHQLTRVAVDVGAGPWGNQTVVFLGSEAGTVLKFLVRPNASTSGTSGLSVFLEEFETYRPDRCGRPGGGETGQRLLSLELDAASGGLLAAFPRCVVRVPVARCQQYSGCMKNCIGSQDPYCGWAPDGSCIFLSPGTRAAFEQDVSGASTSGLGDCTGLLRASLSEDRAGLVSVNLLVTSSVAAFVVGAVVSGFSVGWFVGLRERRELARRKDKEAILAHGAGEAVLSVSRLGERRAQGPGGRGGGGGGGAGVPPEALLAPLMQNGWAKATLLQGGPHDLDSGLLPTPEQTPLPQKRLPTPHPHPHALGPRAWDHGHPLLPASASSSLLLLAPARAPEQPPAPGEPTPDGRLYAARPGRASHGDFPLTPHASPDRRRVVSAPTGPLDPASAADGLPRPWSPPPTGSLRRPLGPHAPPAATLRRTHTFNSGEARPGDRHRGCHARPGTDLAHLLPYGGADRTAPPVP

SEQ ID NO: 3900 - protein, 930 aa, unidentified
MPRAPHFMPLLLLLLLLSLPHTQAAFPQDPLPLLISDLQGTSPLSWFRGLEDDAVAAELGLDFQRFLTLNRTLLVAARDHVFSFDLQAEEEGEGLVPNKYLTWRSQDVENCAVRGKLTDECYNYIRVLVPWDSQTLLACGTNSFSPVCRSYGITSLQQEGEELSGQARCPFDATQSNVAIFAEGSLYSATAADFQASDAVVYRSLGPQPPLRSAKYDSKWLREPHFVQALEHGDHVYFFFREVSVEDARLGRVQFSRVARVCKRDMGGSPRALDRHWTSFLKLRLNCSVPGDSTFYFDVLQALTGPVNLHGRSALFGVFTTQTNSIPGSAVCAFYLDEIERGFEGKFKEQRSLDGAWTPVSEDRVPSPRPGSCAGVGGAALFSSSRDLPDDVLTFIKAHPLLDPAVPPVTHQPLLTLTSRALLTQVAVDGMAGPHSNITVMFLGSNDGTVLKVLTPGGRSGGPEPILLEEIDAYSPARCSGKRTAQTARRIIGLELDTEGHRLFVAFSGCIVYLPLSRCARHGACQRSCLASQDPYCGWHSSRGCVDIRGSGGTDVDQAGNQESMEHGDCQDGATGSQSGPGDSAYGVRRDLPPASASRSVPIPLLLASVAAAFALGASVSGLLVSCACRRAHRRRGKDIETPGLPRPLSLRSLARLHGGGPEPPPPSKDGDAVQTPQLYTTFLPPPEGVPPPELACLPTPESTPELPVKHLRAAGDPWEWNQNRNNAKEGPGRSRGGHAAGGPAPRVLVRPPPPGCPGQAVEVTTLEELLRYLHGPQPPRKGAEPPAPLTSRALPPEPAPALLGGPSPRPHECASPLRLDVPPEGRCASAPARPALSAPAPRLGVGGGRRLPFSGHRAPPALLTRVPSGGPSRYSGGPGKHLLYLGRPEGYRGRALKRVDVEKPQLSLKPPLVGPSSRQAVPNGGRFNF

SEQ ID NO: 3901 - protein, 1073 aa, unidentified
MRVFLLCAYILLLMVSQLRAVSFPEDDEPLNTVDYHYSRQYPVFRGRPSGNESQHRLDFQLMLKIRDTLYIAGRDQVYTVNLNEMPKTEVIPNKKLTWRSRQQDRENCAMKGKHKDECHNFIKVFVPRNDEMVFVCGTNAFNPMCRYYRLSTLEYDGEEISGLARCPFDARQTNVALFADGKLYSATVADFLASDAVIYRSMGDGSALRTIKYDSKWIKEPHFLHAIEYGNYVYFFFREIAVEHNNLGKAVYSRVARICKNDMGGSQRVLEKHWTSFLKARLNCSVPGDSFFYFDVLQSITDIIQINGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAKCSAENEEDKKVISLQLDKDHHALYVAFSSCIIRIPLSRCERYGSCKKSCIASRDPYCGWLSQGSCGRVTPGMLAEGYEQDTEFGNTAHLGDCHEILPTSTTPDYKIFGGPTSDMEVSSSSVTTMASIPEITPKVIDTWRPKLTSSRKFVVQDDPNTSDFTDPLSGIPKGVRWEVQSGESNQMVHMNVLITCVFAAFVLGAFIAGVAVYCYRDMFVRKNRKIHKDAESAQSCTDSSGSFAKLNGLFDSPVKEYQQNIDSPKLYSNLLTSRKELPPNGDTKSMVMDHRGQPPELAALPTPESTPVLHQKTLQAMKSHSEKAHGHGASRKETPQFFPSSPPPHSPLSHGHIPSAIVLPNATHDYNTSFSNSNAHKAEKKLQNIDHPLTKSSSKRDHRRSVDSRNTLNDLLKHLNDPNSNPKAIMGDIQMAHQNLMLDPMGSMSEVPPKVPNREASLYSPPSTLPRNSPTKRVDVPTTPGVPMTSLERQRGYHKNSSQRHSISAMPKNLNSPNGVLLSRQPSMNRGGYMPTPTGAKVDYIQGTPVSVHLQPSLSRQSSYTSNGTLPRTGLKRTPSLKPDVPPKPSFVPQTPSVRPLNKYTY

SEQ ID NO: 3902 - protein, 666 aa, unidentified
MTPPPPGRAAPSAPRARVPGPPARLGLPLRLRLLLLLWAAAASAQGHLRSGPRIFAVWKGHVGQDRVDFGQTEPHTVLFHEPGSSSVWVGGRGKVYLFDFPEGKNASVRTVNIGSTKGSCLDKRDCENYITLLERRSEGLLACGTNARHPSCWNLVNGTVVPLGEMRGYAPFSPDENSLVLFEGDEVYSTIRKQEYNGKIPRFRRIRGESELYTSDTVMQNPQFIKATIVHQDQAYDDKIYYFFREDNPDKNPEAPLNVSRVAQLCRGDQGGESSLSVSKWNTFLKAMLVCSDAATNKNFNRLQDVFLLPDPSGQWRDTRVYGVFSNPWNYSAVCVYSLGDIDKVFRTSSLKGYHSSLPNPRPGKCLPDQQPIPTETFQVADRHPEVAQRVEPMGPLKTPLFHSKYHYQKVAVHRMQASHGETFHVLYLTTDRGTIHKVVEPGEQEHSFAFNIMEIQPFRRAAAIQTMSLDAERRKLYVSSQWEVSQVPLDLCEVYGGGCHGCLMSRDPYCGWDQGRCISIYSSERSVLQSINPAEPHKECPNPKPDKAPLQKVSLAPNSRYYLSCPMESRHATYSWRHKENVEQSCEPGHQSPNCILFIENLTAQQYGHYFCEAQEGSYFREAQHWQLLPEDGIMAEHLLGHACALAASLWLGVLPTLTLGLLVH

SEQ ID NO: 3903 - protein, 654 aa, unidentified
MSLAAYCVICCRRIGTSTSPPKSGTHWRDIRNIIKFTGSLILGGSLFLTYEVLALKKAVTLDTQVVEREKMKSYIYVHTVSLDKGENHGIAWQARKELHKAVRKVLATSAKILRNPFADPFSTVDIEDHECAVWLLLRKSKSDDKTTRLEAVREMSETHHWHDYQYRIIAQACDPKTLIGLARSEESDLRFFLLPPPLPSLKEDSSTEEELRQLLASLPQTELDECIQYFTSLALSESSQSLAAQKGGLWCFGGNGLPYAESFGEVPSATVEMFCLEAIVKHSEISTHCDKIEANGGLQLLQRLYRLHKDCPKVQRNIMRVIGNMALNEHLHSSIVRSGWVSIMAEAMKSPHIMESSHAARILANLDRETVQEKYQDGVYVLHPQYRTSQPIKADVLFIHGLMGAAFKTWRQQDSEQAVIEKPMEDEDRYTTCWPKTWLAKDCPALRIISVEYDTSLSDWRARCPMERKSIAFRSNELLRKLRAAGVGDRPVVWISHSMGGLLVKKMLLEASTKPEMSTVINNTRGIIFYSVPHHGSRLAEYSVNIRYLLFPSLEVKELSKDSPALKTLQDDFLEFAKDKNFQVLNFVETLPTYIGSMIKLHVVPVESADLGIGDLIPVDVNHLNICKPKKKDAFLYQRTLQFIREALAKDLEN

SEQ ID NO: 3904 - protein, 110 aa, unidentified
MARGNQRELARQKNMKKTQEISKGKRKEDSLTASQRKQSSGGQKSESKMSAGPHLPLKAPRENPCFPLPAAGGSRYYLAYGSITPISAFVFVVFFSVFFPSFYEDFCCWI

SEQ ID NO: 3905 - protein, 110 aa, unidentified; identical to SEQ ID NO: 3904

SEQ ID NO: 3906 - protein, 453 aa, unidentified
MGSVLGLCSMASWIPCLCGSAPCLLCRCCPSGNNSTVTRLIYALFLLVGVCVACVMLIPGMEEQLNKIPGFCENEKGVVPCNILVGYKAVYRLCFGLAMFYLLLSLLMIKVKSSSDPRAAVHNGFWFFKFAAAIAIIIGAFFIPEGTFTTVWFYVGMAGAFCFILIQLVLLIDFAHSWNESWVEKMEEGNSRCWYAALLSATALNYLLSLVAIVLFFVYYTHPASCSENKAFISVNMLLCVGASVMSILPKIQESQPRSGLLQSSVITVYTMYLTWSAMTNEPETNCNPSLLSIIGYNTTSTVPKEGQSVQWWHAQGIIGLILFLLCVFYSSIRTSNNSQVNKLTLTSDESTLIEDGGARSDGSLEDGDDVHRAVDNERDGVTYSYSFFHFMLFLASLYIMMTLTNWYRYEPSREMKSQWTAVWVKISSSWIGIVLYVWTLVAPLVLTNRDFD

SEQ ID NO: 3907 - protein, 455 aa, unidentified
MGACLGACSLLSCASCLCGSAPCILCSCCPASRNSTVSRLIFTFFLFLGVLVSIIMLSPGVESQLYKLPWVCEEGAGIPTVLQGHIDCGSLLGYRAVYRMCFATAAFFFFFTLLMLCVSSSRDPRAAIQNGFWFFKFLILVGLTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPHLPTQLGNETVVAGPEGYETQWWDAPSIVGLIIFLLCTLFISLRSSDHRQVNSLMQTEECPPMLDATQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 3908 - protein, 473 aa, unidentified
MGAVLGVFSLASWVPCLCSGASCLLCSCCPNSKNSTVTRLIYAFILLLSTVVSYIMQRKEMETYLKKIPGFCEGGFKIHEADINADKDCDVLVGYKAVYRISFAMAIFFFVFSLLMFKVKTSKDLRAAVHNGFWFFKIAALIGIMVGSFYIPGGYFSSVWFVVGMIGAALFILIQLVLLVDFAHSWNESWVNRMEEGNPRLWYAALLSFTSAFYILSIICVGLLYTYYTKPDGCTENKFFISINLILCVVASIISIHPKIQEHQPRSGLLQSSLITLYTMYLTWSAMSNEPDRSCNPNLMSFITRITAPTLAPGNSTAVVPTPTPPSKSGSLLDSDNFIGLFVFVLCLLYSSIRTSTNSQVDKLTLSGSDSVILGDTTTSGASDEEDGQPRRAVDNEKEGVQYSYSLFHLMLCLASLYIMMTLTSWYSPDAKFQSMTSKWPAVWVKISSSWVCLLLYVWTLVAPLVLTSRDFS

SEQ ID NO: 3909 - protein, 518 aa, unidentified
MVGAKAGPSPGTSLGLAQQHSGGSSVLVKSPFCQVCCCGPAPCASCCHSRWPSLTASTCSRLFYILLHVGASAICCLLLSRTVVERVWGKTHRIQMPSGLCAHLFGLSDCPVLSGSGAVYRVCAGTATFHLLQAVLLVHLHSPTSPRAQLHNSFWLLKLLFLLGLCAIAFCIPDEHLFPAWHYIGICGGFAFILLQLVLITAFAHSWNKNWQTGAAQDCSWFLAVLLATLGFYSMAGVGAVLLFHYYTHPAGCLLNKMLLSLHLCFCGLISFLSIAPCIRLKQPRSGLLQASVISCYIMYLTFSALSSRPPERVILQGQNHTLCLPGLSKMEPQTPDISLAMLSASIMYACVLFACNEASYLAEVFGPLWIVKVYSYEFQKPSLCFCCPETVEADKGQRGGAARPADQETPPAPPVQVQHLSYNYSAFHFVFFLASLYVMVTLTNWFSYEGAELEKTFIKGSWATFWVKVASCWACVLLYLGLLLAPLCWPPTQKPQPLILRRRRHRIISPDNKYPPV

SEQ ID NO: 3910 - protein, 423 aa, unidentified
MSAQCCAGQLACCCGSAGCSLCCDCCPRIRQSLSTRFMYALYFILVVVLCCIMMSTTVAHKMKEHIPFFEDMCKGIKAGDTCEKLVGYSAVYRVCFGMACFFFIFCLLTLKINNSKSCRAHIHNGFWFFKLLLLGAMCSGAFFIPDQDTFLNAWRYVGAVGGFLFIGIQLLLLVEFAHKWNKNWTAGTASNKLWYASLALVTLIMYSIATGGLVLMAVFYTQKDSCMENKILLGVNGGLCLLISLVAISPWVQNRQPHSGLLQSGVISCYVTYLTFSALSSKPAEVVLDEHGKNVTICVPDFGQDLYRDENLVTILGTSLLIGCILYSCLTSTTRSSSDALQGRYAAPELEIARCCFCFSPGGEDTEEQQPGKEGPRVIYDEKKGTVYIYSYFHFVFFLASLYVMMTVTNWFNHVRSAFHLLP

SEQ ID NO: 3911 - protein, 66 aa, unidentified
MVAKQRIRMANEKHSKNITQRGNVAKTSRNAPEEKASVGPWLLALFIFVVCGSAIFQIIQSIRMGM

SEQ ID NO: 3912 - protein, 65 aa, unidentified
MVAKQRIRMANEKHSKNITQRGNVAKTLRPQEEKYPVGPWLLALFVFVVCGSAIFQIIQSIRMGM

SEQ ID NO: 3913 - protein, 444 aa, unidentified
MKVVPSLLLSVLLAQVWLVPGLAPSPQSPETPAPQNQTSRVVQAPKEEEEDEQEASEEKASEEEKAWLMASRQQLAKETSNFGFSLLRKISMRHDGNMVFSPFGMSLAMTGLMLGATGPTETQIKRGLHLQALKPTKPGLLPSLFKGLRETLSRNLELGLTQGSFAFIHKDFDVKETFFNLSKRYFDTECVPMNFRNASQAKRLMNHYINKETRGKIPKLFDEINPETKLILVDYILFKGKWLTPFDPVFTEVDTFHLDKYKTIKVPMMYGAGKFASTFDKNFRCHVLKLPYQGNATMLVVLMEKMGDHLALEDYLTTDLVETWLRNMKTRNMEVFFPKFKLDQKYEMHELLRQMGIRRIFSPFADLSELSATGRNLQVSRVLQRTVIEVDERGTEAVAGILSEITAYSMPPVIKVDRPFHFMIYEETSGMLLFLGRVVNPTLL

SEQ ID NO: 3914 - protein, 391 aa, unidentified
MDSLGAVSTRLGFDLFKELKKTNDGNIFFSPVGILTAIGMVLLGTRGATASQLEEVFHSEKETKSSRIKAEEKEVIENTEAVHQQFQKFLTEISKLTNDYELNITNRLFGEKTYLFLQKYLDYVEKYYHASLEPVDFVNAADESRKKINSWVESKTNEKIKDLFPDGSISSSTKLVLVNMVYFKGQWDREFKKENTKEEKFWMNKSTSKSVQMMTQSHSFSFTFLEDLQAKILGIPYKNNDLSMFVLLPNDIDGLEKIIDKISPEKLVEWTSPGHMEERKVNLHLPRFEVEDGYDLEAVLAAMGMGDAFSEHKADYSGMSSGSGLYAQKFLHSSFVAVTEEGTEAAAATGIGFTVTSAPGHENVHCNHPFLFFIRHNESNSILFFGRFSSP

SEQ ID NO: 3915 - protein, 107 aa, unidentified
MSEPDTSSGFSGSVENGTFLELFPTSLSTSVDPSSGHLSNVYIYVSIFLSLLAFLLLLLIIALQRLKNIISSSSSYPEYPSDAGSSFTNLEVCSISSQRSTFSNLSS

SEQ ID NO: 3916 - protein, 1291 aa, unidentified
MSSLPGCIGLDAATATVESEEIAELQQAVVEELGISMEELRHFIDEELEKMDCVQQRKKQLAELETWVIQKESEVAHVDQLFDDASRAVTNCESLVKDFYSKLGLQYRDSSSEDESSRPTEIIEIPDEDDDVLSIDSGDAGSRTPKDQKLREAMAALRKSAQDVQKFMDAVNKKSSSQDLHKGTLSQMSGELSKDGDLIVSMRILGKKRTKTWHKGTLIAIQTVGPGKKYKVKFDNKGKSLLSGNHIAYDYHPPADKLYVGSRVVAKYKDGNQVWLYAGIVAETPNVKNKLRFLIFFDDGYASYVTQSELYPICRPLKKTWEDIEDISCRDFIEEYVTAYPNRPMVLLKSGQLIKTEWEGTWWKSRVEEVDGSLVRILFLDDKRCEWIYRGSTRLEPMFSMKTSSASALEKKQGQLRTRPNMGAVRSKGPVVQYTQDLTGTGTQFKPVEPPQPTAPPAPPFPPAPPLSPQAGDSDLESQLAQSRKQVAKKSTSFRPGSVGSGHSSPTSPALSENVSGGKPGINQTYRSPLGSTASAPAPSALPAPPAPPVFHGMLERAPAEPSYRAPMEKLFYLPHVCSYTCLSRVRPMRNEQYRGKNPLLVPLLYDFRRMTARRRVNRKMGFHVIYKTPCGLCLRTMQEIERYLFETGCDFLFLEMFCLDPYVLVDRKFQPYKPFYYILDITYGKEDVPLSCVNEIDTTPPPQVAYSKERIPGKGVFINTGPEFLVGCDCKDGCRDKSKCACHQLTIQATACTPGGQINPNSGYQYKRLEECLPTGVYECNKRCKCDPNMCTNRLVQHGLQVRLQLFKTQNKGWGIRCLDDIAKGSFVCIYAGKILTDDFADKEGLEMGDEYFANLDHIESVENFKEGYESDAPCSSDSSGVDLKDQEDGNSGTEDPEESNDDSSDDNFCKDEDFSTSSVWRSYATRRQTRGQKENGLSETTSKDSHPPDLGPPHIPVPPSIPVGGCNPPSSEETPKNKVASWLSCNSVSEGGFADSDSHSSFKTNEGGEGRAGGSRMEAEKASTSGLGIKDEGDIKQAKKEDTDDRNKMSVVTESSRNYGYNPSPVKPEGLRRPPSKTSMHQSRRLMASAQSNPDDVLTLSSSTESEGESGTSRKPTAGQTSATAVDSDDIQTISSGSEGDDFEDKKNMTGPMKRQVAVKSTRGFALKSTHGIAIKSTNMASVDKGESAPVRKNTRQFYDGEESCYIIDAKLEGNLGRYLNHSCSPNLFVQNVFVDTHDLRFPWVAFFASKRIRAGTELTWDYNYEVGSVEGKELLCCCGAIECRGRLL

SEQ ID NO: 3917 - protein, 994 aa, unidentified
MRPVALLLLPSLLALLAHGLSLEAPTVGKGQAPGIEETDGELTAAPTPEQPERGVHFVTTAPTLKLLNHHPLLEEFLQEGLEKGDEELRPALPFQPDPPAPFTPSPLPRLANQDSRPVFTSPTPAMAAVPTQPQSKEGPWSPESESPMLRITAPLPPGPSMAVPTLGPGEIASTTPPSRAWTPTQEGPGDMGRPWVAEVVSQGAGIGIQGTITSSTASGDDEETTTTTTIITTTITTVQTPGPCSWNFSGPEGSLDSPTDLSSPTDVGLDCFFYISVYPGYGVEIKVQNISLREGETVTVEGLGGPDPLPLANQSFLLRGQVIRSPTHQAALRFQSLPPPAGPGTFHFHYQAYLLSCHFPRRPAYGDVTVTSLHPGGSARFHCATGYQLKGARHLTCLNATQPFWDSKEPVCIAACGGVIRNATTGRIVSPGFPGNYSNNLTCHWLLEAPEGQRLHLHFEKVSLAEDDDRLIIRNGDNVEAPPVYDSYEVEYLPIEGLLSSGKHFFVELSTDSSGAAAGMALRYEAFQQGHCYEPFVKYGNFSSSTPTYPVGTTVEFSCDPGYTLEQGSIIIECVDPHDPQWNETEPACRAVCSGEITDSAGVVLSPNWPEPYGRGQDCIWGVHVEEDKRIMLDIRVLRIGPGDVLTFYDGDDLTARVLGQYSGPRSHFKLFTSMADVTIQFQSDPGTSVLGYQQGFVIHFFEVPRNDTCPELPEIPNGWKSPSQPELVHGTVVTYQCYPGYQVVGSSVLMCQWDLTWSEDLPSCQRVTSCHDPGDVEHSRRLISSPKFPVGATVQYICDQGFVLMGSSILTCHDRQAGSPKWSDRAPKCLLEQLKPCHGLSAPENGARSPEKQLHPAGATIHFSCAPGYVLKGQASIKCVPGHPSHWSDPPPICRAASLDGFYNSRSLDVAKAPAASSTLDAAHIAAAIFLPLVAMVLLVGGVYFYFSRLQGKSSLQLPRPRPRPYNRITIESAFDNPTYETGSLSFAGDERI

SEQ ID NO: 3918 - protein, 1024 aa, unidentified
MPAARPPAAGLRGISLFLALLLGSPAAALERDALPEGDASPLGPYLLPSGAPERGSPGKEHPEERVVTAPPSSSQSAEVLGELVLDGTAPSAHHDIPALSPLLPEEARPKHALPPKKKLPSLKQVNSARKQLRPKATSAATVQRAGSQPASQGLDLLSSSTEKPGPPGDPDPIVASEEASEVPLWLDRKESAVPTTPAPLQISPFTSQPYVAHTLPQRPEPGEPGPDMAQEAPQEDTSPMALMDKGENELTGSASEESQETTTSTIITTTVITTEQAPALCSVSFSNPEGYIDSSDYPLLPLNNFLECTYNVTVYTGYGVELQVKSVNLSDGELLSIRGVDGPTLTVLANQTLLVEGQVIRSPTNTISVYFRTFQDDGLGTFQLHYQAFMLSCNFPRRPDSGDVTVMDLHSGGVAHFHCHLGYELQGAKMLTCINASKPHWSSQEPICSAPCGGAVHNATIGRVLSPSYPENTNGSQFCIWTIEAPEGQKLHLHFERLLLHDKDRMTVHSGQTNKSALLYDSLQTESVPFEGLLSEGNTIRIEFTSDQARAASTFNIRFEAFEKGHCYEPYIQNGNFTTSDPTYNIGTIVEFTCDPGHSLEQGPAIIECINVRDPYWNDTEPLCRAMCGGELSAVAGVVLSPNWPEPYVEGEDCIWKIHVGEEKRIFLDIQFLNLSNSDILTIYDGDEVMPHILGQYLGNSGPQKLYSSTPDLTIQFHSDPAGLIFGKGQGFIMNYIEVSRNDSCSDLPEIQNGWKTTSHTELVRGARITYQCDPGYDIVGSDTLTCQWDLSWSSDPPFCEKIMYCTDPGEVDHSTRLISDPVLLVGTTIQYTCNPGFVLEGSSLLTCYSRETGTPIWTSRLPHCVSEESLACDNPGLPENGYQILYKRLYLPGESLTFMCYEGFELMGEVTIRCILGQPSHWNGPLPVCKVNQDSFEHALEVAEAAAETSLEGGNMALAIFIPVLIISLLLGGAYIYITRCRYYSNLRLPLMYSHPYSQITVETEFDNPIYETGETREYEVSI

SEQ ID NO: 3919 - protein, 910 aa, unidentified
MGTPRAQHPPPPQLLFLILLSCPWIQGLPLKEEEILPEPGSETPTVASEALAELLHGALLRRGPEMGYLPGSDRDPTLATPPAGQTLAVPSLPRATEPGTGPLTTAVTPNGVRGAGPTAPELLTPPPGTTAPPPPSPASPGPPLGPEGGEEETTTTIITTTTVTTTVTSPVLCNNNISEGEGYVESPDLGSPVSRTLGLLDCTYSIHVYPGYGIEIQVQTLNLSQEEELLVLAGGGSPGLAPRLLANSSMLGEGQVLRSPTNRLLLHFQSPRVPRGGGFRIHYQAYLLSCGFPPRPAHGDVSVTDLHPGGTATFHCDSGYQLQGEETLICLNGTRPSWNGETPSCMASCGGTIHNATLGRIVSPEPGGAVGPNLTCRWVIEAAEGRRLHLHFERVSLDEDNDRLMVRSGGSPLSPVIYDSDMDDVPERGLISDAQSLYVELLSETPANPLLLSLRFEAFEEDRCFAPFLAHGNVTTTDPEYRPGALATFSCLPGYALEPPGPPNAIECVDPTEPHWNDTEPACKAMCGGELSEPAGVVLSPDWPQSYSPGQDCVWGVHVQEEKRILLQVEILNVREGDMLTLFDGDGPSARVLAQLRGPQPRRRLLSSGPDLTLQFQAPPGPPNPGLGQGFVLHFKEVPRNDTCPELPPPEWGWRTASHGDLIRGTVLTYQCEPGYELLGSDILTCQWDLSWSAAPPACQKIMTCADPGEIANGHRTASDAGFPVGSHVQYRCLPGYSLEGAAMLTCYSRDTGTPKWSDRVPKCALKYEPCLNPGVPENGYQTLYKHHYQAGESLRFFCYEGFELIGEVTITCVPGHPSQWTSQPPLCKVTQTTDPSRQLEGGNLALAILLPLGLVIVLGSGVYIYYTKLQGKSLFGFSGSHSYSPITVESDFSNPLYEAGDTREYEVSI

SEQ ID NO: 3920 - protein, 1304 aa, unidentified
MAKIAKTHEDIEAQIREIQGKKAALDEAQGVGLDSTGYYDQEIYGGSDSRFAGYVTSIAATELEDDDDDYSSSTSLLGQKKPGYHAPVALLNDIPQSTEQYDPFAEHRPPKIADREDEYKKHRRTMIISPERLDPFADGGKTPDPKMNARTYMDVMREQHLTKEEREIRQQLAEKAKAGELKVVNGAAASQPPSKRKRRWDQTADQTPGATPKKLSSWDQAETPGHTPSLRWDETPGRAKGSETPGATPGSKIWDPTPSHTPAGAATPGRGDTPGHATPGHGGATSSARKNRWDETPKTERDTPGHGSGWAETPRTDRGGDSIGETPTPGASKRKSRWDETPASQMGGSTPVLTPGKTPIGTPAMNMATPTPGHIMSMTPEQLQAWRWEREIDERNRPLSDEELDAMFPEGYKVLPPPAGYVPIRTPARKLTATPTPLGGMTGFHMQTEDRTMKSVNDQPSGNLPFLKPDDIQYFDKLLVDVDESTLSPEEQKERKIMKLLLKIKNGTPPMRKAALRQITDKAREFGAGPLFNQILPLLMSPTLEDQERHLLVKVIDRILYKLDDLVRPYVHKILVVIEPLLIDEDYYARVEGREIISNLAKAAGLATMISTMRPDIDNMDEYVRNTTARAFAVVASALGIPSLLPFLKAVCKSKKSWQARHTGIKIVQQIAILMGCAILPHLRSLVEIIEHGLVDEQQKVRTISALAIAALAEAATPYGIESFDSVLKPLWKGIRQHRGKGLAAFLKAIGYLIPLMDAEYANYYTREVMLILIREFQSPDEEMKKIVLKVVKQCCGTDGVEANYIKTEILPPFFKHFWQHRMALDRRNYRQLVDTTVELANKVGAAEIISRIVDDLKDEAEQYRKMVMETIEKIMGNLGAADIDHKLEEQLIDGILYAFQEQTTEDSVMLNGFGTVVNALGKRVKPYLPQICGTVLWRLNNKSAKVRQQAADLISRTAVVMKTCQEEKLMGHLGVVLYEYLGEEYPEVLGSILGALKAIVNVIGMHKMTPPIKDLLPRLTPILKNRHEKVQENCIDLVGRIADRGAEYVSAREWMRICFELLELLKAHKKAIRRATVNTFGYIAKAIGPHDVLATLLNNLKVQERQNRVCTTVAIAIVAETCSPFTVLPALMNEYRVPELNVQNGVLKSLSFLFEYIGEMGKDYIYAVTPLLEDALMDRDLVHRQTASAVVQHMSLGVYGFGCEDSLNHLLNYVWPNVFETSPHVIQAVMGALEGLRVAIGPCRMLQYCLQGLFHPARKVRDVYWKIYNSIYIGSQDALIAHYPRIYNDDKNTYIRYELDYIL

SEQ ID NO: 3921 - protein, 159 aa, unidentified
MEKLRRVLSGQDDEEQGLTAQVLDASSLSFNTRLKWFAICFVCGVFFSILGTGLLWLPGGIKLFAVFYTLGNLAALASTCFLMGPVKQLKKMFEATRLLATIVMLLCFIFTLCAALWWHKKGLAVLFCILQFLSMTWYSLSYIPYARDAVIKCCSSLLS

SEQ ID NO: 3922 - protein, 160 aa, unidentified
MDKLKKVLSGQDTEDRSGLSEVVEASSLSWSTRIKGFIACFAIGILCSLLGTVLLWVPRKGLHLFAVFYTFGNIASIGSTIFLMGPVKQLKRMFEPTRLIATIMVLLCFALTLCSAFWWHNKGLALIFCILQSLALTWYSLSFIPFARDAVKKCFAVCLA

SEQ ID NO: 3923 - protein, 215 aa, unidentified
MADLHRQLQEYLAQGKAGGPAAAEPLLAAEKAEEPGDRPAEEWLGRAGLRWTWARSPAESAAAGLTCLPSVTRGQRLAAGGGCLLLAALCFGLAALYAPVLLLRARKFALLWSLGSALALAGSALLRGGAACGRLLRCEEAPSRPALLYMAALGATLFAALGLRSTLLTVLGAGAQVAALLAALVGLLPWGGGTALRLALGRLGRGAGLAKVLPV

SEQ ID NO: 3924 - protein, 322 aa, unidentified
MSGELPPNINIKEPRWDQSTFIGRANHFFTVTDPRNILLTNEQLESARKIVHDYRQGIVPPGLTENELWRAKYIYDSAFHPDTGEKMILIGRMSAQVPMNMTITGCMMTFYRTTPAVLFWQWINQSFNAVVNYTNRSGDAPLTVNELGTAYVSATTGAVATALGLNALTKHVSPLIGRFVPFAAVAAANCINIPLMRQRELKVGIPVTDENGNRLGESANAAKQAITQVVVSRILMAAPGMAIPPFIMNTLEKKAFLKRFPWMSAPIQVGLVGFCLVFATPLCCALFPQKSSMSVTSLEAELQAKIQESHPELRRVYFNKGL

SEQ ID NO: 3925 - protein, 322 aa, unidentified
MEADLSGFNIDAPRWDQRTFLGRVKHFLNITDPRTVFVSERELDWAKVMVEKSRMGVVPPGTQVEQLLYAKKLYDSAFHPDTGEKMNVIGRMSFQLPGGMIITGFMLQFYRTMPAVIFWQWVNQSFNALVNYTNRNAASPTSVRQMALSYFTATTTAVATAVGMNMLTKKAPPLVGRWVPFAAVAAANCVNIPMMRQQELIKGICVKDRNENEIGHSRRAAAIGITQVVISRITMSAPGMILLPVIMERLEKLHFMQKVKVLHAPLQVMLSGCFLIFMVPVACGLFPQKCELPVSYLEPKLQDTIKAKYGELEPYVYFNKGL

SEQ ID NO: 3926 - protein, 321 aa, unidentified
MGELPLDINIQEPRWDQSTFLGRARHFFTVTDPRNLLLSGAQLEASRNIVQNYRAGVVTPGITEDQLWRAKYVYDSAFHPDTGEKVVLIGRMSAQVPMNMTITGCMLTFYRKTPTVVFWQWVNQSFNAIVNYSNRSGDTPITVRQLGTAYVSATTGAVATALGLKSLTKHLPPLVGRFVPFAAVAAANCINIPLMRQRELQVGIPVADEAGQRLGYSVTAAKQGIFQVVISRICMAIPAMAIPPLIMDTLEKKDFLKRRPWLGAPLQVGLVGFCLVFATPLCCALFPQKSSIHISNLEPELRAQIHEQNPSVEVVYYNKGL

SEQ ID NO: 3927 - protein, 337 aa, unidentified
MSLEQEEETQPGRLLGRRDAVPAFIEPNVRFWITERQSFIRRFLQWTELLDPTNVFISVESIENSRQLLCTNEDVSSPASADQRIQEAWKRSLATVHPDSSNLIPKLFRPAAFLPFMAPTVFLSMTPLKGIKSVILPQVFLCAYMAAFNSINGNRSYTCKPLERSLLMAGAVASSTFLGVIPQFVQMKYGLTGPWIKRLLPVIFLVQASGMNVYMSRSLESIKGIAVMDKEGNVLGHSRIAGTKAVRETLASRIVLFGTSALIPEVFTYFFKRTQYFRKNPGSLWILKLSCTVLAMGLMVPFSFSIFPQIGQIQYCSLEEKIQSPTEETEIFYHRGV

SEQ ID NO: 3928 - protein, 340 aa, unidentified
MADTATTASAAAASAASASSDAPPFQLGKPRFQQTSFYGRFRHFLDIIDPRTLFVTERRLREAVQLLEDYKHGTLRPGVTNEQLWSAQKIKQAILHPDTNEKIFMPFRMSGYIPFGTPIVVGLLLPNQTLASTVFWQWLNQSHNACVNYANRNATKPSPASKFIQGYLGAVISAVSIAVGLNVLVQKANKFTPATRLLIQRFVPFPAVASANICNVVLMRYGELEEGIDVLDSDGNLVGSSKIAARHALLETALTRVVLPMPILVLPPIVMSMLEKTALLQARPRLLLPVQSLVCLAAFGLALPLAISLFPQMSEIETSQLEPEIAQATSSRTVVYNKGL

SEQ ID NO: 3929 - protein, 387 aa, unidentified
MAETLFWTPLLVVLLAGLGDTEAQQTTLHPLVGRVFVHTLDHETFLSLPEHVAVPPAVHITYHAHLQGHPDLPRWLRYTQRSPHHPGFLYGSATPEDRGLQVIEVTAYNRDSFDTTRQRLVLEIGDPEGPLLPYQAEFLVRSHDAEEVLPSTPASRFLSALGGLWEPGELQLLNVTSALDRGGRVPLPIEGRKEGVYIKVGSASPFSTCLKMVASPDSHARCAQGQPPLLSCYDTLAPHFRVDWCNVTLVDKSVPEPADEVPTPGDGILEHDPFFCPPTEAPDRDFLVDALVTLLVPLLVALLLTLLLAYVMCCRREGRLKRDLATSDIQMVHHCTIHGNTEELRQMAASREVPRPLSTLPMFNVHTGERLPPRVDSAQVPLILDQH

SEQ ID NO: 3930 - protein, 318 aa, unidentified
MAAAAAAAAEQQSSNGPVKKSMREKAVERRSVNKEHNSNFKAGYIPIDEDRLHKTGLRGRKGNLAICVIILLFILAVINLIITLVIWAVIRIGPNGCDSMEFHESGLLRFKQVSDMGVIHPLYKSTVGGRRNENLVITGNNQPIVFQQGTTKLSVENNKTSITSDIGMQFFDPRTQNILFSTDYETHEFHLPSGVKSLNVQKASTERITSNATSDLNIKVDGRAIVRGNEGVFIMGKTIEFHMGGNMELKAENSIILNGSVMVSTTRLPSSSSGDQLGSGDWVRYKLCMCADGTLFKVQVTSQNMGCQISDNPCGNTH

SEQ ID NO: 3931 - protein, 289 aa, unidentified
MPQEQYTHHRSTMPGSVGPQVYKVGIYGWRKRCLYFFVLLLMILILVNLAMTIWILKVMNFTIDGMGNLRITEKGLKLEGDSEFLQPLYAKEIQSRPGNALYFKSARNVTVNILNDQTKVLTQLITGPKAVEAYGKKFEVKTVSGKLLFSADNNEVVVGAERLRVLGAEGTVFPKSIETPNVRADPFKELRLESPTRSLVMEAPKGVEINAEAGNMEATCRTELRLESKDGEIKLDAAKIRLPRLPHGSYTPTGTRQKVFEICVCANGRLFLSQAGAGSTCQINTSVCL

SEQ ID NO: 3932 - protein, 437 aa, unidentified
MQLPRWWELGDPCAWTGQGRGTRRMSPATTGTFLLTVYSIFSKVHSDRNVYPSAGVLFVHVLEREYFKGEFPPYPKPGEISNDPITFNTNLMGYPDRPGWLRYIQRTPYSDGVLYGSPTAENVGKPTIIEITAYNRRTFETARHNLIINIMSAEDFPLPYQAEFFIKNMNVEEMLASEVLGDFLGAVKNVWQPERLNAINITSALDRGGRVPLPINDLKEGVYVMVGADVPFSSCLREVENPQNQLRCSQEMEPVITCDKKFRTQFYIDWCKISLVDKTKQVSTYQEVIRGEGILPDGGEYKPPSDSLKSRDYYTDFLITLAVPSAVALVLFLILAYIMCCRREGVEKRNMQTPDIQLVHHSAIQKSTKELRDMSKNREIAWPLSTLPVFHPVTGEIIPPLHTDNYDSTNMPLMQTQQNLPHQTQIPQQQTTGKWYP

SEQ ID NO: 3933 - protein, 291 aa, unidentified
MVREQYTTATEGICIERPENQYVYKIGIYGWRKRCLYLFVLLLLIILVVNLALTIWILKVMWFSPAGMGHLCVTKDGLRLEGESEFLFPLYAKEIHSRVDSSLLLQSTQNVTVNARNSEGEVTGRLKVGPKMVEVQNQQFQINSNDGKPLFTVDEKEVVVGTDKLRVTGPEGALFEHSVETPLVRADPFQDLRLESPTRSLSMDAPRGVHIQAHAGKIEALSQMDILFHSSDGMLVLDAETVCLPKLVQGTWGPSGSSQSLYEICVCPDGKLYLSVAGVSTTCQEHNHICL

SEQ ID NO: 3934 - protein, 299 aa, unidentified
MTREQYILATQQNNLPRTENAQLYPVGIYGWRKRCLYFFVLLLLVTMIVNLAMTIWILKVMNFTVDGMGNLRVTKKGIRLEGISEFLLPLYVKEIHSRKDSPLVLQSDRNVTVNARNHMGQLTGQLTIGADAVEAQCKRFEVRASEDGRVLFSADEDEITIGAEKLKVTGTEGAVFGHSVETPHIRAEPSQDLRLESPTRSLIMEAPRGVQVSAAAGDFKATCRKELHLQSTEGEIFLNAETIKLGNLPTGSFSSSSPSSSSSRQTVYELCVCPNGKLYLSPAGVGSTCQSSSNICLWS

SEQ ID NO: 3935 - protein, 413 aa, unidentified
MKEVVYWSPKKVADWLLENAMPEYCEPLEHFTGQDLINLTQEDFKKPPLCRVSSDNGQRLLDMIETLKMEHHLEAHKNGHANGHLNIGVDIPTPDGSFSIKIKPNGMPNGYRKEMIKIPMPELERSQYPMEWGKTFLAFLYALSCFVLTTVMISVVHERVPPKEVQPPLPDTFFDHFNRVQWAFSICEINGMILVGLWLIQWLLLKYKSIISRRFFCIVGTLYLYRCITMYVTTLPVPGMHFNCSPKLFGDWEAQLRRIMKLIAGGGLSITGSHNMCGDYLYSGHTVMLTLTYLFIKEYSPRRLWWYHWICWLLSVVGIFCILLAHDHYTVDVVVAYYITTRLFWWYHTMANQQVLKEASQMNLLARVWWYRPFQYFEKNVQGIVPRSYHWPFPWPVVHLSRQVKYSRLVNDT

SEQ ID NO: 3936 - protein, 365 aa, unidentified
MDIIETAKLEEHLENQPSDPTNTYARPAEPVEEENKNGNGKPKSLSSGLRKGTKKYPDYIQIAMPTESRNKFPLEWWKTGIAFIYAVFNLVLTTVMITVVHERVPPKELSPPLPDKFFDYIDRVKWAFSVSEINGIILVGLWITQWLFLRYKSIVGRRFCFIIGTLYLYRCITMYVTTLPVPGMHFQCAPKLNGDSQAKVQRILRLISGGGLSITGSHILCGDFLFSGHTVTLTLTYLFIKEYSPRHFWWYHLICWLLSAAGIICILVAHEHYTIDVIIAYYITTRLFWWYHSMANEKNLKVSSQTNFLSRAWWFPIFYFFEKNVQGSIPCCFSWPLSWPPGCFKSSCKKYSRVQKIGEDNEKST

SEQ ID NO: 3937 - protein, 568 aa, unidentified
MPSTDLLMLKAFEPYLEILEVYSTKAKNYVNGHCTKYEPWQLIAWSVVWTLLIVWGYEFVFQPESLWSRFKKKCFKLTRKMPIIGRKIQDKLNKTKDDISKNMSFLKVDKEYVKALPSQGLSSSAVLEKLKEYSSMDAFWQEGRASGTVYSGEEKLTELLVKAYGDFAWSNPLHPDIFPGLRKIEAEIVRIACSLFNGGPDSCGCVTSGGTESILMACKAYRDLAFEKGIKTPEIVAPQSAHAAFNKAASYFGMKIVRVPLTKMMEVDVRAMRRAISRNTAMLVCSTPQFPHGVIDPVPEVAKLAVKYKIPLHVDACLGGFLIVFMEKAGYPLEHPFDFRVKGVTSISADTHKYGYAPKGSSLVLYSDKKYRNYQFFVDTDWQGGIYASPTIAGSRPGGISAACWAALMHFGENGYVEATKQIIKTARFLKSELENIKGIFVFGNPQLSVIALGSRDFDIYRLSNLMTAKGWNLNQLQFPPSIHFCITLLHARKRVAIQFLKDIRESVTQIMKNPKAKTTGMGAIYGMAQTTVDRNMVAELSSVFLDSLYSTDTVTQGSQMNGSPKPH

SEQ ID NO: 3938 - protein, 441 aa, unidentified
MSLRQRLAQLVGRLQDPQKVARFQRLCGVEAPPRRSADRREDEKAEAPLAGDPRLRGRQPGAPGGPQPPGSDRNQCPAKPDGGGAPNGVRNGLAAELGPASPRRAGALRRNSLTGEEGQLARVSNWPLYCLFCFGTELGNELFYILFFPFWIWNLDPLVGRRLVVIWVLVMYLGQCTKDIIRWPRPASPPVVKLEVFYNSEYSMPSTHAMSGTAIPISMVLLTYGRWQYPLIYGLILIPCWCSLVCLSRIYMGMHSILDIIAGFLYTILILAVFYPFVDLIDNFNQTHKYAPFIIIGLHLALGIFSFTLDTWSTSRGDTAEILGSGAGIACGSHVTYNMGLVLDPSLDTLPLAGPPITVTLFGKAILRILIGMVFVLIIRDVMKKITIPLACKIFNIPCDDIRKARQHMEVELPYRYITYGMVGFSITFFVPYIFFFIGIS

SEQ ID NO: 3939 - protein, 399 aa, unidentified
MAELLRSLQDSQLVARFQRRCGLFPAPDEGPRENGADPTERAARVPGVEHLPAANGKGGEAPANGLRRAAAPEAYVQKYVVKNYFYYYLFQFSAALGQEVFYITFLPFTHWNIDPYLSRRLIIIWVLVMYIGQVAKDVLKWPRPSSPPVVKLEKRLIAEYGMPSTHAMAATAIAFTLLISTMDRYQYPFVLGLVMAVVFSTLVCLSRLYTGMHTVLDVLGGVLITALLIVLTYPAWTFIDCLDSASPLFPVCVIVVPFFLCYNYPVSDYYSPTRADTTTILAAGAGVTIGFWINHFFQLVSKPAESLPVIQNIPPLTTYMLVLGLTKFAVGIVLILLVRQLVQNLSLQVLYSWFKVVTRNKEARRRLEIEVPYKFVTYTSVGICATTFVPMLHRFLGLP

SEQ ID NO: 3940 - protein, 749 aa, unidentified
MSGSHTPACGPFSALTPSIWPQEILAKYTQKEESAEQPEFYYDEFGFRVYKEEGDEPGSSLLANSPLMEDAPQRLRWQAHLEFTHNHDVGDLTWDKIAVSLPRSEKLRSLVLAGIPHGMRPQLWMRLSGALQKKRNSELSYREIVKNSSNDETIAAKQIEKDLLRTMPSNACFASMGSIGVPRLRRVLRALAWLYPEIGYCQGTGMVAACLLLFLEEEDAFWMMSAIIEDLLPASYFSTTLLGVQTDQRVLRHLIVQYLPRLDKLLQEHDIELSLITLHWFLTAFASVVDIKLLLRIWDLFFYEGSRVLFQLTLGMLHLKEEELIQSENSASIFNTLSDIPSQMEDAELLLGVAMRLAGSLTDVAVETQRRKHLAYLIADQGQLLGAGTLTNLSQVVRRRTQRRKSTITALLFGEDDLEALKAKNIKQTELVADLREAILRVARHFQCTDPKNCSVELTPDYSMESHQRDHENYVACSRSHRRRAKALLDFERHDDDELGFRKNDIITIVSQKDEHCWVGELNGLRGWFPAKFVEVLDERSKEYSIAGDDSVTEGVTDLVRGTLCPALKALFEHGLKKPSLLGGACHPWLFIEEAAGREVERDFASVYSRLVLCKTFRLDEDGKVLTPEELLYRAVQSVNVTHDAVHAQMDVKLRSLICVGLNEQVLHLWLEVLCSSLPTVEKWYQPWSFLRSPGWVQIKCELRVLCCFAFSLSQDWELPAKREAQQPLKEGVRDMLVKHHLFSWDVDG

SEQ ID NO: 3941 - protein, 1336 aa, unidentified
MENLPAVTTEEPTPMGRGPVGPSGGGSTRDQVRTVVMRPSVSWEKAGPEEAKAPVRGDEAPPARVAGPAAGTPPCQMGVYPTDLTLQLLAVRRKSRLRDPGLQQTLRGQLRLLENDSREMARVLGELSARLLSIHSDQDRIVVTFKTFEEIWKFSTYHALGFTHHCLANLLMDQAFWLLLPSEEEETAIQVHVDENALRLTHESLLIQEGPFFVLCPDHHVRVMTGPRDAGNGPQALRQASGAPQGEAAPETDSSPPSPSVSSEEVAVAAAPEPLIPFHQWALRIPQDPIDDAMGGPVMPGNPLMAVGLASALADFQGSGPEEMTFRGGDLIEILGAQVPSLPWCVGRHAASGRVGFVRSSLISMQGPVSELESAIFLNEEEKSFFSEGCFSEEDARQLLRRMSGTDVCSVYSLDSVEEAETEQPQEKEIPPPCLSLEPQETLQKVKNVLEQCKTCPGCPQEPASWGLCAASSDVSLQDPEEPSFCLEAEDDWEDPEALSSLLLFLNAPGYKASFRGLYDVALPWLSSVFRSFSDEEELTGRLAQARGAAKKAGLLMALARLCFLLGRLCSRRLKLSQARVYFEEALGALEGSFGDLFLVVAVYANLASIYRKQKNREKCAQVVPKAMALLLGTPDHICSTEAEGELLQLALRRAVGGQSLQAEARACFLLARHHVHLKQPEEALPFLERLLLLHRDSGAPEAAWLSDCYLLLADIYSRKCLPHLVLSCVKVASLRTRGSLAGSLRSVNLVLQNAPQPHSLPAQTSHYLRQALASLTPGTGQALRGPLYTSLAQLYSHHGCHGPAITFMTQAVEASAIAGVRAIVDHLVALAWLHVLHGQSPVALDILQSVRDAVVASEDQEGVIANMVAVALKRTGRTRQAAESYYRALRVARDLGQQRNQAVGLANFGALCLHAGASRLAQHYLLEAVRLFSRLPLGECGRDFTHVLLQLGHLCTRQGPAQQGKGYYEWALLVAVEMGHVESQLRAVQRLCHFYSAVMPSEAQCVIYHELQLSLACKVADKVLEGQLLETISQLYLSLGTERAYKSALDYTKRSLGIFIDLQKKEKEAHAWLQAGKIYYILRQSELVDLYIQVAQNVALYTGDPNLGLELFEAAGDIFFDGAWEREKAVSFYRDRALPLAVTTGNRKAELRLCNKLVALLATLEEPQEGLEFAHMALALSITLGDRLNERVAYHRLAALQHRLGHGELAEHFYLKALSLCNSPLEFDEETLYYVKVYLVLGDIIFYDLKDPFDAAGYYQLALAAAVDLGNKKAQLKIYTRLATIYHNFLLDREKSLFFYQKARTFATELNVRRVNLPPLPLCGWAPWLAPSHPR

SEQ ID NO: 3942 - protein, 295 aa, unidentified
MWGARRSSVSSSWNAASLLQLLLAALLAAGARASGEYCHGWLDAQGVWRIGFQCPERFDGGDATICCGSCALRYCCSSAEARLDQGGCDNDRQQGAGEPGRADKDGPDGSAVPIYVPFLIVGSVFVAFIILGSLVAACCCRCLRPKQDPQQSRAPGGNRLMETIPMIPSASTSRGSSSRQSSTAASSSSSANSGARAPPTRSQTNCCLPEGTMNNVYVNMPTNFSVLNCQQATQIVPHQGQYLHPPYVGYTVQHDSVPMTAVPPFMDGLQPGYRQIQSPFPHTNSEQKMYPAVTV

SEQ ID NO: 3943 - protein, 238 aa, unidentified
MRALLALCLLLGWLRWGPAGAQQSGEYCHGWVDVQGNYHEGFQCPEDFDTLDATICCGSCALRYCCAAADARLEQGGCTNDRRELEHPGITAQPVYVPFLIVGSIFIAFIILGSVVAIYCCTCLRPKEPSQQPIRFSLRSYQTETLPMILTSTSPRAPSRQSSTATSSSSTGGSIRRFSFARAEPGCLVPSPPPPYTTSHSIHLAQPSGFLVSPQYFAYPLQQEPPLPGKSCPDFSSS

SEQ ID NO: 3944 - protein, 197 aa, unidentified
MPPAGLRRAAPLTAIALLVLGAPLVLAGEDCLWYLDRNGSWHPGFNCEFFTFCCGTCYHRYCCRDLTLLITERQQKHCLAFSPKTIAGIASAVILFVAVVATTICCFLCSCCYLYRRRQQLQSPFEGQEIPMTGIPVQPVYPYPQDPKAGPAPPQPGFIYPPSGPAPQYPLYPAGPPVYNPAAPPPYMPPQPSYPGA

SEQ ID NO: 3945 - protein, 240 aa, unidentified
MTAPVPAPRILLPLLLLLLLTPPPGARGEVCMASRGLSLFPESCPDFCCGTCDDQYCCSDVLKKFVWSEERCAVPEASVPASVEPVEQLGSALRFRPGYNDPMSGFGATLAVGLTIFVLSVVTIIICFTCSCCCLYKTCRRPRPVVTTTTSTTVVHAPYPQPPSVPPSYPGPSYQGYHTMPPQPGMPAAPYPMQYPPPYPAQPMGPPAYHETLAGGAAAPYPASQPPYNPAYMDAPKAAL

SEQ ID NO: 3946 - protein, 500 aa, unidentified
MALRRLLLLLLLSLESLDLLPSVHGARGRAANRTLSAGGAAVGGRRAGGALARGGRELNGTARAPGIPEAGSRRGQPAAAVAAAASAAVTYETCWGYYDVSGQYDKEFECNNSESGYLYCCGTCYYRFCCKKRHEKLDQRQCTNYQSPVWVQTPSTKVVSPGPENKYDPEKDKTNFTVYITCGVIAFVIVAGVFAKVSYDKAHRPPREMNIHRALADILRQQGPIPIAHCERETISAIDTSPKENTPVRSSSKNHYTPVRTAKQTPEKPRMNNILTSATEPYDLSFSRSFQNLAHLPPSYESAVKTNPSKYSSLKRLTDKEADEYYMRRRHLPDLAARGTLPLNVIQMSQQKPLPRERPRRPIRAMSQDRVLSPDRGLPDEFSMPYDRILSDEQLLSTERLHSQDPLLSPERTAFPEQSLSRAISHTDVFVSTPVLDRYRMSKMHSHPSASNNSYATLGQSQTAAKRHAFASRRHNTVEQLHYIPGHHTCYTASKTEVTV

SEQ ID NO: 3947 - protein, 538 aa, unidentified
MPALLLLVLLASSAGQARARPSNATSAEPAGPLPALLAHLRRLTGALTGGGGAASPGANGTRTGPAGGAGAAARAPPPAELCHGYYDVMGQYDATFNCSTGSYRFCCGTCHYRFCCEHRHMRLAQASCSNYDTPRWATTPPPLAGGAGGAGGAGGGPGPGQAGWLEGGRTGGAGGRGGEGPGGSTAYVVCGVISFALAVGVGAKVAFSKASRAPRAHRDINVPRALVDILRHQAGPGTRPDRARSSSLTPGIGGPDSMPPRTPKNLYNTVKTPNLDWRALPPPSPSLHYSTLSCSRSFHNLSHLPPSYEAAVKSELNRYSSLKRLAEKDLDEAYLKRRPLELPRGTLPLHALRRPGTGGGYRMEAWGGPEELGLAPAPNPRRVMSQEHLLGDGGRSRYEFTLPRARLVSQEHLLLSSPEALRQSREHLLSPPRSPALPPDPTARASLAASHSNLLLGPGGPPTPLRGLPPPSSLHAHHHHALHGSPQPAWMSDAGGGGGTLARRPPFQRQGTLEQLQFIPGHHLPQHLRTASKNEVTV

SEQ ID NO: 3948 - protein, 424 aa, unidentified
MRRVLRLLLGCFLTELCARVCRAQERAGHGQLAQLGGVLLLAGGNRSGAASGEASEGAEASDAPPTRAPTPDFCRGYFDVMGQWDPPFNCSSGDFIFCCGTCGFRFCCTFKKRRLNQSTCTNYDTPLWLNTGKPPARKDDPLHDPTKDKTNLIVYIICGVVAVMVLVGIFTKLGLEKAHRPQREHMSRALADVMRPQGHCNTDHMERDLNIVVHVQHYENMDTRTPINNLHATQMNNAVPTSPLLQQMGHPHSYPNLGQISNPYEQQPPGKELNKYASLKAVGSSDGDWAVSTLKSPKADKVNDDFYTKRRHLAELAAKGNLPLHPVRVEDEPRAFSPEHGPAKQNGQKSRTNKMPPHPLAYTSTTNFKGWDPNEQSLRRQAYSNKGKLGTAETGSSDPLGTRPQHYPPPQPYFITNSKTEVTV

SEQ ID NO: 3949 - protein, 1827 aa, unidentified
MARKKFSGLEISLIVLFVIVTIIAIALIVVLATKTPAVDEISDSTSTPATTRVTTNPSDSGKCPNVLNDPVNVRINCIPEQFPTEGICAQRGCCWRPWNDSLIPWCFFVDNHGYNVQDMTTTSIGVEAKLNRIPSPTLFGNDINSVLFTTQNQTPNRFRFKITDPNNRRYEVPHQYVKEFTGPTVSDTLYDVKVAQNPFSIQVIRKSNGKTLFDTSIGPLVYSDQYLQISTRLPSDYIYGIGEQVHKRFRHDLSWKTWPIFTRDQLPGDNNNNLYGHQTFFMCIEDTSGKSFGVFLMNSNAMEIFIQPTPIVTYRVTGGILDFYILLGDTPEQVVQQYQQLVGLPAMPAYWNLGFQLSRWNYKSLDVVKEVVRRNREAGIPFDTQVTDIDYMEDKKDFTYDQVAFNGLPQFVQDLHDHGQKYVIILDPAISIGRRANGTTYATYERGNTQHVWINESDGSTPIIGEVWPGLTVYPDFTNPNCIDWWANECSIFHQEVQYDGLWIDMNEVSSFIQGSTKGCNVNKLNYPPFTPDILDKLMYSKTICMDAVQNWGKQYDVHSLYGYSMAIATEQAVQKVFPNKRSFILTRSTFAGSGRHAAHWLGDNTASWEQMEWSITGMLEFSLFGIPLVGADICGFVAETTEELCRRWMQLGAFYPFSRNHNSDGYEHQDPAFFGQNSLLVKSSRQYLTIRYTLLPFLYTLFYKAHVFGETVARPVLHEFYEDTNSWIEDTEFLWGPALLITPVLKQGADTVSAYIPDAIWYDYESGAKRPWRKQRVDMYLPADKIGLHLRGGYIIPIQEPDVTTTASRKNPLGLIVALGENNTAKGDFFWDDGETKDTIQNGNYILYTFSVSNNTLDIVCTHSSYQEGTTLAFQTVKILGLTDSVTEVRVAENNQPMNAHSNFTYDASNQVLLIADLKLNLGRNFSVQWNQIFSENERFNCYPDADLATEQKCTQRGCVWRTGSSLSKAPECYFPRQDNSYSVNSARYSSMGITADLQLNTANARIKLPSDPISTLRVEVKYHKNDMLQFKIYDPQKKRYEVPVPLNIPTTPISTYEDRLYDVEIKENPFGIQIRRRSSGRVIWDSWLPGFAFNDQFIQISTRLPSEYIYGFGEVEHTAFKRDLNWNTWGMFTRDQPPGYKLNSYGFHPYYMALEEEGNAHGVFLLNSNAMDVTFQPTPALTYRTVGGILDFYMFLGPTPEVATKQYHEVIGHPVMPAYWALGFQLCRYGYANTSEVRELYDAMVAANIPYDVQYTDIDYMERQLDFTIGEAFQDLPQFVDKIRGEGMRYIIILDPAISGNETKTYPAFERGQQNDVFVKWPNTNDICWAKVWPDLPNITIDKTLTEDEAVNASRAHVAFPDFFRTSTAEWWAREIVDFYNEKMKFDGLWIDMNEPSSFVNGTTTNQCRNDELNYPPYFPELTKRTDGLHFRTICMEAEQILSDGTSVLHYDVHNLYGWSQMKPTHDALQKTTGKRGIVISRSTYPTSGRWGGHWLGDNYARWDNMDKSIIGMMEFSLFGMSYTGADICGFFNNSEYHLCTRWMQLGAFYPYSRNHNIANTRRQDPASWNETFAEMSRNILNIRYTLLPYFYTQMHEIHANGGTVIRPLLHEFFDEKPTWDIFKQFLWGPAFMVTPVLEPYVQTVNAYVPNARWFDYHTGKDIGVRGQFQTFNASYDTINLHVRGGHILPCQEPAQNTFYSRQKHMKLIVAADDNQMAQGSLFWDDGESIDTYERDLYLSVQFNLNQTTLTSTILKRGYINKSETRLGSLHVWGKGTTPVNAVTLTYNGNKNSLPFNEDTTNMILRIDLTTHNVTLEEPIEINWS

SEQ ID NO: 3950 - protein, 827 aa, unidentified
MRGCLRLALLCALPWLLLAASPGHPAKSPRQPPAPRRDPFDAARGADFDHVYSGVVNLSTENIYSFNYTSQPDQVTAVRVYVNSSSENLNYPVLVVVRQQKEVLSWQVPLLFQGLYQRSYNYQEVSRTLCPSEATNETGPLQQLIFVDVASMAPLGAQYKLLVTKLKHFQLRTNVAFHFTASPSQPQYFLYKFPKDVDSVIIKVVSEMAYPCSVVSVQNIMCPVYDLDHNVEFNGVYQSMTKKAAITLQKKDFPGEQFFVVFVIKPEDYACGGSFFIQEKENQTWNLQRKKNLEVTIVPSIKESVYVKSSLFSVFIFLSFYLGCLLVGFVHYLRFQRKSIDGSFGSNDGSGNMVASHPIAASTPEGSNYGTIDESSSSPGRQMSSSDGGPPGQSDTDSSVEESDFDTMPDIESDKNIIRTKMFLYLSDLSRKDRRIVSKKYKIYFWNIITIAVFYALPVIQLVITYQTVVNVTGNQDICYYNFLCAHPLGVLSAFNNILSNLGHVLLGFLFLLIVLRRDILHRRALEAKDIFAVEYGIPKHFGLFYAMGIALMMEGVLSACYHVCPNYSNFQFDTSFMYMIAGLCMLKLYQTRHPDINASAYSAYASFAVVIMVTVLGVVFGKNDVWFWVIFSAIHVLASLALSTQIYYMGRFKIDLGIFRRAAMVFYTDCIQQCSRPLYMDRMVLLVVGNLVNWSFALFGLIYRPRDFASYMLGIFICNLLLYLAFYIIMKLRSSEKVLPVPLFCIVATAVMWAAALYFFFQNLSSWEGTPAESREKNRECILLDFFDDHDIWHFLSATALFFSFLVLLTLDDDLDVVRRDQIPVF

SEQ ID NO: 3951 - protein, 832 aa, unidentified
MFALGLPFLVLLVASVESHLGVLGPKNVSQKDAEFERTYVDEVNSELVNIYTFNHTVTRNRTEGVRVSVNVLNKQKGAPLLFVVRQKEAVVSFQVPLILRGMFQRKYLYQKVERTLCQPPTKNESEIQFFYVDVSTLSPVNTTYQLRVSRMDDFVLRTGEQFSFNTTAAQPQYFKYEFPEGVDSVIVKVTSNKAFPCSVISIQDVLCPVYDLDNNVAFIGMYQTMTKKAAITVQRKDFPSNSFYVVVVVKTEDQACGGSLPFYPFAEDEPVDQGHRQKTLSVLVSQAVTSEAYVSGMLFCLGIFLSFYLLTVLLACWENWRQKKKTLLVAIDRACPESGHPRVLADSFPGSSPYEGYNYGSFENVSGSTDGLVDSAGTGDLSYGYQGRSFEPVGTRPRVDSMSSVEEDDYDTLTDIDSDKNVIRTKQYLYVADLARKDKRVLRKKYQIYFWNIATIAVFYALPVVQLVITYQTVVNVTGNQDICYYNFLCAHPLGNLSAFNNILSNLGYILLGLLFLLIILQREINHNRALLRNDLCALECGIPKHFGLFYAMGTALMMEGLLSACYHVCPNYTNFQFDTSFMYMIAGLCMLKLYQKRHPDINASAYSAYACLAIVIFFSVLGVVFGKGNTAFWIVFSIIHIIATLLLSTQLYYMGRWKLDSGIFRRILHVLYTDCIRQCSGPLYVDRMVLLVMGNVINWSLAAYGLIMRPNDFASYLLAIGICNLLLYFAFYIIMKLRSGERIKLIPLLCIVCTSVVWGFALFFFFQGLSTWQKTPAESREHNRDCILLDFFDDHDIWHFLSSIAMFGSFLVLLTLDDDLDTVQRDKIYVF

SEQ ID NO: 3952 - protein, 410 aa, unidentified
MPGVCDRAPDFLSPSEDQVLRPALGSSVALNCTAWVVSGPHCSLPSVQWLKDGLPLGIGGHYSLHEYSWVKANLSEVLVSSVLGVNVTSTEVYGAFTCSIQNISFSSFTLQRAGPTSHVAAVLASLLVLLALLLAALLYVKCRLNVLLWYQDAYGEVEINDGKLYDAYVSYSDCPEDRKFVNFILKPQLERRRGYKLFLDDRDLLPRAEPSADLLVNLSRCRRLIVVLSDAFLSRAWCSHSFREGLCRLLELTRRPIFITFEGQRRDPAHPALRLLRQHRHLVTLLLWRPGSVTPSSDFWKEVQLALPRKVQYRPVEGDPQTQLQDDKDPMLILRGRVPEGRALDSEVDPDPEGDLGVRGPVFGEPSAPPHTSGVSLGESRSSEVDVSDLGSRNYSARTDFYCLVSKDDM

SEQ ID NO: 3953 - protein, 1709 aa, unidentified
MGFLPKLLLLASFFPAGQASWGVSSPQDVQGVKGSCLLIPCIFSFPADVEVPDGITAIWYYDYSGQRQVVSHSADPKLVEARFRGRTEFMGNPEHRVCNLLLKDLQPEDSGSYNFRFEISEVNRWSDVKGTLVTVTEEPRVPTIASPVELLEGTEVDFNCSTPYVCLQEQVRLQWQGQDPARSVTFNSQKFEPTGVGHLETLHMAMSWQDHGRILRCQLSVANHRAQSEIHLQVKYAPKGVKILLSPSGRNILPGELVTLTCQVNSSYPAVSSIKWLKDGVRLQTKTGVLHLPQAAWSDAGVYTCQAENGVGSLVSPPISLHIFMAEVQVSPAGPILENQTVTLVCNTPNEAPSDLRYSWYKNHVLLEDAHSHTLRLHLATRADTGFYFCEVQNVHGSERSGPVSVVVNHPPLTPVLTAFLETQAGLVGILHCSVVSEPLATLVLSHGGHILASTSGDSDHSPRFSGTSGPNSLRLEIRDLEETDSGEYKCSATNSLGNATSTLDFHANAARLLISPAAEVVEGQAVTLSCRSGLSPTPDARFSWYLNGALLHEGPGSSLLLPAASSTDAGSYHCRARDGHSASGPSSPAVLTVLYPPRQPTFTTRLDLDAAGAGAGRRGLLLCRVDSDPPARLQLLHKDRVVATSLPSGGGCSTCGGCSPRMKVTKAPNLLRVEIHNPLLEEEGLYLCEASNALGNASTSATFNGQATVLAIAPSHTLQEGTEANLTCNVSREAAGSPANFSWFRNGVLWAQGPLETVTLLPVARTDAALYACRILTEAGAQLSTPVLLSVLYPPDRPKLSALLDMGQGHMALFICTVDSRPLALLALFHGEHLLATSLGPQVPSHGRFQAKAEANSLKLEVRELGLGDSGSYRCEATNVLGSSNTSLFFQVRGAWVQVSPSPELQEGQAVVLSCQVHTGVPEGTSYRWYRDGQPLQESTSATLRFAAITLTQAGAYHCQAQAPGSATTSLAAPISLHVSYAPRHVTLTTLMDTGPGRLGLLLCRVDSDPPAQLRLLHGDRLVASTLQGVGGPEGSSPRLHVAVAPNTLRLEIHGAMLEDEGVYICEASNTLGQASASADFDAQAVNVQVWPGATVREGQLVNLTCLVWTTHPAQLTYTWYQDGQQRLDAHSIPLPNVTVRDATSYRCGVGPPGRAPRLSRPITLDVLYAPRNLRLTYLLESHGGQLALVLCTVDSRPPAQLALSHAGRLLASSTAASVPNTLRLELRGPQPRDEGFYSCSARSPLGQANTSLELRLEGVRVILAPEAAVPEGAPITVTCADPAAHAPTLYTWYHNGRWLQEGPAASLSFLVATRAHAGAYSCQAQDAQGTRSSRPAALQVLYAPQDAVLSSFRDSRARSMAVIQCTVDSEPPAELALSHDGKVLATSSGVHSLASGTGHVQVARNALRLQVQDVPAGDDTYVCTAQNLLGSISTIGRLQVEGARVVAEPGLDVPEGAALNLSCRLLGGPGPVGNSTFAWFWNDRRLHAEPVPTLAFTHVARAQAGMYHCLAELPTGAAASAPVMLRVLYPPKTPTMMVFVEPEGGLRGILDCRVDSEPLASLTLHLGSRLVASSQPQGAPAEPHIHVLASPNALRVDIEALRPSDQGEYICSASNVLGSASTSTYFGVRALHRLHQFQQLLWVLGLLVGLLLLLLGLGACYTWRRRRVCKQSMGENSVEMAFQKETTQLIDPDAATCETSTCAPPLG

SEQ ID NO: 3954 - protein, 697 aa, unidentified
MLLPLLLSSLLGGSQAMDGRFWIRVQESVMVPEGLCISVPCSFSYPRQDWTGSTPAYGYWFKAVTETTKGAPVATNHQSREVEMSTRGRFQLTGDPAKGNCSLVIRDAQMQDESQYFFRVERGSYVRYNFMNDGFFLKVTALTQKPDVYIPETLEPGQPVTVICVFNWAFEECPPPSFSWTGAALSSQGTKPTTSHFSVLSFTPRPQDHNTDLTCHVDFSRKGVSAQRTVRLRVAYAPRDLVISISRDNTPALEPQPQGNVPYLEAQKGQFLRLLCAADSQPPATLSWVLQNRVLSSSHPWGPRPLGLELPGVKAGDSGRYTCRAENRLGSQQRALDLSVQYPPENLRVMVSQANRTVLENLGNGTSLPVLEGQSLCLVCVTHSSPPARLSWTQRGQVLSPSQPSDPGVLELPRVQVEHEGEFTCHARHPLGSQHVSLSLSVHYSPKLLGPSCSWEAEGLHCSCSSQASPAPSLRWWLGEELLEGNSSQDSFEVTPSSAGPWANSSLSLHGGLSSGLRLRCEAWNVHGAQSGSILQLPDKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQ

SEQ ID NO: 3955 - protein, 698 aa, unidentified
MVPGQAQPQSPEMLLLPLLLPVLGAGSLNKDPSYSLQVQRQVPVPEGLCVIVSCNLSYPRDGWDESTAAYGYWFKGRTSPKTGAPVATNNQSREVEMSTRDRFQLTGDPGKGSCSLVIRDAQREDEAWYFFRVERGSRVRHSFLSNAFFLKVTALTKKPDVYIPETLEPGQPVTVICVFNWAFKKCPAPSFSWTGAALSPRRTRPSTSHFSVLSFTPSPQDHDTDLTCHVDFSRKGVSAQRTVRLRVAYAPKDLIISISHDNTSALELQGNVIYLEVQKGQFLRLLCAADSQPPATLSWVLQDRVLSSSHPWGPRTLGLELRGVRAGDSGRYTCRAENRLGSQQQALDLSVQYPPENLRVMVSQANRTVLENLGNGTSLPVLEGQSLRLVCVTHSSPPARLSWTRWGQTVGPSQPSDPGVLELPPIQMEHEGEFTCHAQHPLGSQHVSLSLSVHYPPQLLGPSCSWEAEGLHCSCSSQASPAPSLRWWLGEELLEGNSSQGSFEVTPSSAGPWANSSLSLHGGLSSGLRLRCKAWNVHGAQSGSVFQLLPGKLEHGGGLGLGAALGAGVAALLAFCSCLVVFRVKICRKEARKRAAAEQDVPSTLGPISQGHQHECSAGSSQDHPPPGAATYTPGKGEEQELHYASLSFQGLRLWEPADQEAPSTTEYSEIKIHTGQPLRGPGFGLQLEREMSGMVPK

SEQ ID NO: 3956 - protein, 595 aa, unidentified
MLLLLLLLPPLLCGRVGAKEQKDYLLTMQKSVTVQEGLCVSVLCSFSYPQNGWTASDPVHGYWFRAGDHVSRNIPVATNNPARAVQEETRDRFHLLGDPQNKDCTLSIRDTRESDAGTYVFCVERGNMKWNYKYDQLSVNVTASQDLLSRYRLEVPESVTVQEGLCVSVPCSVLYPHYNWTASSPVYGSWFKEGADIPWDIPVATNTPSGKVQEDTHGRFLLLGDPQTNNCSLSIRDARKGDSGKYYFQVERGSRKWNYIYDKLSVHVTALTHMPTFSIPGTLESGHPRNLTCSVPWACEQGTPPTITWMGASVSSLDPTITRSSMLSLIPQPQDHGTSLTCQVTLPGAGVTMTRAVRLNISYPPQNLTMTVFQGDGTASTTLRNGSALSVLEGQSLHLVCAVDSNPPARLSWTWGSLTLSPSQSSNLGVLELPRVHVKDEGEFTCRAQNPLGSQHISLSLSLQNEYTGKMRPISGVTLGAFGGAGATALVFLYFCIIFVVVRSCRKKSARPAVGVGDTGMEDANAVRGSASQGPLIESPADDSPPHHAPPALATPSPEEGEIQYASLSFHKARPQYPQEQEAIGYEYSEINIPK

SEQ ID NO: 3957 - protein, 396 aa, unidentified
MLPLLLLPLLWGGSLQEKPVYELQVQKSVTVQEGLCVLVPCSFSYPWRSWYSSPPLYVYWFRDGEIPYYAEVVATNNPDRRVKPETQGRFRLLGDVQKKNCSLSIGDARMEDTGSYFFRVERGRDVKYSYQQNKLNLEVTALIEKPDIHFLEPLESGRPTRLSCSLPGSCEAGPPLTFSWTGNALSPLDPETTRSSELTLTPRPEDHGTNLTCQVKRQGAQVTTERTVQLNVSYAPQNLAISIFFRNGTGTALRILSNGMSVPIQEGQSLFLACTVDSNPPASLSWFREGKALNPSQTSMSGTLELPNIGAREGGEFTCRVQHPLGSQHLSFILSVQRSSSSCICVTEKQQGSWPLVLTLIRGALMGAGFLLTYGLTWIYYTRCGGPQQSRAERPG

SEQ ID NO: 3958 - protein, 328 aa, unidentified
MEKSIWLLACLAWVLPTGSFVRTKIDTTENLLNTEVHSSPAQRWSMQVPPEVSAEAGDAAVLPCTFTHPHRHYDGPLTAIWRAGEPYAGPQVFRCAAARGSELCQTALSLHGRFRLLGNPRRNDLSLRVERLALADDRRYFCRVEFAGDVHDRYESRHGVRLHVTAAPRIVNISVLPSPAHAFRALCTAEGEPPPALAWSGPALGNSLAAVRSPREGHGHLVTAELPALTHDGRYTCTAANSLGRSEASVYLFRFHGASGASTVALLLGALGFKALLLLGVLAARAARRRPEHLDTPDTPPRSQAQESNYENLSQMNPRSPPATMCSP

SEQ ID NO: 3959 - protein, 551 aa, unidentified
MLPLLLLPLLWGGSLQEKPVYELQVQKSVTVQEGLCVLVPCSFSYPWRSWYSSPPLYVYWFRDGEIPYYAEVVATNNPDRRVKPETQGRFRLLGDVQKKNCSLSIGDARMEDTGSYFFRVERGRDVKYSYQQNKLNLEVTALIEKPDIHFLEPLESGRPTRLSCSLPGSCEAGPPLTFSWTGNALSPLDPETTRSSELTLTPRPEDHGTNLTCQMKRQGAQVTTERTVQLNVSYAPQTITIFRNGIALEILQNTSYLPVLEGQALRLLCDAPSNPPAHLSWFQGSPALNATPISNTGILELRRVRSAEEGGFTCRAQHPLGFLQIFLNLSVYSLPQLLGPSCSWEAEGLHCRCSFRARPAPSLCWRLEEKPLEGNSSQGSFKVNSSSAGPWANSSLILHGGLSSDLKVSCKAWNIYGSQSGSVLLLQGRSNLGTGVVPAALGGAGVMALLCICLCLIFFLIVKARRKQAAGRPEKMDDEDPIMGTITSGSRKKPWPDSPGDQASPPGDAPPLEEQKELHYASLSFSEMKSREPKDQEAPSTTEYSEIKTSK

SEQ ID NO: 3960 - protein, 453 aa, unidentified
MQGAQEASASEMLPLLLPLLWAGALAQERRFQLEGPESLTVQEGLCVLVPCRLPTTLPASYYGYGYWFLEGADVPVATNDPDEEVQEETRGRFHLLWDPRRKNCSLSIRDARRRDNAAYFFRLKSKWMKYGYTSSKLSVRVMALTHRPNISIPGTLESGHPSNLTCSVPWVCEQGTPPIFSWMSAAPTSLGPRTTQSSVLTITPRPQDHSTNLTCQVTFPGAGVTMERTIQLNVSYAPQKVAISIFQGNSAAFKILQNTSSLPVLEGQALRLLCDADGNPPAHLSWFQGFPALNATPISNTGVLELPQVGSAEEGDFTCRAQHPLGSLQISLSLFVHWKPEGRAGGVLGAVWGASITTLVFLCVCFIFRVKTRRKKAAQPVQNTDDVNPVMVSGSRGHQHQFQTGIVSDHPAEAGPISEDEQELHYAVLHFHKVQPQEPKVTDTEYSEIKIHK

SEQ ID NO: 3961 - protein, 467 aa, unidentified
MLLLLLLPLLWGRERVEGQKSNRKDYSLTMQSSVTVQEGMCVHVRCSFSYPVDSQTDSDPVHGYWFRAGNDISWKAPVATNNPAWAVQEETRDRFHLLGDPQTKNCTLSIRDARMSDAGRYFFRMEKGNIKWNYKYDQLSVNVTALTHRPNILIPGTLESGCFQNLTCSVPWACEQGTPPMISWMGTSVSPLHPSTTRSSVLTLIPQPQHHGTSLTCQVTLPGAGVTTNRTIQLNVSYPPQNLTVTVFQGEGTASTALGNSSSLSVLEGQSLRLVCAVDSNPPARLSWTWRSLTLYPSQPSNPLVLELQVHLGDEGEFTCRAQNSLGSQHVSLNLSLQQEYTGKMRPVSGVLLGAVGGAGATALVFLSFCVIFIVVRSCRKKSARPAADVGDIGMKDANTIRGSASQGNLTESWADDNPRHHGLAAHSSGEEREIQYAPLSFHKGEPQDLSGQEATNNEYSEIKIPK

SEQ ID NO: 3962 - protein, 499 aa, unidentified
MLLLLLLLPLLWGTKGMEGDRQYGDGYLLQVQELVTVQEGLCVHVPCSFSYPQDGWTDSDPVHGYWFRAGDRPYQDAPVATNNPDREVQAETQGRFQLLGDIWSNDCSLSIRDARKRDKGSYFFRLERGSMKWSYKSQLNYKTKQLSVFVTALTHRPDILILGTLESGHSRNLTCSVPWACKQGTPPMISWIGASVSSPGPTTARSSVLTLTPKPQDHGTSLTCQVTLPGTGVTTTSTVRLDVSYPPWNLTMTVFQGDATASTALGNGSSLSVLEGQSLRLVCAVNSNPPARLSWTRGSLTLCPSRSSNPGLLELPRVHVRDEGEFTCRAQNAQGSQHISLSLSLQNEGTGTSRPVSQVTLAAVGGAGATALAFLSFCIIFIIVRSCRKKSARPAAGVGDTGMEDAKAIRGSASQGPLTESWKDGNPLKKPPPAVAPSSGEEGELHYATLSFHKVKPQDPQGQEATDSEYSEIKIHKRETAETQACLRNHNPSSKEVRG

SEQ ID NO: 3963 - protein, 463 aa, unidentified
MLLLLLPLLWGRERAEGQTSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSLQSKATSGVTQGVVGGAGATALVFLSFCVIFVVVRSCRKKSARPAAGVGDTGIEDANAVRGSASQGPLTEPWAEDSPPDQPPPASARSSVGEGELQYASLSFQMVKPWDSRGQEATDTEYSEIKIHR

SEQ ID NO: 3964 - protein, 197 aa, unidentified
MLPLLQLVPAKLLNSSCSLEKTLQCSCSFHGIPTPSVQWWMGGVPVGVDGMDGSLQVTSTMLGPWANSTISLTEEPEMGMRLLCEGKNQNGTHALSILLMSRKSSLAAQAFVKGLIQGAIYAGIVIALLFLCLLPLIVKHIRKKQAKKAAAIRAKKSSKVRASQELEMSLKPEEPGKPVVATFSESRILEKQDKRAS

SEQ ID NO: 3965 - protein, 223 aa, unidentified
MQWAVGRRWAWAALLLAVAAVLTQVVWLWLGTQSFVFQREEIAQLARQYAGLDHELAFSRLIVELRRLHPGHVLPDEELQWVFVNAGGWMGAMCLLHASLSEYVLLFGTALGSRGHSGRYWAEISDTIISGTFHQWREGTTKSEVFYPGETVVHGPGEATAVEWGPNTWMVEYGRGVIPSTLAFALADTVFSTQDFLTLFYTLRSYARGLRLELTTYLFGQDP

SEQ ID NO: 3966 - protein, 783 aa, unidentified
MVIMSEFSADPAGQGQGQQKPLRVGFYDIERTLGKGNFAVVKLARHRVTKTQVAIKIIDKTRLDSSNLEKIYREVQLMKLLNHPHIIKLYQVMETKDMLYIVTEFAKNGEMFDYLTSNGHLSENEARKKFWQILSAVEYCHDHHIVHRDLKTENLLLDGNMDIKLADFGFGNFYKSGEPLSTWCGSPPYAAPEVFEGKEYEGPQLDIWSLGVVLYVLVCGSLPFDGPNLPTLRQRVLEGRFRIPFFMSQDCESLIRRMLVVDPARRITIAQIRQHRWMRAEPCLPGPACPAFSAHSYTSNLGDYDEQALGIMQTLGVDRQRTVESLQNSSYNHFAAIYYLLLERLKEYRNAQCARPGPARQPRPRSSDLSGLEVPQEGLSTDPFRPALLCPQPQTLVQSVLQAEMDCELQSSLQWPLFFPVDASCSGVFRPRPVSPSSLLDTAISEEARQGPGLEEEQDTQESLPSSTGRRHTLAEVSTRLSPLTAPCIVVSPSTTASPAEGTSSDSCLTFSASKSPAGLSGTPATQGLLGACSPVRLASPFLGSQSATPVLQAQGGLGGAVLLPVSFQEGRRASDTSLTQGLKAFRQQLRKTTRTKGFLGLNKIKGLARQVCQAPASRASRGGLSPFHAPAQSPGLHGGAAGSREGWSLLEEVLEQQRLLQLQHHPAAAPGCSQAPQPAPAPFVIAPCDGPGAAPLPSTLLTSGLPLLPPPLLQTGASPVASAAQLLDTHLHIGTGPTALPAVPPPRLARLAPGCEPLGLLQGDCEMEDLMPCSLGTFVLVQ

SEQ ID NO: 3967 - protein, 926 aa, unidentified
MVMADGPRHLQRGPVRVGFYDIEGTLGKGNFAVVKLGRHRITKTEVAIKIIDKSQLDAVNLEKIYREVQIMKMLDHPHIIKLYQVMETKSMLYLVTEYAKNGEIFDYLANHGRLNESEARRKFWQILSAVDYCHGRKIVHRDLKAENLLLDNNMNIKIADFGFGNFFKSGELLATWCGSPPYAAPEVFEGQQYEGPQLDIWSMGVVLYVLVCGALPFDGPTLPILRQRVLEGRFRIPYFMSEDCEHLIRRMLVLDPSKRLTIAQIKEHKWMLIEVPVQRPVLYPQEQENEPSIGEFNEQVLRLMHSLGIDQQKTIESLQNKSYNHFAAIYFLLVERLKSHRSSFPVEQRLDGRQRRPSTIAEQTVAKAQTVGLPVTMHSPNMRLLRSALLPQASNVEAFSFPASGCQAEAAFMEEECVDTPKVNGCLLDPVPPVLVRKGCQSLPSNMMETSIDEGLETEGEAEEDPAHAFEAFQSTRSGQRRHTLSEVTNQLVVMPGAGKIFSMNDSPSLDSVDSEYDMGSVQRDLNFLEDNPSLKDIMLANQPSPRMTSPFISLRPTNPAMQALSSQKREVHNRSPVSFREGRRASDTSLTQGIVAFRQHLQNLARTKGILELNKVQLLYEQIGPEADPNLAPAAPQLQDLASSCPQEEVSQQQESVSTLPASVHPQLSPRQSLETQYLQHRLQKPSLLSKAQNTCQLYCKEPPRSLEQQLQEHRLQQKRLFLQKQSQLQAYFNQMQIAESSYPQPSQQLPLPRQETPPPSQQAPPFSLTQPLSPVLEPSSEQMQYSPFLSQYQEMQLQPLPSTSGPRAAPPLPTQLQQQQPPPPPPPPPPRQPGAAPAPLQFSYQTCELPSAASPAPDYPTPCQYPVDGAQQSDLTGPDCPRSPGLQEAPSSYDPLALSELPGLFDCEMLDAVDPQHNGYVLVN

SEQ ID NO: 3968 - protein, 1321 aa, unidentified
MAAAAASGAGGAAGAGTGGAGPAGRLLPPPAPGSPAAPAAVSPAAGQPRPPAPASRGPMPARIGYYEIDRTIGKGNFAVVKRATHLVTKAKVAIKIIDKTQLDEENLKKIFREVQIMKMLCHPHIIRLYQVMETERMIYLVTEYASGGEIFDHLVAHGRMAEKEARRKFKQIVTAVYFCHCRNIVHRDLKAENLLLDANLNIKIADFGFSNLFTPGQLLKTWCGSPPYAAPELFEGKEYDGPKVDIWSLGVVLYVLVCGALPFDGSTLQNLRARVLSGKFRIPFFMSTECEHLIRHMLVLDPNKRLSMEQICKHKWMKLGDADPNFDRLIAECQQLKEERQVDPLNEDVLLAMEDMGLDKEQTLQSLRSDAYDHYSAIYSLLCDRHKRHKTLRLGALPSMPRALAFQAPVNIQAEQAGTAMNISVPQVQLINPENQIVEPDGTLNLDSDEGEEPSPEALVRYLSMRRHTVGVADPRTEVMEDLQKLLPGFPGVNPQAPFLQVAPNVNFMHNLLPMQNLQPTGQLEYKEQSLLQPPTLQLLNGMGPLGRRASDGGANIQLHAQQLLKRPRGPSPLVTMTPAVPAVTPVDEESSDGEPDQEAVQSSTYKDSNTLHLPTERFSPVRRFSDGAASIQAFKAHLEKMGNNSSIKQLQQECEQLQKMYGGQIDERTLEKTQQQHMLYQQEQHHQILQQQIQDSICPPQPSPPLQAACENQPALLTHQLQRLRIQPSSPPPNHPNNHLFRQPSNSPPPMSSAMIQPHGAASSSQFQGLPSRSAIFQQQPENCSSPPNVALTCLGMQQPAQSQQVTIQVQEPVDMLSNMPGTAAGSSGRGISISPSAGQMQMQHRTNLMATLSYGHRPLSKQLSADSAEAHSLNVNRFSPANYDQAHLHPHLFSDQSRGSPSSYSPSTGVGFSPTQALKVPPLDQFPTFPPSAHQQPPHYTTSALQQALLSPTPPDYTRHQQVPHILQGLLSPRHSLTGHSDIRLPPTEFAQLIKRQQQQRQQQQQQQQQQEYQELFRHMNQGDAGSLAPSLGGQSMTERQALSYQNADSYHHHTSPQHLLQIRAQECVSQASSPTPPHGYAHQPALMHSESMEEDCSCEGAKDGFQDSKSSSTLTKGCHDSPLLLSTGGPGDPESLLGTVSHAQELGIHPYGHQPTAAFSKNKVPSREPVIGNCMDRSSPGQAVELPDHNGLGYPARPSVHEHHRPRALQRHHTIQNSDDAYVQLDNLPGMSLVAGKALSSARMSDAVLSQSSLMGSQQFQDGENEECGASLGGHEHPDLSDGSQHLNSSCYPSTCITDILLSYKHPEVSFSMEQAGV

SEQ ID NO: 3969 - protein, 504 aa, unidentified
MEPAGPAPGRLGPLLCLLLAASCAWSGVAGEEELQVIQPDKSVLVAAGETATLRCTATSLIPVGPIQWFRGAGPGRELIYNQKEGHFPRVTTVSDLTKRNNMDFSIRIGNITPADAGTYYCVKFRKGSPDDVEFKSGAGTELSVRAKPSAPVVSGPAARATPQHTVSFTCESHGFSPRDITLKWFKNGNELSDFQTNVDPVGESVSYSIHSTAKVVLTREDVHSQVICEVAHVTLQGDPLRGTANLSETIRVPPTLEVTQQPVRAENQVNVTCQVRKFYPQRLQLTWLENGNVSRTETASTVTENKDGTYNWMSWLLVNVSAHRDDVKLTCQVEHDGQPAVSKSHDLKVSAHPKEQGSNTAAENTGSNERNIYIVVGVVCTLLVALLMAALYLVRIRQKKAQGSTSSTRLHEPEKNAREITQDTNDITYADLNLPKGKKPAPQAAEPNNHTEYASIQTSPQPASEDTLTYADLDMVHLNRTPKQPAPKPEPSFSEYASVQVPRK

SEQ ID NO: 3970 - protein, 398 aa, unidentified
MPVPASWPHLPSPFLLMTLLLGRLTGVAGEDELQVIQPEKSVSVAAGESATLRCAMTSLIPVGPIMWFRGAGAGRELIYNQKEGHFPRVTTVSELTKRNNLDFSISISNITPADAGTYYCVKFRKGSPDDVEFKSGAGTELSVRAKPSAPVVSGPAVRATPEHTVSFTCESHGFSPRDITLKWFKNGNELSDFQTNVDPAGDSVSYSIHSTARVVLTRGDVHSQVICEIAHITLQGDPLRGTANLSEAIRVPPTLEVTQQPMRAENQANVTCQVSNFYPRGLQLTWLENGNVSRTETASTLIENKDGTYNWMSWLLVNTCAHRDDVVLTCQVEHDGQQAVSKSYALEISAHQKEHGSDITHEAALAPTAPLLVALLLGPKLLLVVGVSAIYICWKQKA

SEQ ID NO: 3971 - protein, 342 aa, unidentified
MCSTMSAPTCLAHLPPCFLLLALVLVPSDASGQSSRNDWQVLQPEGPMLVAEGETLLLRCMVVGSCTDGMIKWVKVSTQDQQEIYNFKRGSFPGVMPMIQRTSEPLNCDYSIYIHNVTREHTGTYHCVRFDGLSEHSEMKSDEGTSVLVKGAGDPEPDLWIIQPQELVLGTTGDTVFLNCTVLGDGPPGPIRWFQGAGLSREAIYNFGGISHPKETAVQASNNDFSILLQNVSSEDAGTYYCVKFQRKPNRQYLSGQGTSLKVKAKSTSSKEAEFTSEPATEMSPTGLLVVFAPVVLGLKAITLAALLLALATSRRSPGQEDVKTTGPAGAMNTLAWSKGQE

SEQ ID NO: 3972 - protein, 387 aa, unidentified
MPVPASWPHPPGPFLLLTLLLGLTEVAGEEELQMIQPEKLLLVTVGKTATLHCTVTSLLPVGPVLWFRGVGPGRELIYNQKEGHFPRVTTVSDLTKRNNMDFSIRISSITPADVGTYYCVKFRKGSPENVEFKSGPGTEMALGAKPSAPVVLGPAARTTPEHTVSFTCESHGFSPRDITLKWFKNGNELSDFQTNVDPTGQSVAYSIRSTARVVLDPWDVRSQVICEVAHVTLQGDPLRGTANLSEAIRVPPTLEVTQQPMRVGNQVNVTCQVRKFYPQSLQLTWSENGNVCQRETASTLTENKDGTYNWTSWFLVNISDQRDDVVLTCQVKHDGQLAVSKRLALEVTVHQKDQSSDATPGPASSLTALLLIAVLLGPIYVPWKQKT

SEQ ID NO: 3973 - protein, 196 aa, unidentified
MNQADPRLRAVCLWTLTSAAMSRGDNCTDLLALGIPSITQAWGLWVLLGAVTLLFLISLAAHLSQWTRGRSRSHPGQGRSGESVEEVPLYGNLHYLQTGRLSQDPEPDQQDPTLGGPARAAEEVMCYTSLQLRPPQGRIPGPGTPVKYSEVVLDSEPKSQASGPEPELYASVCAQTRRARASFPDQAYANSQPAAS

SEQ ID NO: 3974 - protein, 335 aa, unidentified
MDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNVSVQRFCLQLRLYEQVSTPEIKVLNKTQENGTCTLILGCTVEKGDHVAYSWSEKAGTHPLNPANSSHLLSLTLGPQHADNIYICTVSNPISNNSQTFSPWPGCRTDPSETKPWAVYAGLLGGVIMILIMVVILQLRRRGKTNHYQTTVEKKSLTIYAQVQKPGPLQKKLDSFPAQDPCTTIYVAATEPVPESVQETNSITVYASVTLPES

SEQ ID NO: 3975 - protein, 332 aa, unidentified
MLWLFQSLLFVFCFGPGNVVSQSSLTPLMVNGILGESVTLPLEFPAGEKVNFITWLFNETSLAFIVPHETKSPEIHVTNPKQGKRLNFTQSYSLQLSNLKMEDTGSYRAQISTKTSAKLSSYTLRILRQLRNIQVTNHSQLFQNMTCELHLTCSVEDADDNVSFRWEALGNTLSSQPNLTVSWDPRISSEQDYTCIAENAVSNLSFSVSAQKLCEDVKIQYTDTKMILFMVSGICIVFGFIILLLLVLRKRRDSLSLSTQRTQGPAESARNLEYVSVSPTNNTVYASVTHSNRETEIWTPRENDTITIYSTINHSKESKPTFSRATALDNVV

SEQ ID NO: 3976 - protein, 335 aa, unidentified
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEGAADDPDSSMVLLCLLLVPLLLSLFVLGLFLWFLKRERQEEYIEEKKRVDICRETPNICPHSGENTEYDTIPHTNRTILKEDPANTVYSTVEIPKKMENPHSLLTMPDTPRLFAYENVI

SEQ ID NO: 3977 - protein, 285 aa, unidentified
MVMRPLWSLLLWEALLPITVTGAQVLSKVGGSVLLVAARPPGFQVREAIWRSLWPSEELLATFFRGSLETLYHSRFLGRAQLHSNLSLELGPLESGDSGNFSVLMVDTRGQPWTQTLQLKVYDAVPRPVVQVFIAVERDAQPSKTCQVFLSCWAPNISEITYSWRRETTMDFGMEPHSLFTDGQVLSISLGPGDRDVAYSCIVSNPVSWDLATVTPWDSCHHEAAPGKASYKDVLLVVVPVSLLLMLVTLFSAWHWCPCSGKKKKDVHADRVGPETENPLVQDLP

SEQ ID NO: 3978 - protein, 289 aa, unidentified
MCAFPWLLLLLLLQEGSQRRLWRWCGSEEVVAVLQESISLPLEIPPDEEVENIIWSSHKSLATVVPGKEGHPATIMVTNPHYQGQVSFLDPSYSLHISNLSWEDSGLYQAQVNLRTSQISTMQQYNICVYRWLSEPQITVNFESSGEGACSMSLVCSVEKAGMDMTYSWLSRGDSTYTFHEGPVLSTSWRPGDSALSYTCRANNPISNVSSCPIPDGPFYADPNYASEKPSTAFCLLAKGLLIFLLLVILAMGLWVIRVQKRHKMPRMKKLMRNRMKLRKEAKPGSSPA

SEQ ID NO: 3979 - protein, 349 aa, unidentified
MEAHNASAPFNFTLPPNFGKRPTDLALSVILVFMLFFIMLSLGCTMEFSKIKAHLWKPKGLAIALVAQYGIMPLTAFVLGKVFRLKNIEALAILVCGCSPGGNLSNVFSLAMKGDMNLSIVMTTCSTFCALGMMPLLLYIYSRGIYDGDLKDKVPYKGIVISLVLVLIPCTIGIVLKSKRPQYMRYVIKGGMIIILLCSVAVTVLSAINVGKSIMFAMTPLLIATSSLMPFIGFLLGYVLSALFCLNGRCRRTVSMETGCQNVQLCSTILNVAFPPEVIGPLFFFPLLYMIFQLGEGLLLIAIFWCYEKFKTPKDKTKMIYTAATTEETIPGALGNGTYKGEDCSPCTA

SEQ ID NO: 3980 - protein, 348 aa, unidentified
MNDPNSCVDNATVCSGASCVVPESNFNNILSVVLSTVLTILLALVMFSMGCNVEIKKFLGHIKRPWGICVGFLCQFGIMPLTGFILSVAFDILPLQAVVVLIIGCCPGGTASNILAYWVDGDMDLSVSMTTCSTLLALGMMPLCLLIYTKMWVDSGSIVIPYDNIGTSLVSLVVPVSIGMFVNHKWPQKAKIILKIGSIAGAILIVLIAVVGGILYQSAWIIAPKLWIIGTIFPVAGYSLGFLLARIAGLPWYRCRTVAFETGMQNTQLCSTIVQLSFTPEELNVVFTFPLIYSIFQLAFAAIFLGFYVAYKKCHGKNKAEIPESKENGTEPESSFYKANGGFQPDEK

SEQ ID NO: 3981 - protein, 477 aa, unidentified
MVLMQDKGSSQQWPGLGGEGGGTGPLSMLRAALLLISLPWGAQGTASTSLSTAGGHTVPPTGGRYLSIGDGSVMEFEFPEDSEGIIVISSQYPGQANRTAPGPMLRVTSLDTEVLTIKNVSAITWGGGGGFVVSIHSGLAGLAPLHIQLVDAHEAPPTLIEERRDFCIKVSPAEDTPATLSADLAHFSENPILYLLLPLIFVNKCSFGCKVELEVLKGLMQSPQPMLLGLLGQFLVMPLYAFLMAKVFMLPKALALGLIITCSSPGGGGSYLFSLLLGGDVTLAISMTFLSTVAATGFLPLSSAIYSRLLSIHETLHVPISKILGTLLFIAIPIAVGVLIKSKLPKFSQLLLQVVKPFSFVLLLGGLFLAYRMGVFILAGIRLPIVLVGITVPLVGLLVGYCLATCLKLPVAQRRTVSIEVGVQNSLLALAMLQLSLRRLQADYASQAPFIVALSGTSEMLALVIGHFIYSSLFPVP

SEQ ID NO: 3982 - protein, 437 aa, unidentified
MDGNDNVTLLFAPLLRDNYTLAPNASSLGPGTDLALAPASSAGPGPGLSLGPGPSFGFSPGPTPTPEPTTSGLAGGAASHGPSPFPRPWAPHALPFWDTPLNHGLNVFVGAALCITMLGLGCTVDVNHFGAHVRRPVGALLAALCQFGLLPLLAFLLALAFKLDEVAAVAVLLCGCCPGGNLSNLMSLLVDGDMNLSIIMTISSTLLALVLMPLCLWIYSWAWINTPIVQLLPLGTVTLTLCSTLIPIGLGVFIRYKYSRVADYIVKVSLWSLLVTLVVLFIMTGTMLGPELLASIPAAVYVIAIFMPLAGYASGYGLATLFHLPPNCKRTVCLETGSQNVQLCTAILKLAFPPQFIGSMYMFPLLYALFQSAEAGIFVLIYKMYGSEMLHKRDPLDEDEDTDISYKKLKEEEMADTSYGTVKAENIIMMETAQTSL

SEQ ID NO: 3983 - protein, 438 aa, unidentified
MIRKLFIVLLLLLVTIEEARMSSLSFLNIEKTEILFFTKTEETILVSSSYENKRPNSSHLFVKIEDPKILQMVNVAKKISSDATNFTINLVTDEEGETNVTIQLWDSEGRQERLIEEIKNVKVKVLKQKDSLLQAPMHIDRNILMLILPLILLNKCAFGCKIELQLFQTVWKRPLPVILGAVTQFFLMPFCGFLLSQIVALPEAQAFGVVMTCTCPGGGGGYLFALLLDGDFTLAILMTCTSTLLALIMMPVNSYIYSRILGLSGTFHIPVSKIVSTLLFILVPVSIGIVIKHRIPEKASFLERIIRPLSFILMFVGIYLTFTVGLVFLKTDNLEVILLGLLVPALGLLFGYSFAKVCTLPLPVCKTVAIESGMLNSFLALAVIQLSFPQSKANLASVAPFTVAMCSGCEMLLIILVYKAKKRCIFFLQDKRKRNFLI

SEQ ID NO: 3984 - protein, 377 aa, unidentified
MRANCSSSSACPANSSEEELPVGLEVHGNLELVFTVVSTVMMGLLMFSLGCSVEIRKLWSHIRRPWGIAVGLLCQFGLMPFTAYLLAISFSLKPVQAIAVLIMGCCPGGTISNIFTFWVDGDMDLSISMTTCSTVAALGMMPLCIYLYTWSWSLQQNLTIPYQNIGITLVCLTIPVAFGVYVNYRWPKQSKIILKIGAVVGGVLLLVVAVAGVVLAKGSWNSDITLLTISFIFPLIGHVTGFLLALFTHQSWQRCRTISLETGAQNIQMCITMLQLSFTAEHLVQMLSFPLAYGLFQLIDGFLIVAAYQTYKRRLKNKHGKKNSGCTEVCHTRKSTSSRETNAFLEVNEEGAITPGPPGPMDCHRALEPVGHITSCE

SEQ ID NO: 3985 - protein, 340 aa, unidentified
MRLLERMRKDWFMVGIVLAIAGAKLEPSIGVNGGPLKPEITVSYIAVATIFFNSGLSLKTEELTSALVHLKLHLFIQIFTLAFFPATIWLFLQLLSITPINEWLLKGLQTVGCMPPPVSSAVILTKAVGGNEAAAIFNSAFGSFLGIVITPLLLLLFLGSSSSVPFTSIFSQLFMTVVVPLIIGQIVRRYIKDWLERKKPPFGAISSSVLLMIIYTTFCDTFSNPNIDLDKFSLVLILFIIFSIQLSFMLLTFIFSTRNNSGFTPADTVAIIFCSTHKSLTLGIPMLKIVFAGHEHLSLISVPLLIYHPAQILLGSVLVPTIKSWMVSRQKGVKLTRPTV

SEQ ID NO: 3986 - protein, 550 aa, unidentified
MTGDKGPQRLSGSSYGSISSPTSPTSPGPQQAPPRETYLSEKIPIPDTKPGTFSLRKLWAFTGPGFLMSIAFLDPGNIESDLQAGAVAGFKLLWVLLWATVLGLLCQRLAARLGVVTGKDLGEVCHLYYPKVPRTVLWLTIELAIVGSDMQEVIGTAIAFNLLSAGRIPLWGGVLITIVDTFFFLFLDNYGLRKLEAFFGLLITIMALTFGYEYVVARPEQGALLRGLFLPSCPGCGHPELLQAVGIVGAIIMPHNIYLHSALVKSREIDRARRADIREANMYFLIEATIALSVSFIINLFVMAVFGQAFYQKTNQAAFNICANSSLHDYAKIFPMNNATVAVDIYQGGVILGCLFGPAALYIWAIGLLAAGQSSTMTGTYAGQFVMEGFLRLRWSRFARVLLTRSCAILPTVLVAVFRDLRDLSGLNDLLNVLQSLLLPFAVLPILTFTSMPTLMQEFANGLLNKVVTSSIMVLVCAINLYFVVSYLPSLPHPAYFGLAALLAAAYLGLSTYLVWTCCLAHGATFLAHSSHHHFLYGLLEEDQKGETSG

SEQ ID NO: 3987 - protein, 568 aa, unidentified
MVLGPEQKMSDDSVSGDHGESASLGNINPAYSNPSLSQSPGDSEEYFATYFNEKISIPEEEYSCFSFRKLWAFTGPGFLMSIAYLDPGNIESDLQSGAVAGFKLLWILLLATLVGLLLQRLAARLGVVTGLHLAEVCHRQYPKVPRVILWLMVELAIIGSDMQEVIGSAIAINLLSVGRIPLWGGVLITIADTFVFLFLDKYGLRKLEAFFGFLITIMALTFGYEYVTVKPSQSQVLKGMFVPSCSGCRTPQIEQAVGIVGAVIMPHNMYLHSALVKSRQVNRNNKQEVREANKYFFIESCIALFVSFIINVFVVSVFAEAFFGKTNEQVVEVCTNTSSPHAGLFPKDNSTLAVDIYKGGVVLGCYFGPAALYIWAVGILAAGQSSTMTGTYSGQFVMEGFLNLKWSRFARVVLTRSIAIIPTLLVAVFQDVEHLTGMNDFLNVLQSLQLPFALIPILTFTSLRPVMSDFANGLGWRIAGGILVLIICSINMYFVVVYVRDLGHVALYVVAAVVSVAYLGFVFYLGWQCLIALGMSFLDCGHTCHLGLTAQPELYLLNTMDADSLVSR

SEQ ID NO: 3988 - protein, 1099 aa, unidentified
MSLNNSSNVFLDSVPSNTNRFQVSVINENHESSAAADDNTDPPHYEETSFGDEAQKRLRISFRPGNQECYDNFLQSGETAKTDASFHAYDSHTNTYYLQTFGHNTMDAVPKIEYYRNTGSISGPKVNRPSLLEIHEQLAKNVAVTPSSADRVANGDGIPGDEQAENKEDDQAGVVKFGWVKGVLVRCMLNIWGVMLFIRLSWIVGEAGIGLGVLIILLSTMVTSITGLSTSAIATNGFVRGGGAYYLISRSLGPEFGGSIGLIFAFANAVAVAMYVVGFAETVVDLLKESDSMMVDPTNDIRIIGSITVVILLGISVAGMEWEAKAQVILLVILLIAIANFFIGTVIPSNNEKKSRGFFNYQASIFAENFGPRFTKGEGFFSVFAIFFPAATGILAGANISGDLEDPQDAIPRGTMLAIFITTVAYLGVAICVGACVVRDATGNMNDTIISGMNCNGSAACGLGYDFSRCRHEPCQYGLMNNFQVMSMVSGFGPLITAGIFSATLSSALASLVSAPKVFQALCKDNIYKALQFFAKGYGKNNEPLRGYILTFLIAMAFILIAELNTIAPIISNFFLASYALINFSCFHASYAKSPGWRPAYGIYNMWVSLFGAVLCCAVMFVINWWAAVITYVIEFFLYVYVTCKKPDVNWGSSTQALSYVSALDNALELTTVEDHVKNFRPQCIVLTGGPMTRPALLDITHAFTKNSGLCICCEVFVGPRKLCVKEMNSGMAKKQAWLIKNKIKAFYAAVAADCFRDGVRSLLQASGLGRMKPNTLVIGYKKNWRKAPLTEIENYVGIIHDAFDFEIGVVIVRISQGFDISQVLQVQEELERLEQERLALEATIKDNECEEESGGIRGLFKKAGKLNITKTTPKKDGSINTSQSMHVGEFNQKLVEASTQFKKKQEKGTIDVWWLFDDGGLTLLIPYILTLRKKWKDCKLRIYVGGKINRIEEEKIVMASLLSKFRIKFADIHIIGDINIRPNKESWKVFEEMIEPYRLHESCKDLTTAEKLKRETPWKITDAELEAVKEKSYRQVRLNELLQEHSRAANLIVLSLPVARKGSISDLLYMAWLEILTKNLPPVLLVRGNHKNVLTFYS

SEQ ID NO: 3989 - protein, 1212 aa, unidentified
MEPRPTAPSSGAPGLAGVGETPSAAALAAARVELPGTAVPSVPEDAAPASRDGGGVRDEGPAAAGDGLGRPLGPTPSQSRFQVDLVSENAGRAAAAAAAAAAAAAAAGAGAGAKQTPADGEASGESEPAKGSEEAKGRFRVNFVDPAASSSAEDSLSDAAGVGVDGPNVSFQNGGDTVLSEGSSLHSGGGGGSGHHQHYYYDTHTNTYYLRTFGHNTMDAVPRIDHYRHTAAQLGEKLLRPSLAELHDELEKEPFEDGFANGEESTPTRDAVVTYTAESKGVVKFGWIKGVLVRCMLNIWGVMLFIRLSWIVGQAGIGLSVLVIMMATVVTTITGLSTSAIATNGFVRGGGAYYLISRSLGPEFGGAIGLIFAFANAVAVAMYVVGFAETVVELLKEHSILMIDEINDIRIIGAITVVILLGISVAGMEWEAKAQIVLLVILLLAIGDFVIGTFIPLESKKPKGFFGYKSEIFNENFGPDFREEETFFSVFAIFFPAATGILAGANISGDLADPQSAIPKGTLLAILITTLVYVGIAVSVGSCVVRDATGNVNDTIVTELTNCTSAACKLNFDFSSCESSPCSYGLMNNFQVMSMVSGFTPLISAGIFSATLSSALASLVSAPKIFQALCKDNIYPAFQMFAKGYGKNNEPLRGYILTFLIALGFILIAELNVIAPIISNFFLASYALINFSVFHASLAKSPGWRPAFKYYNMWISLLGAILCCIVMFVINWWAALLTYVIVLGLYIYVTYKKPDVNWGSSTQALTYLNALQHSIRLSGVEDHVKNFRPQCLVMTGAPNSRPALLHLVHDFTKNVGLMICGHVHMGPRRQAMKEMSIDQAKYQRWLIKNKMKAFYAPVHADDLREGAQYLMQAAGLGRMKPNTLVLGFKKDWLQADMRDVDMYINLFHDAFDIQYGVVVIRLKEGLDISHLQGQEELLSSQEKSPGTKDVVVSVEYSKKSDLDTSKPLSEKPITHKVEEEDGKTATQPLLKKESKGPIVPLNVADQKLLEASTQFQKKQGKNTIDVWWLFDDGGLTLLIPYLLTTKKKWKDCKIRVFIGGKINRIDHDRRAMATLLSKFRIDFSDIMVLGDINTKPKKENIIAFEEIIEPYRLHEDDKEQDIADKMKEDEPWRITDNELELYKTKTYRQIRLNELLKEHSSTANIIVMSLPVARKGAVSSALYMAWLEALSKDLPPILLVRGNHQSVLTFYS

SEQ ID NO: 3990 - protein, 1021 aa, unidentified
MAELPTTETPGDATLCSGRFTISTLLSSDEPSPPAAYDSSHPSHLTHSSTFCMRTFGYNTIDVVPTYEHYANSTQPGEPRKVRPTLADLHSFLKQEGRHLHALAFDSRPSHEMTDGLVEGEAGTSSEKNPEEPVRFGWVKGVMIRCMLNIWGVILYLRLPWITAQAGIVLTWIIILLSVTVTSITGLSISAISTNGKVKSGGTYFLISRSLGPELGGSIGLIFAFANAVGVAMHTVGFAETVRDLLQEYGAPIVDPINDIRIIAVVSVTVLLAISLAGMEWESKAQVLFFLVIMVSFANYLVGTLIPPSEDKASKGFFSYRADIFVQNLVPDWRGPDGTFFGMFSIFFPSATGILAGANISGDLKDPAIAIPKGTLMAIFWTTISYLAISATIGSCVVRDASGVLNDTVTPGWGACEGLACSYGWNFTECTQQHSCHYGLINYYQTMSMVSGFAPLITAGIFGATLSSALACLVSAAKVFQCLCEDQLYPLIGFFGKGYGKNKEPVRGYLLAYAIAVAFIIIAELNTIAPIISNFFLCSYALINFSCFHASITNSPGWRPSFQYYNKWAALFGAIISVVIMFLLTWWAALIAIGVVLFLLLYVIYKKPEVNWGSSVQAGSYNLALSYSVGLNEVEDHIKNYRPQCLVLTGPPNFRPALVDFVGTFTRNLSLMICGHVLIGPHKQRMPELQLIANGHTKWLNKRKIKAFYSDVIAEDLRRGVQILMQAAGLGRMKPNILVVGFKKNWQSAHPATVEDYIGILHDAFDFNYGVCVMRMREGLNVSKMMQAHINPVFDPAEDGKEASARVDPKALVKEEQATTIFQSEQGKKTIDIYWLFDDGGLTLLIPYLLGRKRRWSKCKIRVFVGGQINRMDQERKAIISLLSKFRLGFHEVHILPDINQNPRAEHTKRFEDMIAPFRLNDGFKDEATVNEMRRDCPWKISDEEITKNRVKSLRQVRLNEIVLDYSRDAALIVITLPIGRKGKCPSSLYMAWLETLSQDLRPPVILIRGNQENVLTFYCQ

SEQ ID NO: 3991 - protein, 1085 aa, unidentified
MPHFTVVPVDGPRRGDYDNLEGLSWVDYGERAELDDSDGHGNHRESSPFLSPLEASRGIDYYDRNLALFEEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMHNSDISAYTYERTLMMEQRSQMLRQMRLTKTEREREAQLVKDRHSALRLESLYSDEEDESAVGADKIQMTWTRDKYMTETWDPSHAPDNFRELVHIKPDQSNVRRMHTAVKLNEVIVTRSHDARLVLLNMPGPPRNSEGDENYMEFLEVLTEGLERVLLVRGGGREVITIYS

SEQ ID NO: 3992 - protein, 1139 aa, unidentified
MSRRFTVTSLPPAGPARSPDPESRRHSVADPRHLPGEDVKGDGNPKESSPFINSTDTEKGKEYDGKNMALFEEEMDTSPMVSSLLSGLANYTNLPQGSREHEEAENNEGGKKKPVQAPRMGTFMGVYLPCLQNIFGVILFLRLTWVVGIAGIMESFCMVFICCSCTMLTAISMSAIATNGVVPAGGSYYMISRSLGPEFGGAVGLCFYLGTTFAGAMYILGTIEILLAYLFPAMAIFKAEDASGEAAAMLNNMRVYGTCVLTCMATVVFVGVKYVNKFALVFLGCVILSILAIYAGVIKSAFDPPNFPICLLGNRTLSRHGFDVCAKLAWEGNETVTTRLWGLFCSSRFLNATCDEYFTRNNVTEIQGIPGAASGLIKENLWSSYLTKGVIVERSGMTSVGLADGTPIDMDHPYVFSDMTSYFTLLVGIYFPSVTGIMAGSNRSGDLRDAQKSIPTGTILAIATTSAVYISSVVLFGACIEGVVLRDKFGEAVNGNLVVGTLAWPSPWVIVIGSFFSTCGAGLQSLTGAPRLLQAISRDGIVPFLQVFGHGKANGEPTWALLLTACICEIGILIASLDEVAPILSMFFLMCYMFVNLACAVQTLLRTPNWRPRFRYYHWTLSFLGMSLCLALMFICSWYYALVAMLIAGLIYKYIEYRGAEKEWGDGIRGLSLSAARYALLRLEEGPPHTKNWRPQLLVLVRVDQDQNVVHPQLLSLTSQLKAGKGLTIVGSVLEGTFLENHPQAQRAEESIRRLMEAEKVKGFCQVVISSNLRDGVSHLIQSGGLGGLQHNTVLVGWPRNWRQKEDHQTWRNFIELVRETTAGHLALLVTKNVSMFPGNPERFSEGSIDVWWIVHDGGMLMLLPFLLRHHKVWRKCKMRIFTVAQMDDNSIQMKKDLTTFLYHLRITAEVEVVEMHESDISAYTYEKTLVMEQRSQILKQMHLTKNEREREIQSITDESRGSIRRKNPANTRLRLNVPEETAGDSEEKPEEEVQLIHDQSAPSCPSSSPSPGEEPEGEGETDPEKVHLTWTKDKSVAEKNKGPSPVSSEGIKDFFSMKPEWENLNQSNVRRMHTAVRLNEVIVKKSRDAKLVLLNMPGPPRNRNGDENYMEFLEVLTEHLDRVMLVRGGGREVITIYS

SEQ ID NO: 3993 - protein, 1150 aa, unidentified
MHPPETTTKMASVRFMVTPTKIDDIPGLSDTSPDLSSRSSSRVRFSSRESVPETSRSEPMSEMSGATTSLATVALDPPSDRTSHPQDVIEDLSQNSITGEHSQLLDDGHKKARNAYLNNSNYEEGDEYFDKNLALFEEEMDTRPKVSSLLNRMANYTNLTQGAKEHEEAENITEGKKKPTKTPQMGTFMGVYLPCLQNIFGVILFLRLTWVVGTAGVLQAFAIVLICCCCTMLTAISMSAIATNGVVPAGGSYFMISRALGPEFGGAVGLCFYLGTTFAAAMYILGAIEIFLVYIVPRAAIFHSDDALKESAAMLNNMRVYGTAFLVLMVLVVFIGVRYVNKFASLFLACVIVSILAIYAGAIKSSFAPPHFPVCMLGNRTLSSRHIDVCSKTKEINNMTVPSKLWGFFCNSSQFFNATCDEYFVHNNVTSIQGIPGLASGIITENLWSNYLPKGEIIEKPSAKSSDVLGSLNHEYVLVDITTSFTLLVGIFFPSVTGIMAGSNRSGDLKDAQKSIPIGTILAILTTSFVYLSNVVLFGACIEGVVLRDKFGDAVKGNLVVGTLSWPSPWVIVIGSFFSTCGAGLQSLTGAPRLLQAIAKDNIIPFLRVFGHSKANGEPTWALLLTAAIAELGILIASLDLVAPILSMFFLMCYLFVNLACALQTLLRTPNWRPRFRYYHWALSFMGMSICLALMFISSWYYAIVAMVIAGMIYKYIEYQGAEKEWGDGIRGLSLSAARFALLRLEEGPPHTKNWRPQLLVLLKLDEDLHVKHPRLLTFASQLKAGKGLTIVGSVIVGNFLENYGEALAAEQTIKHLMEAEKVKGFCQLVVAAKLREGISHLIQSCGLGGMKHNTVVMGWPNGWRQSEDARAWKTFIGTVRVTTAAHLALLVAKNISFFPSNVEQFSEGNIDVWWIVHDGGMLMLLPFLLKQHKVWRKCSIRIFTVAQLEDNSIQMKKDLATFLYHLRIEAEVEVVEMHDSDISAYTYERTLMMEQRSQMLRHMRLSKTERDREAQLVKDRNSMLRLTSIGSDEDEETETYQEKVHMTWTKDKYMASRGQKAKSMEGFQDLLNMRPDQSNVRRMHTAVKLNEVIVNKSHEAKLVLLNMPGPPRNPEGDENYMEFLEVLTEGLERVLLVRGGGSEVITIYS

SEQ ID NO: 3994 - protein, 1083 aa, unidentified
MPTNFTVVPVEAHADGGGDETAERTEAPGTPEGPEPERPSPGDGNPRENSPFLNNVEVEQESFFEGKNMALFEEEMDSNPMVSSLLNKLANYTNLSQGVVEHEEDEESRRREAKAPRMGTFIGVYLPCLQNILGVILFLRLTWIVGVAGVLESFLIVAMCCTCTMLTAISMSAIATNGVVPAGGSYYMISRSLGPEFGGAVGLCFYLGTTFAGAMYILGTIEIFLTYISPGAAIFQAEAAGGEAAAMLHNMRVYGTCTLVLMALVVFVGVKYVNKLALVFLACVVLSILAIYAGVIKSAFDPPDIPVCLLGNRTLSRRSFDACVKAYGIHNNSATSALWGLFCNGSQPSAACDEYFIQNNVTEIQGIPGAASGVFLENLWSTYAHAGAFVEKKGVPSVPVAEESRASALPYVLTDIAASFTLLVGIYFPSVTGIMAGSNRSGDLKDAQKSIPTGTILAIVTTSFIYLSCIVLFGACIEGVVLRDKFGEALQGNLVIGMLAWPSPWVIVIGSFFSTCGAGLQSLTGAPRLLQAIARDGIVPFLQVFGHGKANGEPTWALLLTVLICETGILIASLDSVAPILSMFFLMCYLFVNLACAVQTLLRTPNWRPRFKFYHWTLSFLGMSLCLALMFICSWYYALSAMLIAGCIYKYIEYRGAEKEWGDGIRGLSLNAARYALLRVEHGPPHTKNWRPQVLVMLNLDAEQAVKHPRLLSFTSQLKAGKGLTIVGSVLEGTYLDKHMEAQRAEENIRSLMSTEKTKGFCQLVVSSSLRDGMSHLIQSAGLGGLKHNTVLMAWPASWKQEDNPFSWKNFVDTVRDTTAAHQALLVAKNVDSFPQNQERFGGGHIDVWWIVHDGGMLMLLPFLLRQHKVWRKCRMRIFTVAQVDDNSIQMKKDLQMFLYHLRISAEVEVVEMVENDISAFTYERTLMMEQRSQMLKQMQLSKNEQEREAQLIHDRNTASHTAAAARTQAPPTPDKVQMTWTREKLIAEKYRSRDTSLSGFKDLFSMKPDQSNVRRMHTAVKLNGVVLNKSQDAQLVLLNMPGPPKNRQGDENYMEFLEVLTEGLNRVLLVRGGGREVITIYS

SEQ ID NO: 3995 - protein, 714 aa, unidentified
MTQMSQVQELFHEAAQQDALAQPQPWWKTQLFMWEPVLFGTWDGVFTSCMINIFGVVLFLRTGWLVGNTGVLLGMFLVSFVILVALVTVLSGIGVGERSSIGSGGVYSMISSVLGGQTGGTIGLLYVFGQCVAGAMYITGFAESISDLLGLGNIWAVRGISVAVLLALLGINLAGVKWIIRLQLLLLFLLAVSTLDFVVGSFTHLDPEHGFIGYSPELLQNNTLPDYSPGESFFTVFGVFFPAATGVMAGFNMGGDLREPAASIPLGSLAAVGISWFLYIIFVFLLGAICTREALRYDFLIAEKVSLMGFLFLLGLYISSLASCMGGLYGAPRILQCIAQEKVIPALACLGQGKGPNKTPVAAICLTSLVTMAFVFVGQVNVLAPIVTINFMLTYVAVDYSYFSLSMCSCSLTPVPEPVLREGAEGLHCSEHLLLEKAPSYGSEGPAQRVLEGTLLEFTKDMDQLLQLTRKLESSQPRQGEGNRTPESQKRKSKKATKQTLQDSFLLDLKSPPSFPVEISDRLPAASWEGQESCWNKQTSKSEGTQPEGTYGEQLVPELCNQSESSGEDFFLKSRLQEQDVWRRSTSFYTHMCNPWVSLLGAVGSLLIMFVIQWVYTLVNMGVAAIVYFYIGRASPGLHLGSASNFSFFRWMRSLLLPSCRSLRSPQEQIILAPSLAKVDMEMTQLTQENADFATRDRYHHSSLVNREQLMPHY

SEQ ID NO: 3996 - protein, 914 aa, unidentified
MASESSPLLAYRLLGEEGVALPANGAGGPGGASARKLSTFLGVVVPTVLSMFSIVVFLRIGFVVGHAGLLQALAMLLVAYFILALTVLSVCAIATNGAVQGGGAYFMISRTLGPEVGGSIGLMFYLANVCGCAVSLLGLVESVLDVFGADATGPSGLRVLPQGYGWNLLYGSLLLGLVGGVCTLGAGLYARASFLTFLLVSGSLASVLISFVAVGPRDIRLTPRPGPNGSSLPPRFGHFTGFNSSTLKDNLGAGYAEDYTTGAVMNFASVFAVLFNGCTGIMAGANMSGELKDPSRAIPLGTIVAVAYTFFVYVLLFFLSSFTCDRTLLQEDYGFFRAISLWPPLVLIGIYATALSASMSSLIGASRILHALARDDLFGVILAPAKVVSRGGNPWAAVLYSWGLVQLVLLAGKLNTLAAVVTVFYLVAYAAVDLSCLSLEWASAPNFRPTFSLFSWHTCLLGVASCLLMMFLISPGAAGGSLLLMGLLAALLTARGGPSSWGYVSQALLFHQVRKYLLRLDVRKDHVKFWRPQLLLLVGNPRGALPLLRLANQLKKGGLYVLGHVTLGDLDSLPSDPVQPQYGAWLSLVDRAQVKAFVDLTLSPSVRQGAQHLLRISGLGGMKPNTLVLGFYDDAPPQDHFLTDPAFSEPADSTREGSSPALSTLFPPPRAPGSPRALNPQDYVATVADALKMNKNVVLARASGALPPERLSRGSGGTSQLHHVDVWPLNLLRPRGGPGYVDVCGLFLLQMATILGMVPAWHSARLRIFLCLGPREAPGAAEGRLRALLSQLRIRAEVQEVVWGEGAGAGEPEAEEEGDFVNSGRGDAEAEALARSANALVRAQQGRGTGGGPGGPEGGDAEGPITALTFLYLPRPPADPARYPRYLALLETLTRDLGPTLLVHGVTPVTCTDL

SEQ ID NO: 3997 - protein, 595 aa, unidentified
MKFFSYILVYRRFLFVVFTVLVLLPLPIVLHTKEAECAYTLFVVATFWLTEALPLSVTALLPSLMLPMFGIMPSKKVASAYFKDFHLLLIGVICLATSIEKWNLHKRIALKMVMMVGVNPAWLTLGFMSSTAFLSMWLSNTSTAAMVMPIAEAVVQQIINAEAEVEATQMTYFNGSTNHGLEIDESVNGHEINERKEKTKPVPGYNNDTGKISSKVELEKNSGMRTKYRTKKGHVTRKLTCLCIAYSSTIGGLTTITGTSTNLIFAEYFNTRYPDCRCLNFGSWFTFSFPAALIILLLSWIWLQWLFLGFNFKEMFKCGKTKTVQQKACAEVIKQEYQKLGPIRYQEIVTLVLFIIMALLWFSRDPGFVPGWSALFSEYPGFATDSTVALLIGLLFFLIPAKTLTKTTPTGEIVAFDYSPLITWKEFQSFMPWDIAILVGGGFALADGCEESGLSKWIGNKLSPLGSLPAWLIILISSLMVTSLTEVASNPATITLFLPILSPLAEAIHVNPLYILIPSTLCTSFAFLLPVANPPNAIVFSYGHLKVIDMVKAGLGVNIVGVAVVMLGICTWIVPMFDLYTYPSWAPAMSNETMP

SEQ ID NO: 3998 - protein, 592 aa, unidentified
MATCWQALWAYRSYLIVFFVPILLLPLPILVPSKEAYCAYAIILMALFWCTEALPLAVTALFPLILFPMMGIVDASEVAVEYLKDSNLLFFGGLLVAIAVEHWNLHKRIALRVLLIVGVRPAPLILGFMLVTAFLSMWISNTATSAMMVPIAHAVLDQLHSSQASSNVEEGSNNPTFELQEPSPQKEVTKLDNGQALPVTSASSEGRAHLSQKHLHLTQCMSLCVCYSASIGGIATLTGTAPNLVLQGQINSLFPQNGNVVNFASWFSFAFPTMVILLLLAWLWLQILFLGFNFRKNFGIGEKMQEQQQAAYCVIQTEHRLLGPMTFAEKAISILFVILVLLWFTREPGFFLGWGNLAFPNAKGESMVSDGTVAIFIGIIMFIIPSKFPGLTQDPENPGKLKAPLGLLDWKTVNQKMPWNIVLLLGGGYALAKGSERSGLSEWLGNKLTPLQSVPAPAIAIILSLLVATFTECTSNVATTTIFLPILASMAQAICLHPLYVMLPCTLATSLAFMLPVATPPNAIVFSFGDLKVLDMARAGFLLNIIGVLIIALAINSWGIPLFSLHSFPSWAQSNTTAQCLPSLANTTTPSP

SEQ ID NO: 3999 - protein, 602 aa, unidentified
MAALAAAAKKVWSARRLLVLLFTPLALLPVVFALPPKEGRCLFVILLMAVYWCTEALPLSVTALLPIVLFPFMGILPSNKVCPQYFLDTNFLFLSGLIMASAIEEWNLHRRIALKILMLVGVQPARLILGMMVTTSFLSMWLSNTASTAMMLPIANAILKSLFGQKEVRKDPSQESEENTAAVRRNGLHTVPTEMQFLASTEAKDHPGETEVPLDLPADSRKEDEYRRNIWKGFLISIPYSASIGGTATLTGTAPNLILLGQLKSFFPQCDVVNFGSWFIFAFPLMLLFLLAGWLWISFLYGGLSFRGWRKNKSEIRTNAEDRARAVIREEYQNLGPIKFAEQAVFILFCMFAILLFTRDPKFIPGWASLFNPGFLSDAVTGVAIVTILFFFPSQRPSLKWWFDFKAPNTETEPLLTWKKAQETVPWNIILLLGGGFAMAKGCEESGLSVWIGGQLHPLENVPPALAVLLITVVIAFFTEFASNTATIIIFLPVLAELAIRLRVHPLYLMIPGTVGCSFAFMLPVSTPPNSIAFASGHLLVKDMVRTGLLMNLMGVLLLSLAMNTWAQTIFQLGTFPDWADMYSVNVTALPPTLANDTFRTL

SEQ ID NO: 4000 - protein, 626 aa, unidentified
MGLLQGLLRVRKLLLVVCVPLLLLPLPVLHPSSEASCAYVLIVTAVYWVSEAVPLGAAALVPAFLYPFFGVLRSNEVAAEYFKNTTLLLVGVICVAAAVEKWNLHKRIALRMVLMAGAKPGMLLLCFMCCTTLLSMWLSNTSTTAMVMPIVEAVLQELVSAEDEQLVAGNSNTEEAEPISLDVKNSQPSLELIFVNEESNADLTTLMHNENLNGVPSITNPIKTANQHQGKKQHPSQEKPQVLTPSPRKQKLNRKYRSHHDQMICKCLSLSISYSATIGGLTTIIGTSTSLIFLEHFNNQYPAAEVVNFGTWFLFSFPISLIMLVVSWFWMHWLFLGCNFKETCSLSKKKKTKREQLSEKRIQEEYEKLGDISYPEMVTGFFFILMTVLWFTREPGFVPGWDSFFEKKGYRTDATVSVFLGFLLFLIPAKKPCFGKKNDGENQEHSLGTEPIITWKDFQKTMPWEIVILVGGGYALASGSKSSGLSTWIGNQMLSLSSLPPWAVTLLACILVSIVTEFVSNPATITIFLPILCSLSETLHINPLYTLIPVTMCISFAVMLPVGNPPNAIVFSYGHCQIKDMVKAGLGVNVIGLVIVMVAINTWGVSLFHLDTYPAWARVSNITDQA

SEQ ID NO: 4001 - protein, 568 aa, unidentified [sequence omitted]

SEQ ID NO: 4002 - protein, 389 aa, unidentified
MEDSPTMVRVDSPTMVRGENQVSPCQGRRCFPKALGYVTGDMKELANQLKDKPVVLQFIDWILRGISQVVFVNNPVSGILILVGLLVQNPWWALTGWLGTVVSTLMALLLSQDRSLIASGLYGYNATLVGVLMAVFSDKGDYFWWLLLPVCAMSMTCPIFSSALNSMLSKWDLPVFTLPFNMALSMYLSATGHYNPFFPAKLVIPITTAPNISWSDLSALELLKSIPVGVGQIYGCDNPWTGGIFLGAILLSSPLMCLHAAIGSLLGIAAGLSLSAPFEDIYFGLWGFNSSLACIAMGGMFMALTWQTHLLALGCALFTAYLGVGMANFMAEVGLPACTWPFCLATLLFLIMTTKNSNIYKMPLSKVTYPEENRIFYLQAKKRMVESPL

SEQ ID NO: 4003 - protein, 920 aa, unidentified
MSDPHSSPLLPEPLSSRYKLYEAEFTSPSWPSTSPDTHPALPLLEMPEEKDLRSSNEDSHIVKIEKLNERSKRKDDGVAHRDSAGQRCICLSKAVGYLTGDMKEYRIWLKDKHLALQFIDWVLRGTAQVMFINNPLSGLIIFIGLLIQNPWWTITGGLGTVVSTLTALALGQDRSAIASGLHGYNGMLVGLLMAVFSEKLDYYWWLLFPVTFTAMSCPVLSSALNSIFSKWDLPVFTLPFNIAVTLYLAATGHYNLFFPTTLVEPVSSVPNITWTEMEMPLLLQAIPVGVGQVYGCDNPWTGGVFLVALFISSPLICLHAAIGSIVGLLAALSVATPFETIYTGLWSYNCVLSCIAIGGMFYALTWQTHLLALICALFCAYMEAAISNIMSVVGVPPGTWAFCLATIIFLLLTTNNPAIFRLPLSKVTYPEANRIYYLTVKSGEEEKAPSGGGGEHPPTAGPKVEEGSEAVLSKHRSVFHIEWSSIRRRSKVFGKGEHQERQNKDPFPYRYRKPTVELLDLDTMEESSEIKVETNISKTSWIRSSMAASGKRVSKALSYITGEMKECGEGLKDKSPVFQFFDWVLRGTSQVMFVNNPLSGILIILGLFIQNPWWAISGCLGTIMSTLTALILSQDKSAIAAGFHGYNGVLVGLLMAVFSDKGDYYWWLLLPVIIMSMSCPILSSALGTIFSKWDLPVFTLPFNITVTLYLAATGHYNLFFPTTLLQPASAMPNITWSEVQVPLLLRAIPVGIGQVYGCDNPWTGGIFLIALFISSPLICLHAAIGSTMGMLAALTIATPFDSIYFGLCGFNSTLACIAIGGMFYVITWQTHLLAIACALFAAYLGAALANMLSVFGLPPCTWPFCLSALTFLLLTTNNPAIYKLPLSKVTYPEANRIYYLSQERNRRASIITKYQAYDVS

SEQ ID NO: 4004 - protein, 708 aa, unidentified
MGMSKSHSFFGYPLSIFFIVVNEFCERFSYYGMRAILILYFTNFISWDDNLSTAIYHTFVALCYLTPILGALIADSWLGKFKTIVSLSIVYTIGQAVTSVSSINDLTDHNHDGTPDSLPVHVVLSLIGLALIALGTGGIKPCVSAFGGDQFEEGQEKQRNRFFSIFYLAINAGSLLSTIITPMLRVQQCGIHSKQACYPLAFGVPAALMAVALIVFVLGSGMYKKFKPQGNIMGKVAKCIGFAIKNRFRHRSKAFPKREHWLDWAKEKYDERLISQIKMVTRVMFLYIPLPMFWALFDQQGSRWTLQATTMSGKIGALEIQPDQMQTVNAILIVIMVPIFDAVLYPLIAKCGFNFTSLKKMAVGMVLASMAFVVAAIVQVEIDKTLPVFPKGNEVQIKVLNIGNNTMNISLPGEMVTLGPMSQTNAFMTFDVNKLTRINISSPGSPVTAVTDDFKQGQRHTLLVWAPNHYQVVKDGLNQKPEKGENGIRFVNTFNELITITMSGKVYANISSYNASTYQFFPSGIKGFTISSTEIPPQCQPNFNTFYLEFGSAYTYIVQRKNDSCPEVKVFEDISANTVNMALQIPQYFLLTCGEVVFSVTGLEFSYSQAPSNMKSVLQAGWLLTVAVGNIIVLIVAGAGQFSKQWAEYILFAALLLVVCVIFAIMARFYTYINPAEIEAQFDEDEKKNRLEKSNPYFMSGANSQKQM

SEQ ID NO: 4005 - protein, 729 aa, unidentified
MNPFQKNESKETLFSPVSIEEVPPRPPSPPKKPSPTICGSNYPLSIAFIVVNEFCERFSYYGMKAVLILYFLYFLHWNEDTSTSIYHAFSSLCYFTPILGAAIADSWLGKFKTIIYLSLVYVLGHVIKSLGALPILGGQVVHTVLSLIGLSLIALGTGGIKPCVAAFGGDQFEEKHAEERTRYFSVFYLSINAGSLISTFITPMLRGDVQCFGEDCYALAFGVPGLLMVIALVVFAMGSKIYNKPPPEGNIVAQVFKCIWFAISNRFKNRSGDIPKRQHWLDWAAEKYPKQLIMDVKALTRVLFLYIPLPMFWALLDQQGSRWTLQAIRMNRNLGFFVLQPDQMQVLNPLLVLIFIPLFDFVIYRLVSKCGINFSSLRKMAVGMILACLAFAVAAAVEIKINEMAPAQPGPQEVFLQVLNLADDEVKVTVVGNENNSLLIESIKSFQKTPHYSKLHLKTKSQDFHFHLKYHNLSLYTEHSVQEKNWYSLVIREDGNSISSMMVKDTESRTTNGMTTVRFVNTLHKDVNISLSTDTSLNVGEDYGVSAYRTVQRGEYPAVHCRTEDKNFSLNLGLLDFGAAYLFVITNNTNQGLQAWKIEDIPANKMSIAWQLPQYALVTAGEVMFSVTGLEFSYSQAPSSMKSVLQAAWLLTIAVGNIIVLVVAQFSGLVQWAEFILFSCLLLVICLIFSIMGYYYVPVKTEDMRGPADKHIPHIQGNMIKLETKKTKL

SEQ ID NO: 4006 - protein, 581 aa, unidentified
MPAPRAREQPRVPGERQPLLPRGARGPRRWRRAAGAAVLLVEMLERAAFFGVTANLVLYLNSTNFNWTGEQATRAALVFLGASYLLAPVGGWLADVYLGRYRAVALSLLLYLAASGLLPATAFPDGRSSFCGEMPASPLGPACPSAGCPRSSPSPYCAPVLYAGLLLLGLAASSVRSNLTSFGADQVMDLGRDATRRFFNWFYWSINLGAVLSLLVVAFIQQNISFLLGYSIPVGCVGLAFFIFLFATPVFITKPPMGSQVSSMLKLALQNCCPQLWQRHSARDRQCARVLADERSPQPGASPQEDIANFQVLVKILPVMVTLVPYWMVYFQMQSTYVLQGLHLHIPNIFPANPANISVALRAQGSSYTIPEAWLLLANVVVVLILVPLKDRLIDPLLLRCKLLPSALQKMALGMFFGFTSVIVAGVLEMERLHYIHHNETVSQQIGEVLYNAAPLSIWWQIPQYLLIGISEIFASIPGLEFAYSEAPRSMQGAIMGIFFCLSGVGSLLGSSLVALLSLPGGWLHCPKDFGNINNCRMDLYFFLLAGIQAVTALLFVWIAGRYERASQGPASHSRFSRDRG

SEQ ID NO: 4007 - protein, 577 aa, unidentified
MEGSGGGAGERAPLLGARRAAAAAAAAGAFAGRRAACGAVLLTELLERAAFYGITSNLVLFLNGAPFCWEGAQASEALLLFMGLTYLGSPFGGWLADARLGRARAILLSLALYLLGMLAFPLLAAPATRAALCGSARLLNCTAPGPDAAARCCSPATFAGLVLVGLGVATVKANITPFGADQVKDRGPEATRRFFNWFYWSINLGAILSLGGIAYIQQNVSFVTGYAIPTVCVGLAFVVFLCGQSVFITKPPDGSAFTDMFKILTYSCCSQKRSGERQSNGEGIGVFQQSSKQSLFDSCKMSHGGPFTEEKVEDVKALVKIVPVFLALIPYWTVYFQMQTTYVLQSLHLRIPEISNITTTPHTLPAAWLTMFDAVLILLLIPLKDKLVDPILRRHGLLPSSLKRIAVGMFFVMCSAFAAGILESKRLNLVKEKTINQTIGNVVYHAADLSLWWQVPQYLLIGISEIFASIAGLEFAYSAAPKSMQSAIMGLFFFFSGVGSFVGSGLLALVSIKAIGWMSSHTDFGNINGCYLNYYFFLLAAIQGATLLLFLIISVKYDHHRDHQRSRANGVPTSRRA

SEQ ID NO: 4008 - protein, 579 aa, unidentified
MSVTGFTITDEKVHLYHSIEKEKTVRHIGDLCSSHSVKKIQVGICLLLVELCERFTFFEVVCNMIPFCTIKLGYHNCQAAILNLCFIGTSILTPVFVRWLTDVYLGRNKLVYICLFLHFLGTALLSVVAFPLEDFYLGTYHAVNNIPKTEQHRLFYVALLTICLGIGGVRAIVCPLGAFGLQEYGSQKTMSFFNWFYWLMNLNATIVFLGISYIQHSQAWALVLLIPFMSMLMAVITLHMIYYNLIYQSEKRCSLLTGVGVLVSALKTCHPQYCHLGRDVTSQLDHAKEKNGGCYSELHVEDTTFFLTLLPLFIFQLLYRMCIMQIPSGYYLQTMNSNLNLDGFLLPIAVMNAISSLPLLILAPFLEYFSTCLFPSKRVGSFLSTCIIAGNLFAALSVMIAGFFEIHRKHFPAVEQPLSGKVLTVSSMPCFYLILQYVLLGVAETLVNPALSVISYRFVPSNVRGTSMNFLTLFNGFGCFTGALLVKLVYLISDGNWFPNTLNKGNLESFFFFLASLTLLNVLGFCSVSQRYCNLNHFNAQNIRGSNLEETLLLHEKSLKFYGSIQEFSSSIDLWETAL

SEQ ID NO: 4009 - protein, 500 aa, unidentified
MPPAVGGPVGYTPPDGGWGWAVVIGAFISIGFSYAFPKSITVFFKEIEGIFHATTSEVSWISSIMLAVMYGGGPISSILVNKYGSRIVMIVGGCLSGCGLIAASFCNTVQQLYVCIGVIGGLGLAFNLNPALTMIGKYFYKRRPLANGLAMAGSPVFLCTLAPLNQVFFGIFGWRGSFLILGGLLLNCCVAGALMRPIGPKPTKAGKDKSKASLEKAGKSGVKKDLHDANTDLIGRHPKQEKRSVFQTINQFLDLTLFTHRGFLLYLSGNVIMFFGLFAPLVFLSSYGKSQHYSSEKSAFLLSILAFVDMVARPSMGLVANTKPIRPRIQYFFAASVVANGVCHMLAPLSTTYVGFCVYAGFFGFAFGWLSSVLFETLMDLVGPQRFSSAVGLVTIVECCPVLLGPPLLGRLNDMYGDYKYTYWACGVVLIISGIYLFIGMGINYRLLAKEQKANEQKKESKEEETSIDVAGKPNEVTKAAESPDQKDTDGGPKEEESPV

SEQ ID NO: 4010 - protein, 515 aa, unidentified
MVLSQEEPDSARGTSEAQPLGPAPTGAAPPPGPGPSDSPEAAVEKVEVELAGPATAEPHEPPEPPEGGWGWLVMLAAMWCNGSVFGIQNACGVLFVSMLETFGSKDDDKMVFKTAWVGSLSMGMIFFCCPIVSVFTDLFGCRKTAVVGAAVGFVGLMSSSFVSSIEPLYLTYGIIFACGCSFAYQPSLVILGHYFKKRLGLVNGIVTAGSSVFTILLPLLLRVLIDSVGLFYTLRVLCIFMFVLFLAGFTYRPLATSTKDKESGGSGSSLFSRKKFSPPKKIFNFAIFKVTAYAVWAVGIPLALFGYFVPYVHLMKHVNERFQDEKNKEVVLMCIGVTSGVGRLLFGRIADYVPGVKKVYLQVLSFFFIGLMSMMIPLCSIFGALIAVCLIMGLFDGCFISIMAPIAFELVGAQDVSQAIGFLLGFMSIPMTVGPPIAGLLRDKLGSYDVAFYLAGVPPLIGGAVLCFIPWIHSKKQREISKTTGKEKMEKMLENQNSLLSSSSGMFKKESDSII

SEQ ID NO: 4011 - protein, 471 aa, unidentified
MPAPQRKHRRGGFSHRCFPTPQTAMTPQPAGPPDGGWGWVVAAAAFAINGLSYGLLRSLGLAFPDLAEHFDRSAQDTAWISALALAVQQAASPVGSALSTRWGARPVVMVGGVLASLGFVFSAFASDLLHLYLGLGLLAGFGWALVFAPALGTLSRYFSRRRVLAVGLALTGNGASSLLLAPALQLLLDTFGWRGALLLLGAITLHLTPCGALLLPLVLPGDPPAPPRSPLAALGLSLFTRRAFSIFALGTALVGGGYFVPYVHLAPHALDRGLGGYGAALVVAVAAMGDAGARLVCGWLADQGWVPLPRLLAVFGALTGLGLWVVGLVPVVGGEESWGGPLLAAAVAYGLSAGSYAPLVFGVLPGLVGVGGVVQATGLVMMLMSLGGLLGPPLSGFLRDETGDFTASFLLSGSLILSGSFIYIGLPRALPSCGPASPPATPPPETGELLPAPQAVLLSPGGPGSTLDTTC

SEQ ID NO: 4012 - protein, 516 aa, unidentified
MPSGSHWTANSSKIITWLLEQPGKEEKRKTMAKVNRARSTSPPDGGWGWMIVAGCFLVTICTRAVTRCISIFFVEFQTYFTQDYAQTAWIHSIVDCVTMLCAPLGSVVSNHLSCQVGIMLGGLLASTGLILSSFATSLKHLYLTLGVLTGLGFALCYSPAIAMVGKYFSRRKALAYGIAMSGSGIGTFILAPVVQLLIEQFSWRGALLILGGFVLNLCVCGALMRPITLKEDHTTPEQNHVCRTQKEDIKRVSPYSSLTKEWAQTCLCCCLQQEYSFLLMSDFVVLAVSVLFMAYGCSPLFVYLVPYALSVGVSHQQAAFLMSILGVIDIIGNITFGWLTDRRCLKNYQYVCYLFAVGMDGLCYLCLPMLQSLPLLVPFSCTFGYFDGAYVTLIPVVTTEIVGTTSLSSALGVVYFLHAVPYLVSPPIAGRLVDTTGSYTAAFLLCGFSMIFSSVLLGFARLIKRMRKTQLQFIAKESDPKLQLWTNGSVAYSVARELDQKHGEPVATAVPGYSLT

SEQ ID NO: 4013 - protein, 426 aa, unidentified
MARRTEPPDGGWGWVVVLSAFFQSALVFGVLRSFGVFFVEFVAAFEEQAARVSWIASIGIAVQQFGSPVGSALSTKFGPRPVVMTGGILAALGMLLASFATSLTHLYLSIGLLSGSGWALTFAPTLACLSCYFSRRRSLATGLALTGVGLSSFTFAPFFQWLLSHYAWRGSLLLVSALSLHLVACGALLRPPSLAEDPAVGGPRAQLTSLLHHGPFLRYTVALTLINTGYFIPYLHLVAHLQDLDWDPLPAAFLLSVVAISDLVGRVVSGWLGDAVPGPVTRLLMLWTTLTGVSLALFPVAQAPTALVALAVAYGFTSGALAPLAFSVLPELIGTRRIYCGLGLLQMIESIGGLLGPPLSGYLRDVTGNYTASFVVAGAFLLSGSGILLTLPHFFCFSTTTSGPQDLVTEALDTKVPLPKEGLEED

SEQ ID NO: 4014 - protein, 510 aa, unidentified
MYTSHEDIGYDFEDGPKDKKTLKPHPNIDGGWAWMMVLSSFFVHILIMGSQMALGVLNVEWLEEFHQSRGLTAWVSSLSMGITLIVGPFIGLFINTCGCRQTAIIGGLVNSLGWVLSAYAANVHYLFITFGVAAGLGSGMAYLPAVVMVGRYFQKRRALAQGLSTTGTGFGTFLMTVLLKYLCAEYGWRNAMLIQGAVSLNLCVCGALMRPLSPGKNPNDPGEKDVRGLPAHSTESVKSTGQQGRTEEKDGGLGNEETLCDLQAQECPDQAGHRKNMCALRILKTVSWLTMRVRKGFEDWYSGYFGTASLFTNRMFVAFIFWALFAYSSFVIPFIHLPEIVNLYNLSEQNDVFPLTSIIAIVHIFGKVILGVIADLPCISVWNVFLLANFTLVLSIFILPLMHTYAGLAVICALIGFSSGYFSLMPVVTEDLVGIEHLANAYGIIICANGISALLGPPFAGWIYDITQKYDFSFYICGLLYMIGILFLLIQPCIRIIEQSRRKYMDGAHV

SEQ ID NO: 4015 - protein, 539 aa, unidentified
MALQSQASEEAKGPWQEADQEQQEPVGSPEPESEPEPEPEPEPVPVPPPEPQPEPQPLPDPAPLPELEFESERVHEPEPTPTVETRGTARGFQPPEGGFGWVVVFAATWCNGSIFGIHNSVGILYSMLLEEEKEKNRQVEFQAAWVGALAMGMIFFCSPIVSIFTDRLGCRITATAGAAVAFIGLHTSSFTSSLSLRYFTYGILFGCGCSFAFQPSLVILGHYFQRRLGLANGVVSAGSSIFSMSFPFLIRMLGDKIKLAQTFQVLSTFMFVLMLLSLTYRPLLPSSQDTPSKRGVRTLHQRFLAQLRKYFNMRVFRQRTYRIWAFGIAAAALGYFVPYVHLMKYVEEEFSEIKETWVLLVCIGATSGLGRLVSGHISDSIPGLKKIYLQVLSFLLLGLMSMMIPLCRDFGGLIVVCLFLGLCDGFFITIMAPIAFELVGPMQASQAIGYLLGMMALPMIAGPPIAGLLRNCFGDYHVAFYFAGVPPIIGAVILFFVPLMHQRMFKKEQRDSSKDKMLAPDPDPNGELLPGSPNPEEPI

SEQ ID NO: 4016 - protein, 465 aa, unidentified
MGGAVVDEGPTGVKAPDGGWGWAVLFGCFVITGFSYAFPKAVSVFFKELIQEFGIGYSDTAWISSILLAMLYGTGPLCSVCVNRFGCRPVMLVGGLFASLGMVAASFCRSIIQVYLTTGVITGLGLALNFQPSLIMLNRYFSKRRPMANGLAAAGSPVFLCALSPLGQLLQDRYGWRGGFLILGGLLLNCCVCAALMRPLVVTAQPGSGPPRPSRRLLDLSVFRDRGFVLYAVAASVMVLGLFVPPVFVVSYAKDLGVPDTKAAFLLTILGFIDIFARPAAGFVAGLGKVRPYSVYLFSFSMFFNGLADLAGSTAGDYGGLVVFCIFFGISYGMVGALQFEVLMAIVGTHKFSSAIGLVLLMEAVAVLVGPPSGGKLLDATHVYMYVFILAGAEVLTSSLILLLGNFFCIRKKPKEPQPEVAAAEEEKLHKPPADSGVDLREVEHFLKAEPEKNGEVVHTPETSV

SEQ ID NO: 4017 - protein, 487 aa, unidentified
MLKREGKVQPYTKTLDGGWGWMIVIHFFLVNVFVMGMTKTFAIFFVVFQEEFEGTSEQIGWIGSIMSSLRFCAGPLVAIICDILGEKTTSILGAFVVTGGYLISSWATSIPFLCVTMGLLPGLGSAFLYQVAAVVTTKYFKKRLALSTAIARSGMGLTFLLAPFTKFLIDLYDWTGALILFGAIALNLVPSSMLLRPIHIKSENNSGIKDKGSSLSAHGPEAHATETHCHETEESTIKDSTTQKAGLPSKNLTVSQNQSEEFYNGPNRNRLLLKSDEESDKVISWSCKQLFDISLFRNPFFYIFTWSFLLSQLAYFIPTFHLVARAKTLGIDIMDASYLVSVAGILETVSQIISGWVADQNWIKKYHYHKSYLILCGITNLLAPLATTFPLLMTYTICFAIFAGGYLALILPVLVDLCRNSTVNRFLGLASFFAGMAVLSGPPIAGWLYDYTQTYNGSFYFSGICYLLSSVSFFFVPLAERWKNSLT

SEQ ID NO: 4018 - protein, 505 aa, unidentified
MPQALERADGSWAWVVLLATMVTQGLTLGFPTCIGIFFTELQWEFQASNSETSWFPSILTAVLHMAGPLCSILVGRFGCRVTVMLGGVLASLGMVASSFSHNLSQLYFTAGFITGLGMCFSFQSSITVLGFYFVRRRVLANALASMGVSLGITLWPLLSRYLLENLGWRGTFLVFGGIFLHCCICGAIIRPVATSVAPETKECPPPPPETPALGCLAACGRTIQRHLAFDILRHNTGYCVYILGVMWSVLGFPLPQVFLVPYAMWHSVDEQQAALLISIIGFSNIFLRPLAGLMAGRPAFASHRKYLFSLALLLNGLTNLVCAASGDFWVLVGYCLAYSVSMSGIGALIFQVLMDIVPMDQFPRALGLFTVLDGLAFLISPPLAGLLLDATNNFSYVFYMSSFFLISAALFMGGSFYALQKKEQGKQAVAADALERDLFLEAKDGPGKQRSPEIMCQSSRQPRPAGVNKHLWGCPASSRTSHEWLLWPKAVLQAKQTALGWNSPT

SEQ ID NO: 4019 - protein, 523 aa, unidentified
MTQNKLKLCSKANVYTEVPDGGWGWAVAVSFFFVEVFTYGIIKTFGVFFNDLMDSFNESNSRISWIISICVFVLTFSAPLATVLSNRFGHRLVVMLGGLLVSTGMVAASFSQEVSHMYVAIGIISGLGYCFSFLPTVTILSQYFGKRRSIVTAVASTGECFAVFAFAPAIMALKERIGWRYSLLFVGLLQLNIVIFGALLRPIFIRGPASPKIVIQENRKEAQYMLENEKTRTSIDSIDSGVELTTSPKNVPTHTNLELEPKADMQQVLVKTSPRPSEKKAPLLDFSILKEKSFICYALFGLFATLGFFAPSLYIIPLGISLGIDQDRAAFLLSTMAIAEVFGRIGAGFVLNREPIRKIYIELICVILLTVSLFAFTFATEFWGLMSCSIFFGFMVGTIGGTHIPLLAEDDVVGIEKMSSAAGVYIFIQSIAGLAGPPLAGLLVDQSKIYSRAFYSCAAGMALAAVCLALVRPCKMGLCQHHHSGETKVVSHRGKTLQDIPEDFLEMDLAKNEHRVHVQMEPV

SEQ ID NO: 4020 - protein, 478 aa, unidentified
MPPMPSAPPVHPPPDGGWGWIVVGAAFISIGFSYAFPKAVTVFFKEIQQIFHTTYSEIAWISSIMLAVMYAGGPVSSVLVNKYGSRPVVIAGGLLCCLGMVLASFSSSVVQLYLTMGFITGLGLAFNLQPALTIIGKYFYRKRPMANGLAMAGSPVFLSSLAPFNQYLFNTFGWKGSFLILGSLLLNACVAGSLMRPLGPNQTTSKSKNKTGKTEDDSSPKKIKTKKSTWEKVNKYLDFSLFKHRGFLIYLSGNVIMFLGFFAPIIFLAPYAKDQGIDEYSAAFLLSVMAFVDMFARPSVGLIANSKYIRPRIQYFFSFAIMFNGVCHLLCPLAQDYTSLVLYAVFFGLGFGSVSSVLFETLMDLVGAPRFSSAVGLVTIVECGPVLLGPPLAGKLVDLTGEYKYMYMSCGAIVVAASVWLLIGNAINYRLLAKERKEENARQKTRESEPLSKSKHSEDVNVKVSNAQSVTSERETNI

SEQ ID NO: 4021 - protein, 504 aa, unidentified
MGAGGPRRGEGPPDGGWGWVVLGACFVVTGFAYGFPKAVSVFFRALMRDFDAGYSDTAWVSSIMLAMLYGTGPVSSILVTRFGCRPVMLAGGLLASAGMILASFATRLLELYLTAGVLTGLGLALNFQPSLIMLGLYFERRRPLANGLAAAGSPVFLSALSPLGQQLLERFGWRGGFLLLGGLLLHCCACGAVMRPPPGPGPRPRRDSAGDRAGDAPGEAEADGAGLQLREASPRVRPRRRLLDLAVCTDRAFAVYAVTKFLMALGLFVPAILLVNYAKDAGVPDTDAAFLLSIVGFVDIVARPACGALAGLARLRPHVPYLFSLALLANGLTDLSSARARSYGALVAFCVAFGLSYGMVGALQFEVLMAAVGAPRFPSALGLVLLVEAAAVLIGPPSAGRLVDVLKNYEIIFYLAGSEVALAGVFMAVATNCCLRCAKAAPSGPGTEGGASDTEDAEAEGDSEPLPVVAEEPGNLEALEVLSARGEPTEPEIEARPRLAAESV

SEQ ID NO: 4022 - protein, 509 aa, unidentified
MELKKSPDGGWGWVIVFVSFLTQFLCYGSPLAVGVLYIEWLDAFGEGKGKTAWVGSLASGVGLLASPVCSLCVSSFGARPVTIFSGFMVAGGLMLSSFAPNIYFLFFSYGIVVGLGCGLLYTATVTITCQYFDDRRGLALGLISTGSSVGLFIYAALQRMLVEFYGLDGCLLIVGALALNILACGSLMRPLQSSDCPLPKKIAPEDLPDKYSIYNEKGKNLEENINILDKSYSSEEKCRITLANGDWKQDSLLHKNPTVTHTKEPETYKKKVAEQTYFCKQLAKRKWQLYKNYCGETVALFKNKVFSALFIAILLFDIGGFPPSLLMEDVARSSNVKEEEFIMPLISIIGIMTAVGKLLLGILADFKWINTLYLYVATLIIMGLALCAIPFAKSYVTLALLSGILGFLTGNWSIFPYVTTKTVGIEKLAHAYGILMFFAGLGNSLGPPIVGWFYDWTQTYDIAFYFSGFCVLLGGFILLLAALPSWDTCNKQLPKPAPTTFLYKVASNV

SEQ ID NO: 4023 - protein, 467 aa, unidentified
MQMDNRLPPKKVPGFCSFRYGLSFLVHCCNVIITAQRACLNLTMVVMVNSTDPHGLPNTSTKKLLDNIKNPMYNWSPDIQGIILSSTSYGVIIIQVPVGYFSGIYSTKKMIGFALCLSSVLSLLIPPAAGIGVAWVVVCRAVQGAAQGIVATAQFEIYVKWAPPLERGRLTSMSTSGFLLGPFIVLLVTGVICESLGWPMVFYIFGACGCAVCLLWFVLFYDDPKDHPCISISEKEYITSSLVQQVSSSRQSLPIKAILKSLPVWAISTGSFTFFWSHNIMTLYTPMFINSMLHVNIKENGFLSSLPYLFAWICGNLAGQLSDFFLTRNILSVIAVRKLFTAAGFLLPAIFGVCLPYLSSTFYSIVIFLILAGATGSFCLGGVFINGLDIAPRYFGFIKACSTLTGMIGGLIASTLTGLILKQDPESAWFKTFILMAAINVTGLIFYLIVATAEIQDWAKEKQHTRL

SEQ ID NO: 4024 - protein, 439 aa, unidentified
MDGKPATRKGPDFCSLRYGLALIMHFSNFTMITQRVSLSIAIIAMVNTTQQQGLSNASTEGPVADAFNNSSISIKEFDTKASVYQWSPETQGIIFSSINYGIILTLIPSGYLAGIFGAKKMLGAGLLISSLLTLFTPLAADFGVILVIMVRTVQGMAQGMAWTGQFTIWAKWAPPLERSKLTTIAGSGSAFGSFIILCVGGLISQALSWPFIFYIFGSTGCVCCLLWFTVIYDDPMHHPCISVREKEHILSSLAQQPSSPGRAVPIKAMVTCLPLWAIFLGFFSHFWLCTIILTYLPTYISTLLHVNIRDSGVLSSLPFIAAASCTILGGQLADFLLSRNLLRLITVRKLFSSLGLLLPSICAVALPFVASSYVITIILLILIPGTSNLCDSGFIINTLDIAPRYASFLMGISRGFGLIAGIISSTATGFLISQVGPVY

SEQ ID NO: 4025 - protein, 420 aa, unidentified
MATKTELSPTARESKNAQDMQVDETLIPRKVPSLCSARYGIALVLHFCNFTTIAQNVIMNITMVAMVNSTSPQSQLNDSSEVLPVDSFGGLSKAPKSLPAKSSILGGQFAIWEKWGPPQERSRLCSIALSGMLLGCFTAILIGGFISETLGWPFVFYIFGGVGCVCCLLWFVVIYDDPVSYPWISTSEKEYIISSLKQQVGSSKQPLPIKAMLRSLPIWSICLGCFSHQWLVSTMVVYIPTYISSVYHVNIRDNGLLSALPFIVAWVIGMVGGYLADFLLTKKFRLITVRKIATILGSLPSSALIVSLPYLNSGYITATALLTLSCGLSTLCQSGIYINVLDIAPRYSSFLMGASRGFSSIAPVIVPTVSGFLLSQDPEFGWRNVFFLLFAVNLLGLLFYLIFGEADVQEWAKERKLTRL

SEQ ID NO: 4026 - protein, 497 aa, unidentified
MSTGPDVKATVGDISSDGNLNVAQEECSRKGFCSVRHGLALILQLCNFSIYTQQMNLSIAIPAMVNNTAPPSQPNASTERPSTDSQGYWNETLKEFKAMAPAYDWSPEIQGIILSSLNYGSFLAPIPSGYVAGIFGAKYVVGAGLFISSFLTLFIPLAANAGVALLIVLRIVQGIAQVMVLTGQYSIWVKWAPPLERSQLTTIAGSGSMLGSFIVLLAGGLLCQTIGWPYVFYIFGGIGCACCPLWFPLIYDDPVNHPFISAGEKRYIVCSLAQQDCSPGWSLPIRAMIKSLPLWAILVSYFCEYWLFYTIMAYTPTYISSVLQANLRDSGILSALPFVVGCICIILGGLLADFLLSRKILRLITIRKLFTAIGVLFPSVILVSLPWVRSSHSMTMTFLVLSSAISSFCESGALVNFLDIAPRYTGFLKGLLQVFAHIAGAISPTAAGFFISQDSEFGWRNVFLLSAAVNISGLVFYLIFGRADVQDWAKEQTFTHL

SEQ ID NO: 4027 - protein, 495 aa, unidentified
MRSPVRDLARNDGEESTDRTPLLPGAPRAEAAPVCCSARYNLAILAFFGFFIVYALRVNLSVALVDMVDSNTTLEDNRTSKACPEHSAPIKVHHNQTGKKYQWDAETQGWILGSFFYGYIITQIPGGYVASKIGGKMLLGFGILGTAVLTLFTPIAADLGVGPLIVLRALEGLGEGVTFPAMHAMWSSWAPPLERSKLLSISYAGAQLGTVISLPLSGIICYYMNWTYVFYFFGTIGIFWFLLWIWLVSDTPQKHKRISHYEKEYILSSLRNQLSSQKSVPWVPILKSLPLWAIVVAHFSYNWTFYTLLTLLPTYMKEILRFNVQENGFLSSLPYLGSWLCMILSGQAADNLRAKWNFSTLCVRRIFSLIGMIGPAVFLVAAGFIGCDYSLAVAFLTISTTLGGFCSSGFSINHLDIAPSYAGILLGITNTFATIPGMVGPVIAKSLTPDNTVGEWQTVFYIAAAINVFGAIFFTLFAKGEVQNWALNDHHGHRH

SEQ ID NO: 4028 - protein, 582 aa, unidentified
MESVKQRILAPGKEGLKNFAGKSLGQIYRVLEKKQDTGETIELTEDGKPLEVPERKAPLCDCTCFGLPRRYIIAIMSGLGFCISFGIRCNLGVAIVDMVNNSTIHRGGKVIKEKAKFNWDPETVGMIHGSFFWGYIITQIPGGYIASRLAANRVFGAAILLTSTLNMLIPSAARVHYGCVIFVRILQGLVEGVTYPACHGIWSKWAPPLERSRLATTSFCGSYAGAVIAMPLAGILVQYTGWSSVFYVYGSFGMVWYMFWLLVSYESPAKHPTITDEERRYIEESIGESANLLGAMEKFKTPWRKFFTSMPVYAIIVANFCRSWTFYLLLISQPAYFEEVFGFEISKVGMLSAVPHLVMTIIVPIGGQIADFLRSKQILSTTTVRKIMNCGGFGMEATLLLVVGYSHTRGVAISFLVLAVGFSGFAISGFNVNHLDIAPRYASILMGISNGVGTLSGMVCPIIVGAMTKNKSREEWQYVFLIAALVHYGGVIFYAIFASGEKQPWADPEETSEEKCGFIHEDELDEETGDITQNYINYGTTKSYGATTQANGGWPSGWEKKEEFVQGEVQDSHSYKDRVDYS

SEQ ID NO: 4029 - protein, 560 aa, unidentified
MEFRQEEFRKLAGRALGKLHRLLEKRQEGAETLELSADGRPVTTQTRDPPVVDCTCFGLPRRYIIAIMSGLGFCISFGIRCNLGVAIVSMVNNSTTHRGGHVVVQKAQFSWDPETVGLIHGSFFWGYIVTQIPGGFICQKFAANRVFGFAIVATSTLNMLIPSAARVHYGCVIFVRILQGLVEGVTYPACHGIWSKWAPPLERSRLATTAFCGSYAGAVVAMPLAGVLVQYSGWSSVFYVYGSFGIFWYLFWLLVSYESPALHPSISEEERKYIEDAIGESAKLMNPLTKFSTPWRRFFTSMPVYAIIVANFCRSWTFYLLLISQPAYFEEVFGFEISKVGLVSALPHLVMTIIVPIGGQIADFLRSRRIMSTTNVRKLMNCGGFGMEATLLLVVGYSHSKGVAISFLVLAVGFSGFAISGFNVNHLDIAPRYASILMGISNGVGTLSGMVCPIIVGAMTKHKTREEWQYVFLIASLVHYGGVIFYGVFASGEKQPWAEPEEMSEEKCGFVGHDQLAGSDDSEMEDEAEPPGAPPAPPPSYGATHSTFQPPRPPPPVRDY

SEQ ID NO: 4030 - protein, 589 aa, unidentified
MPFKAFDTFKEKILKPGKEGVKNAVGDSLGILQRKIDGTTEEEDNIELNEEGRPVQTSRPSPPLCDCHCCGLPKRYIIAIMSGLGFCISFGIRCNLGVAIVEMVNNSTVYVDGKPEIQTAQFNWDPETVGLIHGSFFWGYIMTQIPGGFISNKFAANRVFGAAIFLTSTLNMFIPSAARVHYGCVMCVRILQGLVEGVTYPACHGMWSKWAPPLERSRLATTSFCGSYAGAVVAMPLAGVLVQYIGWSSVFYIYGMFGIIWYMFWLLQAYECPAAHPTISNEEKTYIETSIGEGANVVSLSKFSTPWKRFFTSLPVYAIIVANFCRSWTFYLLLISQPAYFEEVFGFAISKVGLLSAVPHMVMTIVVPIGGQLADYLRSRQILTTTAVRKIMNCGGFGMEATLLLVVGFSHTKGVAISFLVLAVGFSGFAISGFNVNHLDIAPRYASILMGISNGVGTLSGMVCPLIVGAMTRHKTREEWQNVFLIAALVHYSGVIFYGVFASGEKQEWADPENLSEEKCGIIDQDELAEEIELNHESFASPKKKMSYGATSQNCEVQKKEWKGQRGATLDEEELTSYQNEERNFSTIS

SEQ ID NO: 4031 - protein, 436 aa, unidentified
MQPPPDEARRDMAGDTQWSRPECQAWTGTLLLGTCLLYCARSSMPICTVSMSQDFGWNKKEAGIVLSSFFWGYCLTQVVGGHLGDRIGGEKVILLSASAWGSITAVTPLLAHLSSAHLAFMTFSRILMGLLQGVYFPALTSLLSQKVRESERAFTYSIVGAGSQFGTLLTGAVGSLLLEWYGWQSIFYFSGGLTLLWVWYVYRYLLSEKDLILALGVLAQSRPVSRHNRVPWRRLFRKPAVWAAVVSQLSAACSFFILLSWLPTFFEETFPDAKGWIFNVVPWLVAIPASLFSGFLSDHLINQGYRAITVRKLMQGMGLGLSSVFALCLGHTSSFCESVVFASASIGLQTFNHSGISVNIQDLAPSCAGFLFGVANTAGALAGVVGVCLGGYLMETTGSWTCLFNLVAIISNLGLCTFLVFGQAQRVDLSSTHEDL

SEQ ID NO: 4032 - protein, 525 aa, unidentified
MLRTILDAPQRLLKEGRASRQLVLVVVFVALLLDNMLFTVVVPIVPTFLYDMEFKEVNSSLHLGHAGSSPHALASPAFSTIFSFFNNNTVAVEESVPSGIAWMNDTASTIPPPATEAISAHKNNCLQGTGFLEEEITRVGVLFASKAVMQLLVNPFVGPLTNRIGYHIPMFAGFVIMFLSTVMFAFSGTYTLLFVARTLQGIGSSFSSVAGLGMLASVYTDDHERGRAMGTALGGLALGLLVGAPFGSVMYEFVGKSAPFLILAFLALLDGALQLCILQPSKVSPESAKGTPLFMLLKDPYILVAAGSICFANMGVAILEPTLPIWMMQTMCSPKWQLGLAFLPASVSYLIGTNLFGVLANKMGRWLCSLIGMLVVGTSLLCVPLAHNIFGLIGPNAGLGLAIGMVDSSMMPIMGHLVDLRHTSVYGSVYAIADVAFCMGFAIGPSTGGAIVKAIGFPWLMVITGVINIVYAPLCYYLRSPPAKEEKLAILSQDCPMETRMYATQKPTKEFPLGEDSDEEPDHEE

SEQ ID NO: 4033 - protein, 514 aa, unidentified
MALSELALVRWLQESRRSRKLILFIVFLALLLDNMLLTVVVPIIPSYLYSIKHEKNATEIQTARPVHTASISDSFQSIFSYYDNSTMVTGNATRDLTLHQTATQHMVTNASAVPSDCPSEDKDLLNENVQVGLLFASKATVQLITNPFIGLLTNRIGYPIPIFAGFCIMFVSTIMFAFSSSYAFLLIARSLQGIGSSCSSVAGMGMLASVYTDDEERGNVMGIALGGLAMGVLVGPPFGSVLYEFVGKTAPFLVLAALVLLDGAIQLFVLQPSRVQPESQKGTPLTTLLKDPYILIAAGSICFANMGIAMLEPALPIWMMETMCSRKWQLGVAFLPASISYLIGTNIFGILAHKMGRWLCALLGMIIVGVSILCIPFAKNIYGLIAPNFGVGFAIGMVDSSMMPIMGYLVDLRHVSVYGSVYAIADVAFCMGYAIGPSAGGAIAKAIGFPWLMTIIGIIDILFAPLCFFLRSPPAKEEKMAILMDHNCPIKTKMYTQNNIQSYPIGEDEESESD

SEQ ID NO: 4034 - protein, 532 aa, unidentified
MESAEPAGQARAAATKLSEAVGAALQEPRRQRRLVLVIVCVALLLDNMLYMVIVPIVPDYIAHMRGGGEGPTRTPEVWEPTLPLPTPANASAYTANTSASPTAAWPAGSALRPRYPTESEDVKIGVLFASKAILQLLVNPLSGPFIDRMSYDVPLLIGLGVMFASTVLFAFAEDYATLFAARSLQGLGSAFADTSGIAMIADKYPEEPERSRALGVALAFISFGSLVAPPFGGILYEFAGKRVPFLVLAAVSLFDALLLLAVAKPFSAAARARANLPVGTPIHRLMLDPYIAVVAGALTTCNIPLAFLEPTIATWMKHTMAASEWEMGMAWLPAFVPHVLGVYLTVRLAARYPHLQWLYGALGLAVIGASSCIVPACRSFAPLVVSLCGLCFGIALVDTALLPTLAFLVDVRHVSVYGSVYAIADISYSVAYALGPIVAGHIVHSLGFEQLSLGMGLANLLYAPVLLLLRNVGLLTRSRSERDVLLDEPPQGLYDAVRLRERPVSGQDGEPRSPPGPFDACEDDYNYYYTRS

SEQ ID NO: 4035 - protein, 456 aa, unidentified
MEALGDLEGPRAPGGDDPAGSAGETPGWLSREQVFVLISAASVNLGSMMCYSILGPFFPKEAEKKGASNTIIGMIFGCFALFELLASLVFGNYLVHIGAKFMFVAGMFVSGGVTILFGVLDRVPDGPVFIAMCFLVRVMDAVSFAAAMTASSSILAKAFPNNVATVLGSLETFSGLGLILGPPVGGFLYQSFGYEVPFIVLGCVVLLMVPLNMYILPNYESDPGEHSFWKLIALPKVGLIAFVINSLSSCFGFLDPTLSLFVLEKFNLPAGYVGLVFLGMALSYAISSPLFGLLSDKRPPLRKWLLVFGNLITAGCYMLLGPVPILHIKSQLWLLVLILVVSGLSAGMSIIPTFPEILSCAHENGFEEGLSTLGLVSGLFSAMWSIGAFMGPTLGGFLYEKIGFEWAAAIQGLWALISGLAMGLFYLLEYSRRKRSKSQNILSTEEERTTLLPNET

SEQ ID NO: 4036 - protein, 591 aa, unidentified
MVPSSPAVEKQVPVEPGPDPELRSWRHLVCYLCFYGFMAQIRPGESFITPYLLGPDKNFTREQVTNEITPVLSYSYLAVLVPVFLLTDYLRYTPVLLLQGLSFVSVWLLLLLGHSVAHMQLMELFYSVTMAARIAYSSYIFSLVRPARYQRVAGYSRAAVLLGVFTSSVLGQLLVTVGRVSFSTLNYISLAFLTFSVVLALFLKRPKRSLFFNRDDRGRCETSASELERMNPGPGGKLGHALRVACGDSVLARMLRELGDSLRRPQLRLWSLWWVFNSAGYYLVVYYVHILWNEVDPTTNSARVYNGAADAASTLLGAITSFAAGFVKIRWARWSKLLIAGVTATQAGLVFLLAHTRHPSSIWLCYAAFVLFRGSYQFLVPIATFQIASSLSKELCALVFGVNTFFATIVKTIITFIVSDVRGLGLPVRKQFQLYSVYFLILSIIYFLGAMLDGLRHCQRGHHPRQPPAQGLRSAAEEKAAQALSVQDKGLGGLQPAQSPPLSPEDSLGAVGPASLEQRQSDPYLAQAPAPQAAEFLSPVTTPSPCTLCSAQASGPEAADETCPQLAVHPPGVSKLGLQCLPSDGVQNVNQ

SEQ ID NO: 4037 - protein, 497 aa, unidentified
MDVPGPVSRRAAAAAATVLLRTARVRRECWFLPTALLCAYGFFASLRPSEPFLTPYLLGPDKNLTEREVFNEIYPVWTYSYLVLLFPVFLATDYLRYKPVVLLQGLSLIVTWFMLLYAQGLLAIQFLEFFYGIATATEIAYYSYIYSVVDLGMYQKVTSYCRSATLVGFTVGSVLGQILVSVAGWSLFSLNVISLTCVSVAFAVAWFLPMPQKSLFFHHIPSTCQRVNGIKVQNGGIVTDTPASNHLPGWEDIESKIPLNMEEPPVEEPEPKPDRLLVLKVLWNDFLMCYSSRPLLCWSVWWALSTCGYFQVVNYTQGLWEKVMPSRYAAIYNGGVEAVSTLLGAVAVFAVGYIKISWSTWGEMTLSLFSLLIAAAVYIMDTVGNIWVCYASYVVFRIIYMLLITIATFQIAANLSMERYALVFGVNTFIALALQTLLTLIVVDASGLGLEITTQFLIYASYFALIAVVFLASGAVSVMKKCRKLEDPQSSSQVTTS

SEQ ID NO: 4038 - protein, 496 aa, unidentified
MDCYRTSLSSSWIYPTVILCLFGFFSMMRPSEPFLIPYLSGPDKNLTSAEITNEIFPVWTYSYLVLLLPVFVLTDYVRYKPVIILQGISFIITWLLLLFGQGVKTMQVVEFFYGMVTAAEVAYYAYIYSVVSPEHYQRVSGYCRSVTLAAYTAGSVLAQLLVSLANMSYFYLNVISLASVSVAFLFSLFLPMPKKSMFFHAKPSREIKKSSSVNPVLEETHEGEAPGCEEQKPTSEILSTSGKLNKGQLNSLKPSNVTVDVFVQWFQDLKECYSSKRLFYWSLWWAFATAGFNQVLNYVQILWDYKAPSQDSSIYNGAVEAIATFGGAVAAFAVGYVKVNWDLLGELALVVFSVVNAGSLFLMHYTANIWACYAGYLIFKSSYMLLITIAVFQIAVNLNVERYALVFGINTFIALVIQTIMTVIVVDQRGLNLPVSIQFLVYGSYFAVIAGIFLMRSMYITYSTKSQKDVQSPAPSENPDVSHPEEESNIIMSTKL

SEQ ID NO: 4039 - protein, 524 aa, unidentified
MGKPARKGCEWKRFLKNNWVLLSTVAAVVLGITTGVLVREHSNLSTLEKFYFAFPGEILMRMLKLIILPLIISSMITGVAALDSNVSGKIGLRAVVYYFCTTLIAVILGIVLVVSIKPGVTQKVGEIARTGSTPEVSTVDAMLDLIRNMFPENLVQACFQQYKTKREEVKPPSDPEMNMTEESFTAVMTTAISKNKTKEYKIVGMYSDGINVLGLIVFCLVFGLVIGKMGEKGQILVDFFNALSDATMKIVQIIMCYMPLGILFLIAGKIIEVEDWEIFRKLGLYMATVLTGLAIHSIVILPLIYFIVVRKNPFRFAMGMAQALLTALMISSSSATLPVTFRCAEENNQVDKRITRFVLPVGATINMDGTALYEAVAAVFIAQLNDLDLGIGQIITISITATSASIGAAGVPQAGLVTMVIVLSAVGLPAEDVTLIIAVDWLLDRFRTMVNVLGDAFGTGIVEKLSKKELEQMDVSSEVNIVNPFALESTILDNEDSDTKKSYVNGGFAVDKSDTISFTQTSQF

SEQ ID NO: 4040 - protein, 574 aa, unidentified
MASTEGANNMPKQVEVRMHDSHLGSEEPKHRHLGLRLCDKLGKNLLLTLTVFGVILGAVCGGLLRLASPIHPDVVMLIAFPGDILMRMLKMLILPLIISSLITGLSGLDAKASGRLGTRAMVYYMSTTIIAAVLGVILVLAIHPGNPKLKKQLGPGKKNDEVSSLDAFLDLIRNLFPENLVQACFQQIQTVTKKVLVAPPPDEEANATSAVVSLLNETVTEVPEETKMVIKKGLEFKDGMNVLGLIGFFIAFGIAMGKMGDQAKLMVDFFNILNEIVMKLVIMIMWYSPLGIACLICGKIIAIKDLEVVARQLGMYMVTVIIGLIIHGGIFLPLIYFVVTRKNPFSFFAGIFQAWITALGTASSAGTLPVTFRCLEENLGIDKRVTRFVLPVGATINMDGTALYEAVAAIFIAQMNGVVLDGGQIVTVSLTATLASVGAASIPSAGLVTMLLILTAVGLPTEDISLLVAVDWLLDRMRTSVNVVGDSFGAGIVYHLSKSELDTIDSQHRVHEDIEMTKTQSIYDDMKNHRESNSNQCVYAAHNSVIVDECKVTLAANGKSADCSVEEEPWKREK

SEQ ID NO: 4041 - protein, 542 aa, unidentified
MTKSNGEEPKMGGRMERFQQGVRKRTLLAKKKVQNITKEDVKSYLFRNAFVLLTVTAVIVGTILGFTLRPYRMSYREVKYFSFPGELLMRMLQMLVLPLIISSLVTGMAALDSKASGKMGMRAVVYYMTTTIIAVVIGIIIVIIIHPGKGTKENMHREGKIVRVTAADAFLDLIRNMFPPNLVEACFKQFKTNYEKRSFKVPIQANETLVGAVINNVSEAMETLTRITEELVPVPGSVNGVNALGLVVFSMCFGFVIGNMKEQGQALREFFDSLNEAIMRLVAVIMWYAPVGILFLIAGKIVEMEDMGVIGGQLAMYTVTVIVGLLIHAVIVLPLLYFLVTRKNPWVFIGGLLQALITALGTSSSSATLPITFKCLEENNGVDKRVTRFVLPVGATINMDGTALYEALAAIFIAQVNNFELNFGQIITISITATAASIGAAGIPQAGLVTMVIVLTSVGLPTDDITLIIAVDWFLDRLRTTTNVLGDSLGAGIVEHLSRHELKNRDVEMGNSVIEENEMKKPYQLIAQDNETEKPIDSETKM

SEQ ID NO: 4042 - protein, 532 aa, unidentified
MEKSNETNGYLDSAQAGPAAGPGAPGTAAGRARRCAGFLRRQALVLLTVSGVLAGAGLGAALRGLSLSRTQVTYLAFPGEMLLRMLRMIILPLVVCSLVSGAASLDASCLGRLGGIAVAYFGLTTLSASALAVALAFIIKPGSGAQTLQSSDLGLEDSGPPPVPKETVDSFLDLARNLFPSNLVVAAFRTYATDYKVVTQNSSSGNVTHEKIPIGTEIEGMNILGLVLFALVLGVALKKLGSEGEDLIRFFNSLNEATMVLVSWIMWYVPVGIMFLVGSKIVEMKDIIVLVTSLGKYIFASILGHVIHGGIVLPLIYFVFTRKNPFRFLLGLLAPFATAFATCSSSATLPSMMKCIEENNGVDKRISRFILPIGATVNMDGAAIFQCVAAVFIAQLNNVELNAGQIFTILVTATASSVGAAGVPAGGVLTIAIILEAIGLPTHDLPLILAVDWIVDRTTTVVNVEGDALGAGILHHLNQKATKKGEQELAEVKVEAIPNCKSEEETSPLVTHQNPAGPVASAPELESKESVL

SEQ ID NO: 4043 - protein, 541 aa, unidentified
MVADPPRDSKGLAAAEPTANGGLALASIEDQGAAAGGYCGSRDQVRRCLRANLLVLLTVVAVVAGVALGLGVSGAGGALALGPERLSAFVFPGELLLRLLRMIILPLVVCSLIGGAASLDPGALGRLGAWALLFFLVTTLLASALGVGLALALQPGAASAAINASVGAAGSAENAPSKEVLDSFLDLARNIFPSNLVSAAFRSYSTTYEERNITGTRVKVPVGQEVEGMNILGLVVFAIVFGVALRKLGPEGELLIRFFNSFNEATMVLVSWIMWYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVDRSCTVLNVEGDALGAGLLQNYVDRTESRSTEPELIQVKSELPLDPLPVPTEEGNPLLKHYRGPAGDATVASEKESVM

SEQ ID NO: 4044 - protein, 564 aa, unidentified
MSSHGNSLFLRESGQRLGRVGWLQRLQESLQQRALRTRLRLQTMTLEHVLRFLRRNAFILLTVSAVVIGVSLAFALRPYQLTYRQIKYFSFPGELLMRMLQMLVLPLIVSSLVTGMASLDNKATGRMGMRAAVYYMVTTIIAVFIGILMVTIIHPGKGSKEGLHREGRIETIPTADAFMDLIRNMFPPNLVEACFKQFKTQYSTRVVTRTMVRTENGSEPGASMPPPFSVENGTSFLENVTRALGTLQEMLSFEETVPVPGSANGINALGLVVFSVAFGLVIGGMKHKGRVLRDFFDSLNEAIMRLVGIIIWYAPVGILFLIAGKILEMEDMAVLGGQLGMYTLTVIVGLFLHAGIVLPLIYFLVTHRNPFPFIGGMLQALITAMGTSSSSATLPITFRCLEEGLGVDRRITRFVLPVGATVNMDGTALYEALAAIFIAQVNNYELNLGQITTISITATAASVGAAGIPQAGLVTMVIVLTSVGLPTEDITLIIAVDWFLDRLRTMTNVLGDSIGAAVIEHLSQRELELQEAELTLPSLGKPYKSLMAQEKGASRGRGGNESAM

SEQ ID NO: 4045 - protein, 560 aa, unidentified
MVPHAILARGRDVCRRNGLLILSVLSVIVGCLLGFFLRTRRLSPQEISYFQFPGELLMRMLKMMILPLVVSSLMSGLASLDAKTSSRLGVLTVAYYLWTTFMAVIVGIFMVSIIHPGSAAQKETTEQSGKPIMSSADALLDLIRNMFPANLVEATFKQYRTKTTPVVKSPKVAPEEAPPRRILIYGVQEENGSHVQNFALDLTPPPEVVYKSEPGTSDGMNVLGIVFFSATMGIMLGRMGDSGAPLVSFCQCLNESVMKIVAVAVWYFPFGIVFLIAGKILEMDDPRAVGKKLGFYSVTVVCGLVLHGLFILPLLYFFITKKNPIVFIRGILQALLIALATSSSSATLPITFKCLLENNHIDRRIARFVLPVGATINMDGTALYEAVAAIFIAQVNNYELDFGQIITISITATAASIGAAGIPQAGLVTMVIVLTSVGLPTDDITLIIAVDWALDRFRTMINVLGDALAAGIMAHICRKDFARDTGTEKLLPCETKPVSLQEIVAAQQNGCVKSVAEASELTLGPTCPHHVPVQVEQDEELPAASLNHCTIQISELETNV

SEQ ID NO: 4046 - protein, 679 aa, unidentified
MATLITSTTAATAASGPLVDYLWMLILGFIIAFVLAFSVGANDVANSFGTAVGSGVVTLKQACILASIFETVGSVLLGAKVSETIRKGLIDVEMYNSTQGLLMAGSVSAMFGSAVWQLVASFLKLPISGTHCIVGATIGFSLVAKGQEGVKWSELIKIVMSWFVSPLLSGIMSGILFFLVRAFILHKADPVPNGLRALPVFYACTVGINLFSIMYTGAPLLGFDKLPLWGTILISVGCAVFCALIVWFFVCPRMKRKIEREIKCSPSESPLMEKKNSLKEDHEETKLSVGDIENKHPVSEVGPATVPLQAVVEERTVSFKLGDLEEAPERERLPSVDLKEETSIDSTVNGAVQLPNGNLVQFSQAVSNQINSSGHYQYHTVHKDSGLYKELLHKLHLAKVGDCMGDSGDKPLRRNNSYTSYTMAICGMPLDSFRAKEGEQKGEEMEKLTWPNADSKKRIRMDSYTSYCNAVSDLHSASEIDMSVKAEMGLGDRKGSNGSLEEWYDQDKPEVSLLFQFLQILTACFGSFAHGGNDVSNAIGPLVALYLVYDTGDVSSKVATPIWLLLYGGVGICVGLWVWGRRVIQTMGKDLTPITPSSGFSIELASALTVVIASNIGLPISTTHCKVGSVVSVGWLRSKKAVDWRLFRNIFMAWFVTVPISGVISAAIMAIFRYVILRM

SEQ ID NO: 4047 - protein, 652 aa, unidentified
MAMDEYLWMVILGFIIAFILAFSVGANDVANSFGTAVGSGVVTLRQACILASIFETTGSVLLGAKVGETIRKGIIDVNLYNETVETLMAGEVSAMVGSAVWQLIASFLRLPISGTHCIVGSTIGFSLVAIGTKGVQWMELVKIVASWFISPLLSGFMSGLLFVLIRIFILKKEDPVPNGLRALPVFYAATIAINVFSIMYTGAPVLGLVLPMWAIALISFGVALLFAFFVWLFVCPWMRRKITGKLQKEGALSRVSDESLSKVQEAESPVFKELPGAKANDDSTIPLTGAAGETLGTSEGTSAGSHPRAAYGRALSMTHGSVKSPISNGTFGFDGHTRSDGHVYHTVHKDSGLYKDLLHKIHIDRGPEEKPAQESNYRLLRRNNSYTCYTAAICGLPVHATFRAADSSAPEDSEKLVGDTVSYSKKRLRYDSYSSYCNAVAEAEIEAEEGGVEMKLASELADPDQPREDPAEEEKEEKDAPEVHLLFHFLQVLTACFGSFAHGGNDVSNAIGPLVALWLIYKQGGVTQEAATPVWLLFYGGVGICTGLWVWGRRVIQTMGKDLTPITPSSGFTIELASAFTVVIASNIGLPVSTTHCKVGSVVAVGWIRSRKAVDWRLFRNIFVAWFVTVPVAGLFSAAVMALLMYGILPYV

SEQ ID NO: 4048 - protein, 554 aa, unidentified
MPTVDDILEQVGESGWFQKQAFLILCLLSAAFAPICVGIVFLGFTPDHHCQSPGVAELSQRCGWSPAEELNYTVPGLGPAGEAFLGQCRRYEVDWNQSALSCVDPLASLATNRSHLPLGPCQDGWVYDTPGSSIVTEFNLVCADSWKLDLFQSCLNAGFLFGSLGVGYFADRFGRKLCLLGTVLVNAVSGVLMAFSPNYMSMLLFRLLQGLVSKGNWMAGYTLITEFVGSGSRRTVAIMYQMAFTVGLVALTGLAYALPHWRWLQLAVSLPTFLFLLYYWCVPESPRWLLSQKRNTEAIKIMDHIAQKNGKLPPADLKMLSLEEDVTEKLSPSFADLFRTPRLRKRTFILMYLWFTDSVLYQGLILHMGATSGNLYLDFLYSALVEIPGAFIALITIDRVGRIYPMAMSNLLAGAACLVMIFISPDLHWLNIIIMCVGRMGITIAIQMICLVNAELYPTFVRNLGVMVCSSLCDIGGIITPFIVFRLREVWQALPLILFAVLGLLAAGVTLLLPETKGVALPETMKDAENLGRKAKPKENTIYLKVQTSEPSGT

SEQ ID NO: 4049 - protein, 541 aa, unidentified
MAFEELLSQVGGLGRFQMLHLVFILPSLMLLIPHILLENFAAAIPGHRCWVHMLDNNTGSGNETGILSEDALLRISIPLDSNLRPEKCRRFVHPQWQLLHLNGTIHSTSEADTEPCVDGWVYDQSYFPSTIVTKWDLVCDYQSLKSVVQFLLLTGMLVGGIIGGHVSDRFGRRFILRWCLLQLAITDTCAAFAPTFPVYCVLRFLAGFSSMIIISNNSLPITEWIRPNSKALVVILSSGALSIGQIILGGLAYVFRDWQTLHVVASVPFFVFFLLSRWLVESARWLIITNKLDEGLKALRKVARTNGIKNAEETLNIEVVRSTMQEELDAAQTKTTVCDLFRNPSMRKRICILVFLRFANTIPFYGTMVNLQHVGSNIFLLQVLYGAVALIVRCLALLTLNHMGRRISQILFMFLVGLSILANTFVPKEMQTLRVALACLGIGCSAATFSSVAVHFIELIPTVLRARASGIDLTASRIGAALAPLLMTLTVFFTTLPWIIYGIFPIIGGLIVFLLPETKNLPLPDTIKDVENQKKNLKEKA

SEQ ID NO: 4050 - protein, 550 aa, unidentified
MAFSKLLEQAGGVGLFQTLQVLTFILPCLMIPSQMLLENFSAAIPGHRCWTHMLDNGSAVSTNMTPKALLTISIPPGPNQGPHQCRRFRQPQWQLLDPNATATSWSEADTEPCVDGWVYDRSVFTSTIVAKWDLVCSSQGLKPLSQSIFMSGILVGSFIWGLLSYRFGRKPMLSWCCLQLAVAGTSTIFAPTFVIYCGLRFVAAFGMAGIFLSSLTLMVEWTTTSRRAVTMTVVGCAFSAGQAALGGLAFALRDWRTLQLAASVPFFAISLISWWLPESARWLIIKGKPDQALQELRKVARINGHKEAKNLTIEVLMSSVKEEVASAKEPRSVLDLFCVPVLRWRSCAMLVVNFSLLISYYGLVFDLQSLGRDIFLLQALFGAVDFLGRATTALLLSFLGRRTIQAGSQAMAGLAILANMLVPQDLQTLRVVFAVLGKGCFGISLTCLTIYKAELFPTPVRMTADGILHTVGRLGAMMGPLILMSRQALPLLPPLLYGVISIASSLVVLFFLPETQGLPLPDTIQDLESQKSTAAQGNRQEAVTVESTSL

SEQ ID NO: 4051 - protein, 553 aa, unidentified
MAFSELLDLVGGLGRFQVLQTMALMVSIMWLCTQSMLENFSAAVPSHRCWAPLLDNSTAQASILGSLSPEALLAISIPPGPNQRPHQCRRFRQPQWQLLDPNATATSWSEADTEPCVDGWVYDRSIFTSTIVAKWNLVCDSHALKPMAQSIYLAGILVGAAACGPASDRFGRRLVLTWSYLQMAVMGTAAAFAPAFPVYCLFRFLLAFAVAGVMMNTGTLLMEWTAARARPLVMTLNSLGFSFGHGLTAAVAYGVRDWTLLQLVVSVPFFLCFLYSWWLAESARWLLTTGRLDWGLQELWRVAAINGKGAVQDTLTPEVLLSAMREELSMGQPPASLGTLLRMPGLRFRTCISTLCWFAFGFTFFGLALDLQALGSNIFLLQMFIGVVDIPAKMGALLLLSHLGRRPTLAASLLLAGLCILANTLVPHEMGALRSALAVLGLGGVGAAFTCITIYSSELFPTVLRMTAVGLGQMAARGGAILGPLVRLLGVHGPWLPLLVYGTVPVLSGLAALLLPETQSLPLPDTIQDVQNQAVKKATHGTLGNSVLKSTQF

SEQ ID NO: 4052 - protein, 551 aa, unidentified
MAQFVQVLAEIGDFGRFQIQLLILLCVLNFLSPFYFFAHVFMVLDEPHHCAVAWVKNHTFNLSAAEQLVLSVPLDTAGHPEPCLMFRPPPANASLQDILSHRFNETQPCDMGWEYPENRLPSLKNEFNLVCDRKHLKDTTQSVFMAGLLVGTLMFGPLCDRIGRKATILAQLLLFTLIGLATAFVPSFELYMALRFAVATAVAGLSFSNVTLLTEWVGPSWRTQAVVLAQCNFSLGQMVLAGLAYGFRNWRLLQITGTAPGLLLFFYFWALPESARWLLTRGRMDEAIQLIQKAASVNRRKLSPELMNQLVPEKTGPSGNALDLFRHPQLRKVTLIIFCVWFVDSLGYYGLSLQVGDFGLDVYLTQLIFGAVEVPARCSSIFMMQRFGRKWSQLGTLVLGGLMCIIIIFIPADLPVVVTMLAVVGKMATAAAFTISYVYSAELFPTILRQTGMGLVGIFSRIGGILTPLVILLGEYHAALPMLIYGSLPIVAGLLCTLLPETHGQGLKDTLQDLELGPHPRSPKSVPSEKETEAKGRTSSPGVAFVSSTYF

SEQ ID NO: 4053 - protein, 594 aa, unidentified
MAGEENFKEELRSQDASRNLNQHEVAGHPHSWSLEMLLRRLRAVHTKQDDKFANLLDAVGEFGTFQQRLVALTFIPSIMSAFFMFADHFVFTAQKPYCNTSWILAVGPHLSKAEQLNLTIPQAPNGSFLTCFMYLPVPWNLDSIIQFGLNDTDTCQDGWIYPDAKKRSLINEFDLVCGMETKKDTAQIMFMAGLPIGSLIFRLITDKMGRYPAILLSLLGLIIFGFGTAFMNSFHLYLFFRFGISQSVVGYAISSISLATEWLVGEHRAHAIILGHCFFAVGAVLLTGIAYSLPHWQLLFLVGGILVIPFISYIWILPESPRWLMMKGKVKEAKQVLCYAASVNKKTIPSNLLDELQLPRKKVTRASVLDFCKNRQLCKVTLVMSCVWFTVSYTYFTLSLRMRELGVSVHFRHVVPSIMEVPARLCCIFLLQQIGRKWSLAVTLLQAIIWCLLLLFLPEGEDGLRLKWPRCPATELKSMTILVLMLREFSLAATVTVFFLYTAELLPTVLRATGLGLVSLASVAGAILSLTIISQTPSLLPIFLCCVLAIVAFSLSSLLPETRDQPLSESLNHSSQIRNKVKDMKTKETSSDDV

SEQ ID NO: 4054 - protein, 547 aa, unidentified
MEVEEAFQAVGEMGIYQMYLCFLLAVLLQLYVATEAILIALVGATPSYHWDLAELLPNQSHGNQSAGEDQAFGDWLLTANGSEIHKHVHFSSSFTSIASEWFLIANRSYKVSAASSFFFSGVFVGVISFGQLSDRFGRKKVYLTGFALDILFAIANGFSPSYEFFAVTRFLVGMMNGGMSLVAFVLLNECVGTAYWALAGSIGGLFFAVGIAQYALLGYFIRSWRTLAILVNLQGTVVFLLSLFIPESPRWLYSQGRLSEAEEALYLIAKRNRKLKCTFSLTHPANRSCRETGSFLDLFRYRVLLGHTLILMFIWFVCSLVYYGLTLSAGDLGGSIYANLALSGLIEIPSYPLCIYLINQKWFGRKRTLSAFLCLGGLACLIVMFLPEKKDTGVFAVVNSHSLSLLGKLTISAAFNIVYIYTSELYPTVIRNVGLGTCSMFSRVGGIIAPFIPSLKYVQWSLPFIVFGATGLTSGLLSLLLPETLNSPLLETFSDLQVYSYRRLGEEALSLQALDPQQCVDKESSLGSESEEEEEFYDADEETQMIK

SEQ ID NO: 4055 - protein, 577 aa, unidentified
MGSRHFEGIYDHVGHFGRFQRVLYFICAFQNISCGIHYLASVFMGVTPHHVCRPPGNVSQVVFHNHSNWSLEDTGALLSSGQKDYVTVQLQNGEIWELSRCSRNKRENTSSLGYEYTGSKKEFPCVDGYIYDQNTWKSTAVTQWNLVCDRKWLAMLIQPLFMFGVLLGSVTFGYFSDRLGRRVVLWATSSSMFLFGIAAAFAVDYYTFMAARFFLAMVASGYLVVGFVYVMEFIGMKSRTWASVHLHSFFAVGTLLVALTGYLVRTWWLYQMILSTVTVPFILCCWVLPETPFWLLSEGRYEEAQKIVDIMAKWNRASSCKLSELLSLDLQGPVSNSPTEVQKHNLSYLFYNWSITKRTLTVWLIWFTGSLGFYSFSLNSVNLGGNEYLNLFLLGVVEIPAYTFVCIAMDKVGRRTVLAYSLFCSALACGVVMVIPQKHYILGVVTAMVGKFAIGAAFGLIYLYTAELYPTIVRSLAVGSGSMVCRLASILAPFSVDLSSIWIFIPQLFVGTMALLSGVLTLKLPETLGKRLATTWEEAAKLESENESKSSKLLLTTNNSGLEKTEAITPRDSGLGE

SEQ ID NO: 4056 - protein, 538 aa, unidentified
MASDPIFTLAPPLHCHYGAFPPNASGWEQPPNASGVSVASAALAASAASRVATSTDPSCSGFAPPDFNHCLKDWDYNGLPVLTTNAIGQWDLVCDLGWQVILEQILFILGFASGYLFLGYPADRFGRRGIVLLTLGLVGPCGVGGAAAGSSTGVMALRFLLGFLLAGVDLGVYLMRLELCDPTQRLRVALAGELVGVGGHFLFLGLALVSKDWRFLQRMITAPCILFLFYGWPGLFLESARWLIVKRQIEEAQSVLRILAERNRPHGQMLGEEAQEALQDLENTCPLPATSSFSFASLLNYRNIWKNLLILGFTNFIAHAIRHCYQPVGGGGSPSDFYLCSLLASGTAALACVFLGVTVDRFGRRGILLLSMTLTGIASLVLLGLWDCEHPIFPTVWAQQGNPNRDLNEAAITTFSVLGLFSSQAAAILSTLLAAEVIPTTVRGRGLGLIMALGALGGLSGPAQRLHMGHGAFLQHVVLAACALLCILSIMLLPETKRKLLPEVLRDGELCRRPSLLRQPPPTRCDHVPLLATPNPAL

SEQ ID NO: 4057 - protein, 424 aa, unidentified
MQGARAPRDQGRSPGRMSALGRSSVILLTYVLAATELTCLFMQFSIVPYLSRKLGLDSIAFGYLQTTFGVLQLLGGPVFGRFADQRGARAALTLSFLAALALYLLLAAASSPALPGVYLLFASRLPGALMHTLPAAQMVITDLSAPEERPAALGRLGLCFGVGVILGSLLGGTLVSAYGIQCPAILAALATLLGAVLSFTCIPASTKGAKTDAQAPLPGGPRASVFDLKAIASLLRLPDVPRIFLVKVASNCPTGLFMVMFSIISMDFFQLEAAQAGYLMSFFGLLQMVTQGLVIGQLSSHFSEEVLLRASVLVFIVVGLAMAWMSSVFHFCLLVPGLVFSLCTLNVVTDSMLIKAVSTSDTGTMLGLCASVQPLLRTLGPTVGGLLYRSFGVPVFGHVQVAINTLVLLVLWRKPMPQRKDKVR

SEQ ID NO: 4058 - protein, 555 aa, unidentified
MPTTVDDVLEHGGEFHFFQKQMFFLLALLSATFAPIYVGIVFLGFTPDHRCRSPGVAELSLRCGWSPAEELNYTVPGPGPAGEASPRQCRRYEVDWNQSTFDCVDPLASLDTNRSRLPLGPCRDGWVYETPGSSIVTEFNLVCANSWMLDLFQSSVNVGFFIGSMSIGYIADRFGRKLCLLTTVLINAAAGVLMAISPTYTWMLIFRLIQGLVSKAGWLIGYILITEFVGRRYRRTVGIFYQVAYTVGLLVLAGVAYALPHWRWLQFTVSLPNFFFLLYYWCIPESPRWLISQNKNAEAMRIIKHIAKKNGKSLPASLQRLRLEEETGKKLNPSFLDLVRTPQIRKHTMILMYNWFTSSVLYQGLIMHMGLAGDNIYLDFFYSALVEFPAAFMIILTIDRIGRRYPWAASNMVAGAACLASVFIPGDLQWLKIIISCLGRMGITMAYEIVCLVNAELYPTFIRNLGVHICSSMCDIGGIITPFLVYRLTNIWLELPLMVFGVLGLVAGGLVLLLPETKGKALPETIEEAENMQRPRKNKEKMIYLQVQKLDIPLN

SEQ ID NO: 4059 - protein, 686 aa, unidentified
MAIDRRREAAGGGPGRQPAPAEENGSLPPGDAAASAPLGGRAGPGGGAEIQPLPPLHPGGGPHPSCCSAAAAPSLLLLDYDGSVLPFLGGLGGGYQKTLVLLTWIPALFIGFSQFSDSFLLDQPNFWCRGAGKGTELAGVTTTGRGGDMGNWTSLPTTPFATAPWEAAGNRSNSSGADGGDTPPLPSPPDKGDNASNCDCRAWDYGIRAGLVQNVVSKWDLVCDNAWKVHIAKFSLLVGLIFGYLITGCIADWVGRRPVLLFSIIFILIFGLTVALSVNVTMFSTLRFFEGFCLAGIILTLYALRIELCPPGKRFMITMVASFVAMAGQFLMPGLAALCRDWQVLQALIICPFLLMLLYWSIFPESLRWLMATQQFESAKRLILHFTQKNRMNPEGDIKGVIPELEKELSRRPKKVCIVKVVGTRNLWKNIVVLCVNSLTGYGIHHCFARSMMGHEVKVPLLENFYADYYTTASIALVSCLAMCVVVRFLGRRGGLLLFMILTALASLLQLGLLNLIGKYSQHPDSGMSDSVKDKFSIAFSIVGMFASHAVGSLSVFFCAEITPTVIRCGGLGLVLASAGFGMLTAPIIELHNQKGYFLHHIIFACCTLICIICILLLPESRDQNLPENISNGEHYTRQPLLPHKKGEQPLLLTNAELKDYSGLHDAAAAGDTLPEGATANGMKAM

SEQ ID NO: 4060 - protein, 547 aa, unidentified
MAFQDLLDQVGGLGRFQILQMVFLIMFNVIVYHQTQLENFAAFILDHRCWVHILDNDTIPDNDPGTLSQDALLRISIPFDSNLRPEKCRRFVHPQWKLIHLNGTFPNTSEPDTEPCVDGWVYDQSSFPSTIVTKWDLVCESQPLNSVAKFLFMAGMMVGGNLYGHLSDRFGRKFVLRWSYLQLAIVGTCAAFAPTILVYCSLRFLAGAATFSIIVNTVLLIVEWITHQFCAMALTLTLCAASIGHITLGSLAFVIRDQCILQLVMSAPCFVFFLFSRWLAESARWLIINNKPEEGLKELRKAAHRNGMKNAEDILTMEVLKSTMKQELEAAQKKHSLCELLRIPNICKRICFLSFVRFASTIPFWGLTLHLQHLGNNVFLLQTLFGAVTLLANCVAPWALNHMSRRLSQMLLMFLLATCLLAIIFVPQEMQTLRVVLATLGVGAASLGITCSTAQENELIPSIIRGRATGITGNFANIGGALASLMMILSIYSRPLPWIIYGVFAILSGLVVLLLPETRNQPLLDSIQDVENEGVNSLAAPQRSSVL

SEQ ID NO: 4061 - protein, 556 aa, unidentified
MPSFDEALQRVGEFGRFQRRVFLLLCLTGVTFAFLFVGVVFLGTQPDHYWCRGPSAAALAERCGWSPEEEWNRTAPASRGPEPPERRGRCQRYLLEAANDSASATSALSCADPLAAFPNRSAPLVPCRGGWRYAQAHSTIVSEFDLVCVNAWMLDLTQAILNLGFLTGAFTLGYAADRYGRIVIYLLSCLGVGVTGVVVAFAPNFPVFVIFRFLQGVFGKGTWMTCYVIVTEIVGSKQRRIVGIVIQMFFTLGIIILPGIAYFIPNWQGIQLAITLPSFLFLLYYWVVPESPRWLITRKKGDKALQILRRIAKCNGKYLSSNYSEITVTDEEVSNPSFLDLVRTPQMRKCTLILMFAWFTSAVVYQGLVMRLGIIGGNLYIDFFISGVVELPGALLILLTIERLGRRLPFAASNIVAGVACLVTAFLPEGIAWLRTTVATLGRLGITMAFEIVYLVNSELYPTTLRNFGVSLCSGLCDFGGIIAPFLLFRLAAVWLELPLIIFGILASICGGLVMLLPETKGIALPETVDDVEKLGSPHSCKCGRNKKTPVSRSHL

SEQ ID NO: 4062 - protein, 551 aa, unidentified
MRDYDEVIAFLGEWGPFQRLIFFLLSASIIPNGFNGMSVVFLAGTPEHRCRVPDAANLSSAWRNNSVPLRLRDGREVPHSCSRYRLATIANFSALGLEPGRDVDLGQLEQESCLDGWEFSQDVYLSTVVTEWNLVCEDNWKVPLTTSLFFVGVLLGSFVSGQLSDRFGRKNVLFATMAVQTGFSFLQIFSISWEMFTVLFVIVGMGQISNYVVAFILGTEILGKSVRIIFSTLGVCTFFAVGYMLLPLFAYFIRDWRMLLLALTVPGVLCVPLWWFIPESPRWLISQRRFREAEDIIQKAAKMNNIAVPAVIFDSVEELNPLKQQKAFILDLFRTRNIAIMTIMSLLLWMLTSVGYFALSLDAPNLHGDAYLNCFLSALIEIPAYITAWLLLRTLPRRYIIAAVLFWGGGVLLFIQLVPVDYYFLSIGLVMLGKFGITSAFSMLYVFTAELYPTLVRNMAVGVTSTASRVGSIIAPYFVYLGAYNRMLPYIVMGSLTVLIGILTLFFPESLGMTLPETLEQMQKVKWFRSGKKTRDSMETEENPKVLITAF

SEQ ID NO: 4063 - protein, 557 aa, unidentified
MRDYDEVTAFLGEWGPFQRLIFFLLSASIIPNGFTGLSSVFLIATPEHRCRVPDAANLSSAWRNHTVPLRLRDGREVPHSCRRYRLATIANFSALGLEPGRDVDLGQLEQESCLDGWEFSQDVYLSTIVTEWNLVCEDDWKAPLTISLFFVGVLLGSFISGQLSDRFGRKNVLFVTMGMQTGFSFLQIFSKNFEMFVVLFVLVGMGQISNYVAAFVLGTEILGKSVRIIFSTLGVCIFYAFGYMVLPLFAYFIRDWRMLLVALTMPGVLCVALWWFIPESPRWLISQGRFEEAEVIIRKAAKANGIVVPSTIFDPSELQDLSSKKQQSHNILDLLRTWNIRMVTIMSIMLWMTISVGYFGLSLDTPNLHGDIFVNCFLSAMVEVPAYVLAWLLLQYLPRRYSMATALFLGGSVLLFMQLVPPDLYYLATVLVMVGKFGVTAAFSMVYVYTAELYPTVVRNMGVGVSSTASRLGSILSPYFVYLGAYDRFLPYILMGSLTILTAILTLFLPESFGTPLPDTIDQMLRVKGMKHRKTPSHTRMLKDGQERPTILKSTAF

SEQ ID NO: 4064 - protein, 563 aa, unidentified
MAFNDLLQQVGGVGRFQQIQVTLVVLPLLLMASHNTLQNFTAAIPTHHCRPPADANLSKNGGLEVWLPRDRQGQPESCLRFTSPQWGLPFLNGTEANGTGATEPCTDGWIYDNSTFPSTIVTEWDLVCSHRALRQLAQSLYMVGVLLGAMVFGYLADRLGRRKVLILNYLQTAVSGTCAAFAPNFPIYCAFRLLSGMALAGISLNCMTLNVEWMPIHTRACVGTLIGYVYSLGQFLLAGVAYAVPHWRHLQLLVSAPFFAFFIYSWFFIESARWHSSSGRLDLTLRALQRVARINGKREEGAKLSMEVLRASLQKELTMGKGQASAMELLRCPTLRHLFLCLSMLWFATSFAYYGLVMDLQGFGVSIYLIQVIFGAVDLPAKLVGFLVINSLGRRPAQMAALLLAGICILLNGVIPQDQSIVRTSLAVLGKGCLAASFNCIFLYTGELYPTMIRQTGMGMGSTMARVGSIVSPLVSMTAELYPSMPLFIYGAVPVAASAVTVLLPETLGQPLPDTVQDLESRWAPTQKEAGIYPRKGKQTRQQQEHQKYMVPLQASAQEKNGL

SEQ ID NO: 4065 - protein, 548 aa, unidentified
MGFEELLEQVGGFGPFQLRNVALLALPRVLLPLHFLLPIFLAAVPAHRCALPGAPANFSHQDVWLEAHLPREPDGTLSSCLRFAYPQALPNTTLGEERQSRGELEDEPATVPCSQGWEYDHSEFSSTIATESQWDLVCEQKGLNRAASTFFFAGVLVGAVAFGYLSDRFGRRRLLLVAYVSTLVLGLASAASVSYVMFAITRTLTGSALAGFTIIVMPLELEWLDVEHRTVAGVLSSTFWTGGVMLLALVGYLIRDWRWLLLAVTLPCAPGILSLWWVPESARWLLTQGHVKEAHRYLLHCARLNGRPVCEDSFSQEAVSKVAAGERVVRRPSYLDLFRTPRLRHISLCCVVVWFGVNFSYYGLSLDVSGLGLNVYQTQLLFGAVELPSKLLVYLSVRYAGRRLTQAGTLLGTALAFGTRLLVSSDMKSWSTVLAVMGKAFSEAAFTTAYLFTSELYPTVLRQTGMGLTALVGRLGGSLAPLAALLDGVWLSLPKLTYGGIALLAAGTALLLPETRQAQLPETIQDVERKSAPTSLQEEEMPMKQVQN

SEQ ID NO: 4066 - protein, 542 aa, unidentified
MTFSEILDRVGSMGHFQFLHVAILGLPILNMANHNLLQIFTAATPVHHCRPPHNASTGPWVLPMGPNGKPERCLRFVHPPNASLPNDTQRAMEPCLDGWVYNSTKDSIVTEWDLVCNSNKLKEMAQSIFMAGILIGGLVLGDLSDRFGRRPILTCSYLLLAASGSGAAFSPTFPIYMVFRFLCGFGISGITLSTVILNVEWVPTRMRAIMSTALGYCYTFGQFILPGLAYAIPQWRWLQLTVSIPFFVFFLSSWWTPESIRWLVLSGKSSKALKILRRVAVFNGKKEEGERLSLEELKLNLQKEISLAKAKYTASDLFRIPMLRRMTFCLSLAWFATGFAYYSLAMGVEEFGVNLYILQIIFGGVDVPAKFITILSLSYLGRHTTQAAALLLAGGAILALTFVPLDLQTVRTVLAVFGKGCLSSSFSCLFLYTSELYPTVIRQTGMGVSNLWTRVGSMVSPLVKITGEVQPFIPNIIYGITALLGGSAALFLPETLNQPLPETIEDLENWSLRAKKPKQEPEVEKASQRIPLQPHGPGLGSS

SEQ ID NO: 4067 - protein, 553 aa, unidentified
MAFQDLLGHAGDLWRFQILQTVFLSIFAVATYLHFMLENFTAFIPGHRCWVHILDNDTVSDNDTGALSQDALLRISIPLDSNMRPEKCRRFVHPQWQLLHLNGTFPNTSDADMEPCVDGWVYDRISFSSTIVTEWDLVCDSQSLTSVAKFVFMAGMMVGGILGGHLSDRFGRRFVLRWCYLQVAIVGTCAALAPTFLIYCSLRFLSGIAAMSLITNTIMLIAEWATHRFQAMGITLGMCPSGIAFMTLAGLAFAIRDWHILQLVVSVPYFVIFLTSSWLLESARWLIINNKPEEGLKELRKAAHRSGMKNARDTLTLEILKSTMKKELEAAQKKKPSLCEMLHMPNICKRISLLSFTRFANFMAYFGLNLHVQHLGNNVFLLQTLFGAVILLANCVAPWALKYMNRRASQMLLMFLLAICLLAIIFVPQEMQTLREVLATLGLGASALANTLAFAHGNEVIPTIIRARAMGINATFANIAGALAPLMMILSVYSPPLPWIIYGVFPFISGFAFLLLPETRNKPLFDTIQDEKNERKDPREPKQEDPRVEVTQF

SEQ ID NO: 4068 - protein, 598 aa, unidentified
MRAQEDLEGRTQHETTRDPSTPLPTEPKFDMLYKIEDVPPWYLCILLGFQHYLTCFSGTIAVPFLLAEALCVGHDQHMVSQLIGTIFTCVGITTLIQTTVGIRLPLFQASAFAFLVPAKAILALERWKCPPEEEIYGNWSLPLNTSHIWHPRIREVQGAIMVSSVVEVVIGLLGLPGALLNYIGPLTVTPTVSLIGLSVFQAAGDRAGSHWGISACSILLIILFSQYLRNLTFLLPVYRWGKGLTLLRIQIFKMFPIMLAIMTVWLLCYVLTLTDVLPTDPKAYGFQARTDARGDIMAIAPWIRIPYPCQWGLPTVTAAAVLGMFSATLAGIIESIGDYYACARLAGAPPPPVHAINRGIFTEGICCIIAGLLGTGNGSTSSSPNIGVLGITKVGSRRVVQYGAAIMLVLGTIGKFTALFSSLPDPILGGMFCTLFGMITAVGLSNLQFVDMNSSRNLFVLGFSMFFGLTLPNYLESNPGAINTGILEVDQILIVLLTTEMFVGGCLAFILDNTVPGSPEERGLIQWKAGAHANSDMSSSLKSYDFPIGMGIVKRITFLKYIPICPVFKGFSSSSKDQIAIPEDTPENTETASVCTKV

SEQ ID NO: 4069 - protein, 650 aa, unidentified
MMGIGKNTTSKSMEAGSSTEGKYEDEAKHPAFFTLPVVINGGATSSGEQDNEDTELMAIYTTENGIAEKSSLAETLDSTGSLDPQRSDMIYTIEDVPPWYLCIFLGLQHYLTCFSGTIAVPFLLADAMCVGYDQWATSQLIGTIFFCVGITTLLQTTFGCRLPLFQASAFAFLAPARAILSLDKWKCNTTDVSVANGTAELLHTEHIWYPRIREIQGAIIMSSLIEVVIGLLGLPGALLKYIGPLTITPTVALIGLSGFQAAGERAGKHWGIAMLTIFLVLLFSQYARNVKFPLPIYKSKKGWTAYKLQLFKMFPIILAILVSWLLCFIFTVTDVFPPDSTKYGFYARTDARQGVLLVAPWFKVPYPFQWGLPTVSAAGVIGMLSAVVASIIESIGDYYACARLSCAPPPPIHAINRGIFVEGLSCVLDGIFGTGNGSTSSSPNIGVLGITKVGSRRVIQCGAALMLALGMIGKFSALFASLPDPVLGALFCTLFGMITAVGLSNLQFIDLNSSRNLFVLGFSIFFGLVLPSYLRQNPLVTGITGIDQVLNVLLTTAMFVGGCVAFILDNTIPGTPEERGIRKWKKGVGKGNKSLDGMESYNLPFGMNIIKKYRCFSYLPISPTFVGYTWKGLRKSDNSRSSDEDSQATG

SEQ ID NO: 4070 - protein, 610 aa, unidentified
MSRSPLNPSQLRSVGSQDALAPLPPPAPQNPSTHSWDPLCGSLPWGLSCLLALQHVLVMASLLCVSHLLLLCSLSPGGLSYSPSQLLASSFFSCGMSTILQTWMGSRLPLVQAPSLEFLIPALVLTSQKLPRAIQTPGNSSLMLHLCRGPSCHGLGHWNTSLQEVSGAVVVSGLLQGMMGLLGSPGHVFPHCGPLVLAPSLVVAGLSAHREVAQFCFTHWGLALLVILLMVVCSQHLGSCQFHVCPWRRASTSSTHTPLPVFRLLSVLIPVACVWIVSAFVGFSVIPQELSAPTKAPWIWLPHPGEWNWPLLTPRALAAGISMALAASTSSLGCYALCGRLLHLPPPPPHACSRGLSLEGLGSVLAGLLGSPMGTASSFPNVGKVGLIQAGSQQVAHLVGLLCVGLGLSPRLAQLLTTIPLPVVGGVLGVTQAVVLSAGFSSFYLADIDSGRNIFIVGFSIFMALLLPRWFREAPVLFSTGWSPLDVLLHSLLTQPIFLAGLSGFLLENTIPGTQLERGLGQGLPSPFTAQEARMPQKPREKAAQVYRLPFPIQNLCPCIPQPLHCLCPLPEDPGDEEGGSSEPEEMADLLPGSGEPCPESSREGFRSQK

SEQ ID NO: 4071 - protein, 1099 aa, unidentified
MGKLIRMGPQERWLLRTKRLHWSRLLFLLGMLIIGSTYQHLRRPRGLSSLWAAVSSHQPIKLASRDLSSEEMMMMSSSPSKPSSEMGGKMLVPQASVGSDEATLSMTVENIPSMPKRTAKMIPTTTKNNYSPTAAGTERRKEDTPTSSRTLTYYTSTSSRQIVKKYTPTPRGEMKSYSPTQVREKVKYTPSPRGRRVGTYVPSTFMTMETSHAITPRTTVKDSDITATYKILETNSLKRIMEETTPTTLKGMFDSTPTFLTHEVEANVLTSPRSVMEKNNLFPPRRVESNSSAHPWGLVGKSNPKTPQGTVLLHTPATSEGQVTISTMTGSSPAETKAFTAAWSLRNPSPRTSVSAIKTAPAIVWRLAKKPSTAPSTSTTPTVRAKLTMQVHHCVVVKPTPAMLTTPSPSLTTALLPEELSPSPSVLPPSLPDLHPKGEYPPDLFSVEERRQGWVVLHVFGMMYVFVALAIVCDEYFVPALGVITDKLQISEDVAGATFMAAGGSAPELFTSLIGVFISHSNVGIGTIVGSAVFNILFVIGTCSLFSREILNLTWWPLFRDVSFYILDLIMLILFFLDSLIAWWESLLLLLAYAFYVFTMKWNKHIEVWVKEQLSRRPVAKVMALEDLSKPGDGAIAVDELQDNKKLKLPSLLTRGSSSTSLHNSTIRSTIYQLMLHSLDPLREVRLAKEKEEESLNQGARAQPQAKAESKPEEEEPAKLPAVTVTPAPVPDIKGDQKENPGGQEDVAEAESTGEMPGEEGETAGEGETEEKSGGETQPEGEGETETQGKGEECEDENEAEGKGDNEGEDEGEIHAEDGEMKGNEGETESQELSAENHGEAKNDEKGVEDGGGSDGGDSEEEEEEEEEQEEEEEEEEQEEEEEEEEEEEEKGNEEPLSLDWPETRQKQAIYLFLLPIVFPLWLTVPDVRRQESRKFFVFTFLGSIMWIAMFSYLMVWWAHQVGETIGISEEIMGLTILAAGTSIPDLITSVIVARKGLGDMAVSSSVGSNIFDITVGLPVPWLLFSLINGLQPVPVSSNGLFCAIVLLFLMLLFVISSIASCKWRMNKILGFTMFLLYFVFLIISVMLEDRIISCPVSV

SEQ ID NO: 4072 - protein, 661 aa, unidentified
MDLQQSTTITSLEKWCLDESLSGCRRHYSVKKKLKLIRVLGLFMGLVAISTVSFSISAFSETDTQSTGEASVVSGPRVAQGYHQRTLLDLNDKILDYTPQPPLSKEGESENSTDHAQGDYPKDIFSLEERRKGAIILHVIGMIYMFIALAIVCDEFFVPSLTVITEKLGISDDVAGATFMAAGGSAPELFTSLIGVFIAHSNVGIGTIVGSAVFNILFVIGMCALFSREILNLTWWPLFRDVSFYIVDLIMLIIFFLDNVIMWWESLLLLTAYFCYVVFMKFNVQVEKWVKQMINRNKVVKVTAPEAQAKPSAARDKDEPTLPAKPRLQRGGSSASLHNSLMRNSIFQLMIHTLDPLAEELGSYGKLKYYDTMTEEGRFREKASILHKIAKKKCHVDENERQNGAANHVEKIELPNSTSTDVEMTPSSDASEPVQNGNLSHNIEGAEAQTADEEEDQPLSLAWPSETRKQVTFLIVFPIVFPLWITLPDVRKPSSRKFFPITFFGSITWIAVFSYLMVWWAHQVGETIGISEEIMGLTILAAGTSIPDLITSVIVARKGLGDMAVSSSVGSNIFDITVGLPLPWLLYTVIHRFQPVAVSSNGLFCAIVLLFIMLLFVILSIALCKWRMNKILGFIMFGLYFVFLVVSVLLEDRILTCPVSI

SEQ ID NO: 4073 - protein, 644 aa, unidentified
MRPSGDEDRARRRRRRRRRRDLLLSQLCFLASVALLLWSLSSLREQKELDLMDLVGEDRKWMMARKLMQVNDTLTSEDAGLRNSKNCTEPALHEFPNDIFTNEDRRQGAVVLHVLCAIYMFYALAIVCDDFFVPSLEKICERLHLSEDVAGATFMAAGSSAPELFTSVIGVFITKGDVGVGTIVGSAVFNILCIIGVCGLFAGQVVALSSWCLLRDSIYYTLSVIALIVFIYDEKVSWWESLVLVLMYLIYIVIMKYNACIHQCFERRTKGAGNMVNGLANNAEIDDSSNCDATVVLLKKANFHRKASVIMVDELLSAYPHQLSFSEAGLRIMITSHFPPKTRLSMASRMLINERQRLINSRAYTNGESEVAIKIPIKHTVENGTGPSSAPDRGVNGTRRDDVVAEAGNETENENEDNENDEEEEEDEDDDEGPYTPFDTPSGKLETVKWAFTWPLSFVLYFTVPNCNKPRWEKWFMVTFASSTLWIAAFSYMMVWMVTIIGYTLGIPDVIMGITFLAAGTSVPDCMASLIVARQGMGDMAVSNSIGSNVFDILIGLGLPWALQTLAVDYGSYIRLNSRGLIYSVGLLLASVFVTVFGVHLNKWQLDKKLGCGCLLLYGVFLCFSIMTEFNVFTFVNLPMCGDH

SEQ ID NO: 4074 - protein, 622 aa, unidentified
MALRGTLRPLKVRRRREMLPQQVGFVCAVLALVCCASGLFGSLGHKTASASKRVLPDTWRNRKLMAPVNGTQTAKNCTDPAIHEFPTDLFSNKERQHGAVLLHILGALYMFYALAIVCDDFFVPSLEKICERLHLSEDVAGATFMAAGSSTPELFASVIGVFITHGDVGVGTIVGSAVFNILCIIGVCGLFAGQVVRLTWWAVCRDSVYYTISVIVLIVFIYDEQIVWWEGLVLIILYVFYILIMKYNVKMQAFFTVKQKSIANGNPVNSELEAGNDFYDGSYDDPSVPLLGQVKEKPQYGKNPVVMVDEIMSSSPPKFTFPEAGLRIMITNKFGPRTRLRMASRIIINERQRLINSANGVSSKPLQNGRHENIENGNVPVENPEDPQQNQEQQPPPQPPPPEPEPVEADFLSPFSVPEARGDKVKWVFTWPLIFLLCVTIPNCSKPRWEKFFMVTFITATLWIAVFSYIMVWLVTIIGYTLGIPDVIMGITFLAAGTSVPDCMASLIVARQGLGDMAVSNTIGSNVFDILVGLGVPWGLQTMVVNYGSTVKINSRGLVYSVVLLLGSVALTVLGIHLNKWRLDRKLGVYVLVLYAIFLCFSIMIEFNVFTFVNLPMCREDD

SEQ ID NO: 4075 - protein, 500 aa, unidentified
MQTKGGQTWARRALLLGILWATAHLPLSGTSLPQRLPRATGNSTQCVISPSSEFPEGFFTRQERRDGGIIIYFLIIVYMFMAISIVCDEYFLPSLEIISESLGLSQDVAGTTFMAAGSSAPELVTAFLGVFITKGDIGISTILGSAIYNLLGICAACGLLSNTVSTLSCWPLFRDCAAYTISAAAVLGIIYDNQVYWYEGALLLLIYGLYVLVLCFDIKINQYIIKKCSPCCACLAKAMERSEQQPLMGWEDEGQPFIRRQSRTDSGIFYEDSGYSQLSISLHGLSQVSEDPPSVFNMPEADLKRIFWVLSLPIITLLFLTTPDCRKKFWKNYFVITFFMSAIWISAFTYILVWMVTITGETLEIPDTVMGLTLLAAGTSIPDTIASVLVARKGKGDMAMSNIVGSNVFDMLCLGIPWFIKTAFINGSAPAEVNSRGLTYITISLNISIIFLFLAVHFNGWKLDRKLGIVCLLSYLGLATLSVLYELGIIGNNKIRGCGG

SEQ ID NO: 4076 - protein, 287 aa, unidentified
MAAEARVSRWYFGGLASCGAACCTHPLDLLKVHLQTQQEVKLRMTGMALRVVRTDGILALYSGLSASLCRQMTYSLTRFAIYETVRDRVAKGSQGPLPFHEKVLLGSVSGLAGGFVGTPADLVNVRMQNDVKLPQGQRRNYAHALDGLYRVAREEGLRRLFSGATMASSRGALVTVGQLSCYDQAKQLVLSTGYLSDNIFTHFVASFIAGGCATFLCQPLDVLKTRLMNSKGEYQGVFHCAVETAKLGPLAFYKGLVPAGIRLIPHTVLTFVFLEQLRKNFGIKVPS

SEQ ID NO: 4077 - protein, 314 aa, unidentified
MAATASAGAGGIDGKPRTSPKSVKFLFGGLAGMGATVFVQPLDLVKNRMQLSGEGAKTREYKTSFHALTSILKAEGLRGIYTGLSAGLLRQATYTTTRLGIYTVLFERLTGADGTPPGFLLKAVIGMTAGATGAFVGTPAEVALIRMTADGRLPADQRRGYKNVFNALIRITREEGVLTLWRGCIPTMARAVVVNAAQLASYSQSKQFLLDSGYFSDNILCHFCASMISGLVTTAASMPVDIAKTRIQNMRMIDGKPEYKNGLDVLFKVVRYEGFFSLWKGFTPYYARLGPHTVLTFIFLEQMNKAYKRLFLSG

SEQ ID NO: 4078 - protein, 325 aa, unidentified
MGIFPGIILIFLRVKFATAAVIVSGHQKSTTVSHEMSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEDETLLINMICGVVSGVISSTIANPTDVLKIRMQAQGSLFQGSMIGSFIDIYQQEGTRGLWRGVVPTAQRAAIVVGVELPVYDITKKHLILSGMMGDTILTHFVSSFTCGLAGALASNPVDVVRTRMMNQRAIVGHVDLYKGTVDGILKMWKHEGFFALYKGFWPNWLRLGPWNIIFFITYEQLKRLQI

SEQ ID NO: 4079 - protein, 301 aa, unidentified
MKSNPAIQAAIDLTAGAAGGTACVLTGQPFDTMKVKMQTFPDLYRGLTDCCLKTYSQVGFRGFYKGTSPALIANIAENSVLFMCYGFCQQVVRKVAGLDKQAKLSDLQNAAAGSFASAFAALVLCPTELVKCRLQTMYEMETSGKIAKSQNTVWSVIKSILRKDGPLGFYHGLSSTLLREVPGYFFFFGGYELSRSFFASGRSKDELGPVPLMLSGGVGGICLWLAVYPVDCIKSRIQVLSMSGKQAGFIRTFINVVKNEGITALYSGLKPTMIRAFPANGALFLAYEYSRKLMMNQLEAY

SEQ ID NO: 4080 - protein, 332 aa, unidentified
MAAATAAAALAAADPPPAMPQAAGAGGPTTRRDFYWLRSFLAGGIAGCCAKTTVAPLDRVKVLLQAHNHHYKHLGVFSALRAVPQKEGFLGLYKGNGAMMIRIFPYGAIQFMAFEHYKTLITTKLGISGHVHRLMAGSMAGMTAVICTYPLDMVRVRLAFQVKGEHSYTGIIHAFKTIYAKEGGFFGFYRGLMPTILGMAPYAGVSFFTFGTLKSVGLSHAPTLLGRPSSDNPNVLVLKTHVNLLCGGVAGAIAQTISYPFDVTRRRMQLGTVLPEFEKCLTMRDTMKYVYGHHGIRKGLYRGLSLNYIRCIPSQAVAFTTYELMKQFFHLN

SEQ ID NO: 4081 - protein, 307 aa, unidentified
MASVLSYESLVHAVAGAVGSVTAMTVFFPLDTARLRLQVDEKRKSKTTHMVLLEIIKEEGLLAPYRGWFPVISSLCCSNFVYFYTFNSLKALWVKGQHSTTGKDLVVGFVAGVVNVLLTTPLWVVNTRLKLQGAKFRNEDIVPTNYKGIIDAFHQIIRDEGISALWNGTFPSLLLVFNPAIQFMFYEGLKRQLLKKRMKLSSLDVFIIGAVAKAIATTVTYPLQTVQSILRFGRHRLNPENRTLGSLRNILYLLHQRVRRFGIMGLYKGLEAKLLQTVLTAALMFLVYEKLTAATFTVMGLKRAHQH

SEQ ID NO: 4082 - protein, 315 aa, unidentified
MTHQDLSITAKLINGGVAGLVGVTCVFPIDLAKTRLQNQHGKAMYKGMIDCLMKTARAEGFFGMYRGAAVNLTLVTPEKAIKLAANDFFRRLLMEDGMQRNLKMEMLAGCGAGMCQVVVTCPMEMLKIQLQDAGRLAVHHQGSASAPSTSRSYTTGSASTHRRPSATLIAWELLRTQGLAGLYRGLGATLLRDIPFSIIYFPLFANLNNLGFNELAGKASFAHSFVSGCVAGSIAAVAVTPLDVLKTRIQTLKKGLGEDMYSGITDCARKLWIQEGPSAFMKGAGCRALVIAPLFGIAQGVYFIGIGERILKCFD

SEQ ID NO: 4083 - protein, 320 aa, unidentified
MVGYDPKPDGRNNTKFQVAVAGSVSGLVTRALISPFDVIKIRFQLQHERLSRSDPSAKYHGILQASRQILQEEGPTAFWKGHVPAQILSIGYGAVQFLSFEMLTELVHRGSVYDAREFSVHFVCGGLAACMATLTVHPVDVLRTRFAAQGEPKVYNTLRHAVGTMYRSEGPQVFYKGLAPTLIAIFPYAGLQFSCYSSLKHLYKWAIPAEGKKNENLQNLLCGSGAGVISKTLTYPLDLFKKRLQVGGFEHARAAFGQVRRYKGLMDCAKQVLQKEGALGFFKGLSPSLLKAALSTGFMFFSYEFFCNVFHCMNRTASQR

SEQ ID NO: 4084 - protein, 301 aa, unidentified
MKSGPGIQAAIDLTAGAAGGTACVLTGQPFDTIKVKMQTFPDLYKGLTDCFLKTYAQVGLRGFYKGTGPALMAYVAENSVLFMCYGFCQQFVRKVAGMDKQAKLSDLQTAAAGSFASAFAALALCPTELVKCRLQTMYEMEMSGKIAKSHNTIWSVVKGILKKDGPLGFYHGLSSTLLQEVPGYFFFFGGYELSRSFFASGRSKDELGPVHLMLSGGVAGICLWLVVFPVDCIKSRIQVLSMYGKQAGFIGTLLSVVRNEGIVALYSGLKATMIRAIPANGALFVAYEYSRKMMMKQLEAY

SEQ ID NO: 4085 - protein, 301 aa, unidentified
MADQPKPISPLKNLLAGGFGGVCLVFVGHPLDTVKVRLQTQPPSLPGQPPMYSGTFDCFRKTLFREGITGLYRGMAAPIIGVTPMFAVCFFGFGLGKKLQQKHPEDVLSYPQLFAAGMLSGVFTTGIMTPGERIKCLLQIQASSGESKYTGTLDCAKKLYQEFGIRGIYKGTVLTLMRDVPASGMYFMTYEWLKNIFTPEGKRVSELSAPRILVAGGIAGIFNWAVAIPPDVLKSRFQTAPPGKYPNGFRDVLRELIRDEGVTSLYKGFNAVMIRAFPANAACFLGFEVAMKFLNWATPNL

SEQ ID NO: 4086 - protein, 323 aa, unidentified
MADKQISLPAKLINGGIAGLIGVTCVFPIDLAKTRLQNQQNGQRVYTSMSDCLIKTVRSEGYFGMYRGAAVNLTLVTPEKAIKLAANDFFRHQLSKDGQKLTLLKEMLAGCGAGTCQVIVTTPMEMLKIQLQDAGRIAAQRKILAAQGQLSAQGGAQPSVEAPAAPRPTATQLTRDLLRSRGIAGLYKGLGATLLRDVPFSVVYFPLFANLNQLGRPASEEKSPFYVSFLAGCVAGSAAAVAVNPCDVVKTRLQSLQRGVNEDTYSGILDCARKILRHEGPSAFLKGAYCRALVIAPLFGIAQVVYFLGIAESLLGLLQDPQA

SEQ ID NO: 4087 - protein, 468 aa, unidentified
MRGSPGDAERRQRWGRLFEELDSNKDGRVDVHELRQGLARLGGGNPDPGAQQGISSEGDADPDGGLDLEEFSRYLQEREQRLLLMFHSLDRNQDGHIDVSEIQQSFRALGISISLEQAEKILHSMDRDGTMTIDWQEWRDHFLLHSLENVEDVLYFWKHSTVLDIGECLTVPDEFSKQEKLTGMWWKQLVAGAVAGAVSRTGTAPLDRLKVFMQVHASKTNRLNILGGLRSMVLEGGIRSLWRGNGINVLKIAPESAIKFMAYEQIKRAILGQQETLHVQERFVAGSLAGATAQTIIYPMEVLKTRLTLRRTGQYKGLLDCARRILEREGPRAFYRGYLPNVLGIIPYAGIDLAVYETLKNWWLQQYSHDSADPGILVLLACGTISSTCGQIASYPLALVRTRMQAQASIEGGPQLSMLGLLRHILSQEGMRGLYRGIAPNFMKVIPAVSISYVVYENMKQALGVTSR

SEQ ID NO: 4088 - protein, 274 aa, unidentified
MDRPGFVAALVAGGVAGVSVDLILFPLDTIKTRLQSPQGFSKAGGFHGIYAGVPSAAIGSFPNAAAFFITYEYVKWFLHADSSSYLTPMKHMLAASAGEVVACLIRVPSEVVKQRAQVSASTRTFQIFSNILYEEGIQGLYRGYKSTVLREIPFSLVQFPLWESLKALWSWRQDHVVDSWQSAVCGAFAGGFAAAVTTPLDVAKTRITLAKAGSSTADGNVLSVLHGVWRSQGLAGLFAGVFPRMAAISLGGFIFLGAYDRTHSLLLEVGRKSP

SEQ ID NO: 4089 - protein, 362 aa, unidentified
MFSSVAHLARANPFNTPHLQLVHDGLGDLRSSSPGPTGQPRRPRNLAAAAVEEQYSCDYGSGRFFILCGLGGIISCGTTHTALVPLDLVKCRMQVDPQKYKGIFNGFSVTLKEDGVRGLAKGWAPTFLGYSMQGLCKFGFYEVFKVLYSNMLGEENTYLWRTSLYLAASASAEFFADIALAPMEAAKVRIQTQPGYANTLRDAAPKMYKEEGLKAFYKGVAPLWMRQIPYTMMKFACFERTVEALYKFVVPKPRSECSKPEQLVVTFVAGYIAGVFCAIVSHPADSVVSVLNKEKGSSASLVLKRLGFKGVWKGLFARIIMIGTLTALQWFIYDSVKVYFRLPRPPPPEMPESLKKKLGLTQ

SEQ ID NO: 4090 - protein, 315 aa, unidentified
MHREPAKKKAEKRLFDASSFGKDLLAGGVAAAVSKTAVAPIERVKLLLQVQASSKQISPEARYKGMVDCLVRIPREQGFFSFWRGNLANVIRYFPTQALNFAFKDKYKQLFMSGVNKEKQFWRWFLANLASGGAAGATSLCVVYPLDFARTRLGVDIGKGPEERQFKGLGDCIMKIAKSDGIAGLYQGFGVSVQGIIVYRASYFGAYDTVKGLLPKPKKTPFLVSFFIAQVVTTCSGILSYPFDTVRRRMMMQSGEAKRQYKGTLDCFVKIYQHEGISSFFRGAFSNVLRGTGGALVLVLYDKIKEFFHIDIGGR

SEQ ID NO: 4091 - protein, 321 aa, unidentified
MATGGQQKENTLLHLFAGGCGGTVGAIFTCPLEVIKTRLQSSRLALRTVYYPQVHLGTISGAGMVRPTSVTPGLFQVLKSILEKEGPKSLFRGLGPNLVGVAPSRAVYFACYSKAKEQFNGIFVPNSNIVHIFSAGSAAFITNSLMNPIWMVKTRMQLEQKVRGSKQMNTLQCARYVYQTEGIRGFYRGLTASYAGISETIICFAIYESLKKYLKEAPLASSANGTEKNSTSFFGLMAAAALSKGCASCIAYPHEVIRTRLREEGTKYKSFVQTARLVFREEGYLAFYRGLFAQLIRQIPNTAIVLSTYELIVYLLEDRTQ

SEQ ID NO: 4092 - protein, 304 aa, unidentified
METVPPAVDLVLGASACCLACVFTNPLEVVKTRLQLQGELQARGTYPRPYHGFIASVAAVARADGLWGLQKGLAAGLLYQGLMNGVRFYCYSLACQAGLTQQPGGTVVAGAVAGALGAFVGSPAYLIKTQLQAQTVAAVAVGHQHNHQTVLGALETIWRQQGLLGLWQGVGGAVPRVMVGSAAQLATFASAKAWVQKQQWLPEDSWLVALAGGMISSIAVVVVMTPFDVVSTRLYNQPVDTAGRGQLYGGLTDCMVKIWRQEGPLALYKGLGPAYLRLGPHTILSMLFWDELRKLAGRAQHKGT

SEQ ID NO: 4093 - protein, 300 aa, unidentified
MDFLMSGLAACGACVFTNPLEVVKTRMQLQGELQAPGTYQRHYRNVFHAFITIGKVDGLAALQKGLAPALLYQFLMNGIRLGTYGLAEAGGYLHTAEGTHSPARSAAAGAMAGVMGAYLGSPIYMVKTHLQAQAASEIAVGHQYKHQGMFQALTEIGQKHGLVGLWRGALGGLPRVIVGSSTQLCTFSSTKDLLSQWEIFPPQSWKLALVAAMMSGIAVVLAMAPFDVACTRLYNQPTDAQGKGLMYRGILDALLQTARTEGIFGMYKGIGASYFRLGPHTILSLFFWDQLRSLYYTDTK

SEQ ID NO: 4094 - protein, 311 aa, unidentified
MSQRDTLVHLFAGGCGGTVGAILTCPLEVVKTRLQSSSVTLYISEVQLNTMAGASVNRVVSPGPLHCLKVILEKEGPRSLFRGLGPNLVGVAPSRAIYFAAYSNCKEKLNDVFDPDSTQVHMISAAMAGFTAITATNPIWLIKTRLQLDARNRGERRMGAFECVRKVYQTDGLKGFYRGMSASYAGISETVIHFVIYESIKQKLLEYKTASTMENDEESVKEASDFVGMMLAAATSKTCATTIAYPHEVVRTRLREEGTKYRSFFQTLSLLVQEEGYGSLYRGLTTHLVRQIPNTAIMMATYELVVYLLNG

SEQ ID NO: 4095 - protein, 304 aa, unidentified
MIQNSRPSLLQPQDVGDTVETLMLHPVIKAFLCGSISGTCSTLLFQPLDLLKTRLQTLQPSDHGSRRVGMLAVLLKVVRTESLLGLWKGMSPSIVRCVPGVGIYFGTLYSLKQYFLRGHPPTALESVMLGVGSRSVAGVCMSPITVIKTRYESGKYGYESIYAALRSIYHSEGHRGLFSGLTATLLRDAPFSGIYLMFYNQTKNIVPHDQVDATLIPITNFSCGIFAGILASLVTQPADVIKTHMQLYPLKFQWIGQAVTLIFKDYGLRGFFQGGIPRALRRTLMAAMAWTVYEEMMAKMGLKS

SEQ ID NO: 4096 - protein, 359 aa, unidentified
MADQDPAGISPLQQMVASGTGAVVTSLFMTPLDVVKVRLQSQRPSMASELMPSSRLWSLSYTKLPSSLQSTGKCLLYCNGVLEPLYLCPNGARCATWFQDPTRFTGTMDAFVKIVRHEGTRTLWSGLPATLVMTVPATAIYFTAYDQLKAFLCGRALTSDLYAPMVAGALARLGTVTVISPLELMRTKLQAQHVSYRELGACVRTAVAQGGWRSLWLGWGPTALRDVPFSALYWFNYELVKSWLNGFRPKDQTSVGMSFVAGGISGTVAAVLTLPFDVVKTQRQVALGAMEAVRVNPLHVDSTWLLLRRIRAESGTKGLFAGFLPRIIKAAPSCAIMISTYEFGKSFFQRLNQDRLLGG

SEQ ID NO: 4097 - protein, 298 aa, unidentified
MGDHAWSFLKDFLAGGVAAAVSKTAVAPIERVKLLLQVQHASKQISAEKQYKGIIDCVVRIPKEQGFLSFWRGNLANVIRYFPTQALNFAFKDKYKQLFLGGVDRHKQFWRYFAGNLASGGAAGATSLCFVYPLDFARTRLAADVGKGAAQREFHGLGDCIIKIFKSDGLRGLYQGFNVSVQGIIIYRAAYFGVYDTAKGMLPDPKNVHIFVSWMIAQSVTAVAGLVSYPFDTVRRRMMMQSGRKGADIMYTGTVDCWRKIAKDEGAKAFFKGAWSNVLRGMGGAFVLVLYDEIKKYV

SEQ ID NO: 4098 - protein, 338 aa, unidentified
MDPETRGQEIIKVTPLQQMLASCTGAILTSVIVTPLDVVKIRLQAQNNPLPKGKCFVYSNGLMDHLCVCEEGGNKLWYKKPGNFQGTLDAFFKIIRNEGIKSLWSGLPPTLVMAVPATVIYFTCYDQLSALLRSKLGENETCIPIVAGIVARFGAVTVISPLELIRTKMQSKKFSYVELHRFVSKKVSEDGWISLWRGWAPTVLRDVPFSAMYWYNYEILKKWLCEKSGLYEPTFMINFTSGALSGSFAAVATLPFDVVKTQKQTQLWTYESHKISMPLHMSTWIIMKNIVAKNGFSGLFSGLIPRLIKIAPACAIMISTYEFGKAFFQKQNVRRQQY

SEQ ID NO: 4099 - protein, 318 aa, unidentified
MGNGVKEGPVRLHEDAEAVLSSSVSSKRDHRQVLSSLLSGALAGALAKTAVAPLDRTKIIFQVSSKRFSAKEAFRVLYYTYLNEGFLSLWRGNSATMVRVVPYAAIQFSAHEEYKRILGSYYGFRGEALPPWPRLFAGALAGTTAASLTYPLDLVRARMAVTPKEMYSNIFHVFIRISREEGLKTLYHGFMPTVLGVIPYAGLSFFTYETLKSLHREYSGRRQPYPFERMIFGACAGLIGQSASYPLDVVRRRMQTAGVTGYPRASIARTLRTIVREEGAVRGLYKGLSMNWVKGPIAVGISFTTFDLMQILLRHLQS

SEQ ID NO: 4100 - protein, 341 aa, unidentified
MATWRRDGRLTGGQRLLCAGLAGTLSLSLTAPLELATVLAQVGVVRGHARGPWATGHRVWRAEGLRALWKGNAVACLRLFPCSAVQLAAYRKFVVLFTDDLGHISQWSSIMAGSLAGMVSTIVTYPTDLIKTRLIMQNILEPSYRGLLHAFSTIYQQEGFLALYRGVSLTVVGALPFSAGSLLVYMNLEKIWNGPRDQFSLPQNFANVCLAAAVTQTLSFPFETVKRKMQAQSPYLPHSGGVDVHFSGAVDCFRQIVKAQGVLGLWNGLTANLLKIVPYFGIMFSTFEFCKRICLYQNGYILSPLSYKLTPGVDQSLQPQELRELKKFFKTRKPKPKKPTL

SEQ ID NO: 4101 - protein, 314 aa, unidentified
MEDKRNIQIIEWEHLDKKKFYVFGVAMTMMIRVSVYPFTLIRTRLQVQKGKSLYHGTFDAFIKILRADGITGLYRGFLVNTFTLISGQCYVTTYELTRKFVADYSQSNTVKSLVAGGSASLVAQSITVPIDVVSQHLMMQRKGEKMGRFQVRGNPEGQGVVAFGQTKDIIRQILQADGLRGFYRGYVASLLTYIPNSAVWWPFYHFYAEQLSYLCPKECPHIVFQAVSGPLAAATASILTNPMDVIRTRVQVEGKNSIILTFRQLMAEEGPWGLMKGLSARIISATPSTIVIVVGYESLKKLSLRPELVDSRHW

SEQ ID NO: 4102 - protein, 288 aa, unidentified
MPVEEFVAGWISGALGLVLGHPFDTVKVRLQTQTTYRGIVDCMVKIYRHESLLGFFKGMSFPIASIAVVNSVLFGVYSNTLLVLTATSHQERRAQPPSYMHIFLAGCTGGFLQAYCLAPFDLIKVRLQNQTEPRAQPGSPPPRYQGPVHCAASIFREEGPRGLFRGAWALTLRDTPTVGIYFITYEGLCRQYTPEGQNPSSATVLVAGGFAGIASWVAATPLDMIKSRMQMDGLRRRVYQGMLDCMVSSIRQEGLGVFFRGVTINSARAFPVNAVTFLSYEYLLRWWG

SEQ ID NO: 4103 - protein, 418 aa, unidentified
MHPRRPDGFDGLGYRGGARDEQGFGGAFPARSFSTGSDLGHWVTTPPDIPGSRNLHWGEKSPPYGVPTTSTPYEGPTEEPFSSGGGGSVQGQSSEQLNRFAGFGIGLASLFTENVLAHPCIVLRRQCQVNYHAQHYHLTPFTVINIMYSFNKTQGPRALWKGMGSTFIVQGVTLGAEGIISEFTPLPREVLHKWSPKQIGEHLLLKSLTYVVAMPFYSASLIETVQSEIIRDNTGILECVKEGIGRVIGMGVPHSKRLLPLLSLIFPTVLHGVLHYIISSVIQKFVLLILKRKTYNSHLAESTSPVQSMLDAYFPELIANFAASLCSDVILYPLETVLHRLHIQGTRTIIDNTDLGYEVLPINTQYEGMRDCINTIRQEEGVFGFYKGFGAVIIQYTLHAAVLQITKIIYSTLLQNNI

SEQ ID NO: 4104 - protein, 308 aa, unidentified
MDFVAGAIGGVCGVAVGYPLDTVKVRIQTEPKYTGIWHCVRDTYHRERVWGFYRGLSLPVCTVSLVSSVSFGTYRHCLAHICRLRYGNPDAKPTKADITLSGCASGLVRVFLTSPTEVAKVRLQTQTQAQKQQRRLSASGPLAVPPMCPVPPACPEPKYRGPLHCLATVAREEGLCGLYKGSSALVLRDGHSFATYFLSYAVLCEWLSPAGHSRPDVPGVLVAGGCAGVLAWAVATPMDVIKSRLQADGQGQRRYRGLLHCMVTSVREEGPRVLFKGLVLNCCRAFPVNMVVFVAYEAVLRLARGLLT

SEQ ID NO: 4105 - protein, 311 aa, unidentified
MGSFQLEDFAAGWIGGAASVIVGHPLDTVKTRLQAGVGYGNTLSCIRVVYRRESMFGFFKGMSFPLASIAVYNSVVFGVFSNTQRFLSQHRCGEPEASPPRTLSDLLLASMVAGVVSVGLGGPVDLIKIRLQMQTQPFRDANLGLKSRAVAPAEQPAYQGPVHCITTIVRNEGLAGLYRGASAMLLRDVPGYCLYFIPYVFLSEWITPEACTGPSPCAVWLAGGMAGAISWGTATPMDVVKSRLQADGVYLNKYKGVLDCISQSYQKEGLKVFFRGITVNAVRGFPMSAAMFLGYELSLQAIRGDHAVTSP

SEQ ID NO: 4106 - protein, 298 aa, unidentified
MTDAAVSFAKDFLAGGVAAAISKTAVAPIERVKLLLQVQHASKQITADKQYKGIIDCVVRIPKEQGVLSFWRGNLANVIRYFPTQALNFAFKDKYKQIFLGGVDKRTQFWLYFAGNLASGGAAGATSLCFVYPLDFARTRLAADVGKAGAEREFRGLGDCLVKIYKSDGIKGLYQGFNVSVQGIIIYRAAYFGIYDTAKGMLPDPKNTHIVISWMIAQTVTAVAGLTSYPFDTVRRRMMMQSGRKGTDIMYTGTLDCWRKIARDEGGKAFFKGAWSNVLRGMGGAFVLVLYDEIKKYT

SEQ ID NO: 4107 - protein, 297 aa, unidentified
MMDSEAHEKRPPILTSSKQDISPHITNVGEMKHYLCGCCAAFNNVAITFPIQKVLFRQQLYGIKTRDAILQLRRDGFRNLYRGILPPLMQKTTTLALMFGLYEDLSCLLHKHVSAPEFATSGVAAVLAGTTEAIFTPLERVQTLLQDHKHHDKFTNTYQAFKALKCHGIGEYYRGLVPILFRNGLSNVLFFGLRGPIKEHLPTATTHSAHLVNDFICGGLLGAMLGFLFFPINVVKTRIQSQIGGEFQSFPKVFQKIWLERDRKLINLFRGAHLNYHRSLISWGIINATYEFLLKVI

SEQ ID NO: 4108 - protein, 297 aa, unidentified
MIDSEAHEKRPPILTSSKQDISPHITNVGEMKHYLCGCCAAFNNVAITYPIQKVLFRQQLYGIKTRDAVLQLRRDGFRNLYRGILPPLMQKTTTLALMFGLYEDLSCLLRKHVRAPEFATHGVAAVLAGTAEAIFTPLERVQTLLQNHKHHDKFTNTYQAFKALKCHGIGEYYRGLVPILFRNGLSNVLFFGLRGPIKEHLPTATTHSAHLVNDFIGGGLLGAMLGFLCFPINVVKTRLQSQIGGEFQSFPKVFQKIWLERDRKLINLFRGAHLNYHRSLISWGIINATYEFLLKFI

SEQ ID NO: 4109 - protein, 298 aa, unidentified
MTEQAISFAKDFLAGGIAAAISKTAVAPIERVKLLLQVQHASKQIAADKQYKGIVDCIVRIPKEQGVLSFWRGNLANVIRYFPTQALNFAFKDKYKQIFLGGVDKHTQFWRYFAGNLASGGAAGATSLCFVYPLDFARTRLAADVGKSGTEREFRGLGDCLVKITKSDGIRGLYQGFSVSVQGIIIYRAAYFGVYDTAKGMLPDPKNTHIVVSWMIAQTVTAVAGVVSYPFDTVRRRMMMQSGRKGADIMYTGTVDCWRKIFRDEGGKAFFKGAWSNVLRGMGGAFVLVLYDELKKVI

SEQ ID NO: 4110 - protein, 701 aa, unidentified
MDESPEPLQQGRGPVPVRRQRPAPRGLREMLKARLWCSCSCSVLCVRALVQDLLPATRWLRQYRPREYLAGDVMSGLVIGIILVPQAIAYSLLAGLQPIYSLYTSFFANLIYFLMGTSRHVSVGIFSLLCLMVGQVVDRELQLAGFDPSQDGLQPGANSSTLNGSAAMLDCGRDCYAIRVATALTLMTGLYQVLMGVLRLGFVSAYLSQPLLDGFAMGASVTILTSQLKHLLGVRIPRHQGPGMVVLTWLSLLRGAGQANVCDVVTSTVCLAVLLAAKELSDRYRHRLRVPLPTELLVIVVATLVSHFGQLHKRFGSSVAGDIPTGFMPPQVPEPRLMQRVALDAVALALVAAAFSISLAEMFARSHGYSVRANQELLAVGCCNVLPAFLHCFATSAALAKSLVKTATGCRTQLSSVVSATVVLLVLLALAPLFHDLQRSVLACVIVVSLRGALRKVWDLPRLWRMSPADALVWAGTAATCMLVSTEAGLLAGVILSLLSLAGRTQRPRTALLARIGDTAFYEDATEFEGLVPEPGVRVFRFGGPLYYANKDFFLQSLYSLTGLDAGCMAARRKEGGSETGVGEGGPAQGEDLGPVSTRAALVPAAAGFHTVVIDCAPLLFLDAAGVSTLQDLRRDYGALGISLLLACCSPPVRDILSRGGFLGEGPGDTAEEEQLFLSVHDAVQTARARHRELEATDAHL

SEQ ID NO: 4111 - protein, 563 aa, unidentified
MRLDLASLMSAPKSLGSAFKSWRLDKAPSPQHTFPSTSIPGMAFALLASVPPVFGLYTSFFPVLIYSLLGTGRHLSTGTFAILSLMTGSAVERLVPEPLVGNLSGIEKEQLDAQRVGVAAAVAFGSGALMLGMFVLQLGVLSTFLSEPVVKALTSGAALHVLLSQLPSLLGLSLPRQIGCFSLFKTLASLLTALPRSSPAELTISALSLALLVPVKELNVRFRDRLPTPIPGEVVLVLLASVLCFTSSVDTRYQVQIVGLLPGGFPQPLLPNLAELPRILADSLPIALVSFAVSASLASIHADKYSYTIDSNQEFLAHGASNLISSLFSCFPNSATLATTNLLVDAGGKTQLAGLFSCTVVLSVLLWLGPFFYYLPKAVLACINISSMRQVFCQMQELPQLWHISRVDFLLQVPGLCILSYPTPLYFGTRGQFRCNLEWHLGLGEGEKETSKPDGPMVAVAEPVRVVVLDFSGVTFADAAGAREVVQVRERLASRCRDARIRLLLAQCNALVQGTLTRVGLLDRVTPDQLFVSVQDAAAYALGSLLRGSSTRSGSQEALGCGK

SEQ ID NO: 4112 - protein, 606 aa, unidentified
MPSSVTALGQARSSGPGMAPSACCCSPAALQRRLPILAWLPSYSLQWLKMDFVAGLSVGLTAIPQALAYAEVAGLPPQYGLYSAFMGCFVYFFLGTSRDVTLGPTAIMSLLVSFYTFHEPAYAVLLAFLSGCIQLAMGVLRLGFLLDFISYPVIKGFTSAAAVTIGFGQIKNLLGLQNIPRPFFLQVYHTFLRIAETRVGDAVLGLVCMLLLLVLKLMRDHVPPVHPEMPPGVRLSRGLVWAATTARNALVVSFAALVAYSFEVTGYQPFILTGETAEGLPPVRIPPFSVTTANGTISFTEMVQDMGAGLAVVPLMGLLESIAVAKAFASQNNYRIDANQELLAIGLTNMLGSLVSSYPVTGSFGRTAVNAQSGVCTPAGGLVTGVLVLLSLDYLTSLFYYIPKSALAAVIIMAVAPLFDTKIFRTLWRVKRLDLLPLCVTFLLCFWEVQYGILAGALVSLLMLLHSAARPETKVSEGPVLVLQPASGLSFPAMEALREEILSRALEVSPPRCLVLECTHVCSIDYTVVLGLGELLQDFQKQGVALAFVGLQVPVLRVLLSADLKGFQYFSTLEEAEKHLRQEPGTQPYNIREDSILDQKVALLKA

SEQ ID NO: 4113 - protein, 739 aa, unidentified
MSSESKEQHNVSPRDSAEGNDSYPSGIHLELQRESSTDFKQFETNDQCRPYHRILIERQEKSDTNFKEFVIKKLQKNCQCSPAKAKNMILGFLPVLQWLPKYDLKKNILGDVMSGLIVGILLVPQSIAYSLLAGQEPVYGLYTSFFASIIYFLLGTSRHISVGIFGVLCLMIGETVDRELQKAGYDNAHSAPSLGMVSNGSTLLNHTSDRICDKSCYAIMVGSTVTFIAGVYQVAMGFFQVGFVSVYLSDALLSGFVTGASFTILTSQAKYLLGLNLPRTNGVGSLITTWIHVFRNIHKTNLCDLITSLLCLLVLLPTKELNEHFKSKLKAPIPIELVVVVAATLASHFGKLHENYNSSIAGHIPTGFMPPKVPEWNLIPSVAVDAIAISIIGFAITVSLSEMFAKKHGYTVKANQEMYAIGFCNIIPSFFHCFTTSAALAKTLVKESTGCHTQLSGVVTALVLLLVLLVIAPLFYSLQKSVLGVITIVNLRGALRKFRDLPKMWSISRMDTVIWFVTMLSSALLSTEIGLLVGVCFSIFCVILRTQKPKSSLLGLVEESEVFESVSAYKNLQIKPGIKIFRFVAPLYYINKECFKSALYKQTVNPILIKVAWKKAAKRKIKEKVVTLGGIQDEMSVQLSHDPLELHTIVIDCSAIQFLDTAGIHTLKEVRRDYEAIGIQVLLAQCNPTVRDSLTNGEYCKKEEENLLFYSVYEAMAFAEVSKNQKGVCVPNGLSLSSD

SEQ ID NO: 4114 - protein, 764 aa, unidentified
MIEPFGNQYIVARPVYSTNAFEENHKKTGRHHKTFLDHLKVCCSCSPQKAKRIVLSLFPIASWLPAYRLKEWLLSDIVSGISTGIVAVLQGLAFALLVDIPPVYGLYASFFPAIIYLFFGTSRHISVGPFPILSMMVGLAVSGAVSKAVPDRNATTLGLPNNSNNSSLLDDERVRVAAAASVTVLSGIIQLAFGILRIGFVVIYLSESLISGFTTAAAVHVLVSQLKFIFQLTVPSHTDPVSIFKVLYSVFSQIEKTNIADLVTALIVLLVVSIVKEINQRFKDKLPVPIPIEFIMTVIAAGVSYGCDFKNRFKVAVVGDMNPGFQPPITPDVETFQNTVGDCFGIAMVAFAVAFSVASVYSLKYDYPLDGNQELIALGLGNIVCGVFRGFAGSTALSRSAVQESTGGKTQIAGLIGAIIVLIVVLAIGFLLAPLQKSVLAALALGNLKGMLMQFAEIGRLWRKDKYDCLIWIMTFIFTIVLGLGLGLAASVAFQLLTIVFRTQFPKCSTLANIGRTNIYKNKKDYYDMYEPEGVKIFRCPSPIYFANIGFFRRKLIDAVGFSPLRILRKRNKALRKIRKLQKQGLLQVTPKGFICTVDTIKDSDEELDNNQIEVLDQPINTTDLPFHIDWNDDLPLNIEVPKISLHSLILDFSAVSFLDVSSVRGLKSILQEFIRIKVDVYIVGTDDDFIEKLNRYEFFDGEVKSSIFFLTIHDAVLHILMKKDYSTSKFNPSQEKDGKIDFTINTNGGLRNRVYEVPVETKF

SEQ ID NO: 4115 - protein, 780 aa, unidentified
MAAPGGRSEPPQLPEYSCSYMVSRPVYSELAFQQQHERRLQERKTLRESLAKCCSCSRKRAFGVLKTLVPILEWLPKYRVKEWLLSDVISGVSTGLVATLQGMAYALLAAVPVGYGLYSAFFPILTYFIFGTSRHISVGPFPVVSLMVGSVVLSMAPDEHFLVSSSNGTVLNTTMIDTAARDTARVLIASALTLLVGIIQLIFGGLQIGFIVRYLADPLVGGFTTAAAFQVLVSQLKIVLNVSTKNYNGVLSIIYTLVEIFQNIGDTNLADFTAGLLTIVVCMAVKELNDRFRHKIPVPIPIEVIVTIIATAISYGANLEKNYNAGIVKSIPRGFLPPELPPVSLFSEMLAASFSIAVVAYAIAVSVGKVYATKYDYTIDGNQEFIAFGISNIFSGFFSCFVATTALSRTAVQESTGGKTQVAGIISAAIVMIAILALGKLLEPLQKSVLAAVVIANLKGMFMQLCDIPRLWRQNKIDAVIWVFTCIVSIILGLDLGLLAGLIFGLLTVVLRVQFPSWNGLGSIPSTDIYKSTKNYKNIEEPQGVKILRFSSPIFYGNVDGFKKCIKSTVGFDAIRVYNKRLKALRKIQKLIKSGQLRATKNGIISDAVSTNNAFEPDEDIEDLEELDIPTKEIEIQVDWNSELPVKVNVPKVPIHSLVLDCGAISFLDVVGVRSLRVIVKEFQRIDVNVYFASLQDYVIEKLEQCGFFDDNIRKDTFFLTVHDAILYLQNQVKSQEGQGSILETITLIQDCKDTLELIETELTEEELDVQDEAMRTLAS

SEQ ID NO: 4116 - protein, 744 aa, unidentified
MDHAEENEILAATQRYYVERPIFSHPVLQERLHTKDKVPDSIADKLKQAFTCTPKKIRNIIYMFLPITKWLPAYKFKEYVLGDLVSGISTGVLQLPQGLAFAMLAAVPPIFGLYSSFYPVIMYCFLGTSRHISIGPFAVISLMIGGVAVRLVPDDIVIPGGVNATNGTEARDALRVKVAMSVTLLSGIIQFCLGVCRFGFVAIYLTEPLVRGFTTAAAVHVFTSMLKYLFGVKTKRYSGIFSVVYSTVAVLQNVKNLNVCSLGVGLMVFGLLLGGKEFNERFKEKLPAPIPLEFFAVVMGTGISAGFNLKESYNVDVVGTLPLGLLPPANPDTSLFHLVYVDAIAIAIVGFSVTISMAKTLANKHGYQVDGNQELIALGLCNSIGSLFQTFSISCSLSRSLVQEGTGGKTQLAGCLASLMILLVILATGFLFESLPQAVLSAIVIVNLKGMFMQFSDLPFFWRTSKIELTIWLTTFVSSLFLGLDYGLITAVIIALLTVIYRTQSPSYKVLGKLPETDVYIDIDAYEEVKEIPGIKIFQINAPIYYANSDLYSNALKRKTGVNPAVIMGARRKAMRKYAKEVGNANMANATVVKADAEVDGEDATKPEEEDGEVKYPPIVIKSTFPEEMQRFMPPGDNVHTVILDFTQVNFIDSVGVKTLAGIVKEYGDVGIYVYLAGCSAQVVNDLTRNRFFENPALWELLFHSIHDAVLGSQLREALAEQEASAPPSQEDLEPNATPATPEA

SEQ ID NO: 4117 - protein, 651 aa, unidentified
MGLADASGPRDTQALLSATQAMDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVVLEVCWKLPQSKVGTVVTAAVAGVVLVVVKLLNDKLQQQLPMPIPGELLTLIGATGISYGMGLKHRFEVDVVGNIPAGLVPPVAPNTQLFSKLVGSAFTIAVVGFAIAISLGKIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLLKKQEQLKLKQLQKEEKLRKQAASPKGASVSINVNTSLEDMRSNNVEDCKMMVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVPDSPVSVTRL

SEQ ID NO: 4118 - protein, 656 aa, unidentified
MTGAKRKKKSMLWSKMHTPQCEDIIQWCRRRLPILDWAPHYNLKENLLPDTVSGIMLAVQQVTQGLAFAVLSSVHPVFGLYGSLFPAIIYAIFGMGHHVATGTFALTSLISANAVERIVPQNMQNLTTQSNTSVLGLSDFEMQRIHVAAAVSFLGGVIQVAMFVLQLGSATFVVTEPVISAMTTGAATHVVTSQVKYLLGMKMPYISGPLGFFYIYAYVFENIKSVRLEALLLSLLSIVVLVLVKELNEQFKRKIKVVLPVDLVLIIAASFACYCTNMENTYGLEVVGHIPQGIPSPRAPPMNILSAVITEAFGVALVGYVASLALAQGSAKKFKYSIDDNQEFLAHGLSNIVSSFFFCIPSAAAMGRTAGLYSTGAKTQVACLISCIFVLIVIYAIGPLLYWLPMCVLASIIVVGLKGMLIQFRDLKKYWNVDKIDWGIWVSTYVFTICFAANVGLLFGVVCTIAIVIGRFPRAMTVSIKNMKEMEFKVKTEMDSETLQQVKIISINNPLVFLNAKKFYTDLMNMIQKENACNQPLDDISKCEQNTLLNSLSNGNCNEEASQSCPNEKCYLILDCSGFTFFDYSGVSMLVEVYMDCKGRSVDVLLAHCTASLIKAMTYYGNLDSEKPIFFESVSAAISHIHSNKNLSKLSDHSEV

SEQ ID NO: 4119 - protein, 970 aa, unidentified
MAQLERSAISGFSSKSRRNSFAYDVKREVYNEETFQQEHKRKASSSGNMNINITTFRHHVQCRCSWHRFLRCVLTIFPFLEWMCMYRLKDWLLGDLLAGISVGLVQVPQGLTLSLLARQLIPPLNIAYAAFCSSVIYVIFGSCHQMSIGSFFLVSALLINVLKVSPFNNGQLVMGSFVKNEFSAPSYLMGYNKSLSVVATTTFLTGIIQLIMGVLGLGFIATYLPESAMSAYLAAVALHIMLSQLTFIFGIMISFHAGPISFFYDIINYCVALPKANSTSILVFLTVVVALRINKCIRISFNQYPIEFPMELFLIIGFTVIANKISMATETSQTLIDMIPYSFLLPVTPDFSLLPKIILQAFSLSLVSSFLLIFLGKKIASLHNYSVNSNQDLIAIGLCNVVSSFFRSCVFTGAIARTIIQDKSGGRQQFASLVGAGVMLLLMVKMGHFFYTLPNAVLAGIILSNVIPYLETISNLPSLWRQDQYDCALWMMTFSSSIFLGLDIGLIISVVSAFFITTVRSHRAKILLLGQIPNTNIYRSINDYREIITIPGVKIFQCCSSITFVNVYYLKHKLLKEVDMVKVPLKEEEIFSLFNSSDTNLQGGKICRCFCNCDDLEPLPRILYTERFENKLDPEASSINLIHCSHFESMNTSQTASEDQVPYTVSSVSQKNQGQQYEEVEEVWLPNNSSRNSSPGLPDVAESQGRRSLIPYSDASLLPSVHTIILDFSMVHYVDSRGLVVLRQICNAFQNANILILIAGCHSSIVRAFERNDFFDAGITKTQLFLSVHDAVLFALSRKVIGSSELSIDESETVIRETYSETDKNDNSRYKMSSSFLGSQKNVSPGFIKIQQPVEEESELDLELESEQEAGLGLDLDLDRELEPEMEPKAETETKTQTEMEPQPETEPEMEPNPKSRPRAHTFPQQRYWPMYHPSMASTQSQTQTRTWSVERRRHPMDSYSPEGNSNEDV

SEQ ID NO: 4120 - protein, 791 aa, unidentified
MSQPRPRYVVDRAAYSLTLFDDEFEKKDRTYPVGEKLRNAFRCSSAKIKAVVFGLLPVLSWLPKYKIKDYIIPDLLGGLSGGSIQVPQGMAFALLANLPAVNGLYSSFFPLLTYFFLGGVHQMVPGTFAVISILVGNICLQLAPESKFQVFNNATNESYVDTAAMEAERLHVSATLACLTAIIQMGLGFMQFGFVAIYLSESFIRGFMTAAGLQILISVLKYIFGLTIPSYTGPGSIVFTFIDICKNLPHTNIASLIFALISGAFLVLVKELNARYMHKIRFPIPTEMIVVVVATAISGGCKMPKKYHMQIVGEIQRGFPTPVSPVVSQWKDMIGTAFSLAIVSYVINLAMGRTLANKHGYDVDSNQEMIALGCSNFFGSFFKIHVICCALSVTLAVDGAGGKSQVASLCVSLVVMITMLVLGIYLYPLPKSVLGALIAVNLKNSLKQLTDPYYLWRKSKLDCCIWVVSFLSSFFLSLPYGVAVGVAFSVLVVVFQTQFRNGYALAQVMDTDIYVNPKTYNRAQDIQGIKIITYCSPLYFANSEIFRQKVIAKTGMDPQKVLLAKQKYLKKQEKRRMRPTQQRRSLFMKTKTVSLQELQQDFENAPPTDPNNNQTPANGTSVSYITFSPDSSSPAQSEPPASAEAPGEPSDMLASVPPFVTFHTLILDMSGVSFVDLMGIKALAKLSSTYGKIGVKVFLVNIHAQVYNDISHGGVFEDGSLECKHVFPSIHDAVLFAQANARDVTPGHNFQGAPGDAELSLYDSEEDIRSYWDLEQEMFGSMFHAETLTAL

SEQ ID NO: 4121 - protein, 646 aa, unidentified
MRAPGAGAASVVSLALLWLLGLPWTWSAAAALGVYVGSGGWRFLRIVCKTARRDLFGLSVLIRVRLELRRHQRAGHTIPRIFQAVVQRQPERLALVDAGTGECWTFAQLDAYSNAVANLFRQLGFAPGDVVAIFLEGRPEFVGLWLGLAKAGMEAALLNVNLRREPLAFCLGTSGAKALIFGGEMVAAVAEVSGHLGKSLIKFCSGDLGPEGILPDTHLLDPLLKEASTAPLAQIPSKGMDDRLFYIYTSGTTGLPKAAIVVHSRYYRMAAFGHHAYRMQAADVLYDCLPLYHSAGNIIGVGQCLIYGLTVVLRKKFSASRFWDDCIKYNCTVVQYIGEICRYLLKQPVREAERRHRVRLAVGNGLRPAIWEEFTERFGVRQIGEFYGATECNCSIANMDGKVGSCGFNSRILPHVYPIRLVKVNEDTMELLRDAQGLCIPCQAGEPGLLVGQINQQDPLRRFDGYVSESATSKKIAHSVFSKGDSAYLSGDVLVMDELGYMYFRDRSGDTFRWRGENVSTTEVEGVLSRLLGQTDVAVYGVAVPGVEGKAGMAAVADPHSLLDPNAIYQELQKVLAPYARPIFLRLLPQVDTTGTFKIQKTRLQREGFDPRQTSDRLFFLDLKQGHYLPLNEAVYTRICSGAFAL

SEQ ID NO: 4122 - protein, 620 aa, unidentified
MLSAIYTVLAGLLFLPLLVNLCCPYFFQDIGYFLKVAAVGRRVRSYGKRRPARTILRAFLEKARQTPHKPFLLFRDETLTYAQVDRRSNQVARALHDHLGLRQGDCVALLMGNEPAYVWLWLGLVKLGCAMACLNYNIRAKSLLHCFQCCGAKVLLVSPELQAAVEEILPSLKKDDVSIYYVSRTSNTDGIDSFLDKVDEVSTEPIPESWRSEVTFSTPALYIYTSGTTGLPKAAMITHQRIWYGTGLTFVSGLKADDVIYITLPFYHSAALLIGIHGCIVAGATLALRTKFSASQFWDDCRKYNVTVIQYIGELLRYLCNSPQKPNDRDHKVRLALGNGLRGDVWRQFVKRFGDICIYEFYAATEGNIGFMNYARKVGAVGRVNYLQKKIITYDLIKYDVEKDEPVRDENGYCVRVPKGEVGLLVCKITQLTPFNGYAGAKAQTEKKKLRDVFKKGDLYFNSGDLLMVDHENFIYFHDRVGDTFRWKGENVATTEVADTVGLVDFVQEVNVYGVHVPDHEGRIGMASIKMKENHEFDGKKLFQHIADYLPSYARPRFLRIQDTIEITGTFKHRKMTLVEEGFNPAVIKDALYFLDDTAKMYVPMTEDIYNAISAKTLKL

SEQ ID NO: 4123 - protein, 683 aa, unidentified
MAALLLLPLLLLLPLLLLKLHLWPQLRWLPADLAFAVRALCCKRALRARALAAAAADPEGPEGGCSLAWRLAELAQQRAAHTFLIHGSRRFSYSEAERESNRAARAFLRALGWDWGPDGGDSGEGSAGEGERAAPGAGDAAAGSGAEFAGGDGAARGGGAAAPLSPGATVALLLPAGPEFLWLWFGLAKAGLRTAFVPTALRRGPLLHCLRSCGARALVLAPEFLESLEPDLPALRAMGLHLWAAGPGTHPAGISDLLAEVSAEVDGPVPGYLSSPQSITDTCLYIFTSGTTGLPKAARISHLKILQCQGFYQLCGVHQEDVIYLALPLYHMSGSLLGIVGCMGIGATVVLKSKFSAGQFWEDCQQHRVTVFQYIGELCRYLVNQPPSKAERGHKVRLAVGSGLRPDTWERFVRRFGPLQVLETYGLTEGNVATINYTGQRGAVGRASWLYKHIFPFSLIRYDVTTGEPIRDPQGHCMATSPGEPGLLVAPVSQQSPFLGYAGGPELAQGKLLKDVFRPGDVFFNTGDLLVCDDQGFLRFHDRTGDTFRWKGENVATTEVAEVFEALDFLQEVNVYGVTVPGHEGRAGMAALVLRPPHALDLMQLYTHVSENLPPYARPRFLRLQESLATTETFKQQKVRMANEGFDPSTLSDPLYVLDQAVGAYLPLTTARYSALLAGNLRI

SEQ ID NO: 4124 - protein, 643 aa, unidentified
MLLGASLVGVLLFSKLVLKLPWTQVGFSLLFLYLGSGGWRFIRVFIKTIRRDIFGGLVLLKVKAKVRQCLQERRTVPILFASTVRRHPDKTALIFEGTDTHWTFRQLDEYSSSVANFLQARGLASGDVAAIFMENRNEFVGLWLGMAKLGVEAALINTNLRRDALLHCLTTSRARALVFGSEMASAICEVHASLDPSLSLFCSGSWEPGAVPPSTEHLDPLLKDAPKHLPSCPDKGFTDKLFYIYTSGTTGLPKAAIVVHSRYYRMAALVYYGFRMRPNDIVYDCLPLYHSAGNIVGIGQCLLHGMTVVIRKKFSASRFWDDCIKYNCTIVQYIGELCRYLLNQPPREAENQHQVRMALGNGLRQSIWTNFSSRFHIPQVAEFYGATECNCSLGNFDSQVGACGFNSRILSFVYPIRLVRVNEDTMELIRGPDGVCIPCQPGEPGQLVGRIIQKDPLRRFDGYLNQGANNKKIAKDVFKKGDQAYLTGDVLVMDELGYLYFRDRTGDTFRWKGENVSTTEVEGTLSRLLDMADVAVYGVEVPGTEGRAGMAAVASPTGNCDLERFAQVLEKELPLYARPIFLRLLPELHKTGTYKFQKTELRKEGFDPAIVKDPLFYLDAQKGRYVPLDQEAYSRIQAGEEKL

SEQ ID NO: 4125 - protein, 690 aa, unidentified
MGVRQQLALLLLLLLLLWGLGQPVWPVAVALTLRWLLGDPTCCVLLGLAMLARPWLGPWVPHGLSLAAAALALTLLPARLPPGLRWLPADVIFLAKILHLGLKIRGCLSRQPPDTFVDAFERRARAQPGRALLVWTGPGAGSVTFGELDARACQAAWALKAELGDPASLCAGEPTALLVLASQAVPALCMWLGLAKLGCPTAWINPHGRGMPLAHSVLSSGARVLVVDPDLRESLEEILPKLQAENIRCFYLSHTSPTPGVGALGAALDAAPSHPVPADLRAGITWRSPALFIYTSGTTGLPKPAILTHERVLQMSKMLSLSGATADDVVYTVLPLYHVMGLVVGILGCLDLGATCVLAPKFSTSCFWDDCRQHGVTVILYVGELLRYLCNIPQQPEDRTHTVRLAMGNGLRADVWETFQQRFGPIRIWEVYGSTEGNMGLVNYVGRCGALGKMSCLLRMLSPFELVQFDMEAAEPVRDNQGFCIPVGLGEPGLLLTKVVSQQPFVGYRGPRELSERKLVRNVRQSGDVYYNTGDVLAMDREGFLYFRDRLGDTFRWKGENVSTHEVEGVLSQVDFLQQVNVYGVCVPGCEGKVGMAAVQLAPGQTFDGEKLYQHVRAWLPAYATPHFIRIQDAMEVTSTFKLMKTRLVREGFNVGIVVDPLFVLDNRAQSFRPLTAEMYQAVCEGTWRL

SEQ ID NO: 4126 - protein, 619 aa, unidentified
MLLSWLTVLGAGMVVLHFLQKLLFPYFWDDFWFVLKVVLIIIRLKKYEKRGELVTVLDKFLSHAKRQPRKPFIIYEGDIYTYQDVDKRSSRVAHVFLNHSSLKKGDTVALLMSNEPDFVHVWFGLAKLGCVVAFLNTNIRSNSLLNCIRACGPRALVVGADLLGTVEEILPSLSENISVWGMKDSVPQGVISLKEKLSTSPDEPVPRSHHVVSLLKSTCLYIFTSGTTGLPKAAVISQLQVLRGSAVLWAFGCTAHDIVYITLPLYHSSAAILGISGCVELGATCVLKKKFSASQFWSDCKKYDVTVFQYIGELCRYLCKQSKREGEKDHKVRLAIGNGIRSDVWREFLDRFGNIKVCELYAATESSISFMNYTGRIGAIGRTNLFYKLLSTFDLIKYDFQKDEPMRNEQGWCIHVKKGEPGLLISRVNAKNPFFGYAGPYKHTKDKLLCDVFKKGDVYLNTGDLIVQDQDNFLYFWDRTGDTFRWKGENVATTEVADVIGMLDFIQEANVYGVAISGYEGRAGMASIILKPNTSLDLEKVYEQVVTFLPAYACPRFLRIQEKMEATGTFKLLKHQLVEDGFNPLKISEPLYFMDNLKKSYVLLTRELYDQIMLGEIKL

SEQ ID NO: 4127 - protein, 649 aa, unidentified
MENDPSRRRESISLTPVAKGLENMGADFLESLEEGQLPRSDLSPAEIRSSWSEAAPKPFSRWRNLQPALRARSFCREHMQLFRWIGTGLLCTGLSAFLLVACLLDFQRALALFVLTCVVLTFLGHRLLKRLLGPKLRRFLKPQGHPRLLLWFKRGLALAAFLGLVLWLSLDTSQRPEQLVSFAGICVFVALLFACSKHHCAVSWRAVSWGLGLQFVLGLLVIRTEPGFIAFEWLGEQIRIFLSYTKAGSSFVFGEALVKDVFAFQVLPIIVFFSCVISVLYHVGLMQWVILKIAWLMQVTMGTTATETLSVAGNIFVSQTEAPLLIRPYLADMTLSEVHVVMTGGYATIAGSLLGAYISFGIDATSLIAASVMAAPCALALSKLVYPEVEESKFRREEGVKLTYGDAQNLIEAASTGAAISVKVVANIAANLIAFLAVLDFINAALSWLGDMVDIQGLSFQLICSYILRPVAFLMGVAWEDCPVVAELLGIKLFLNEFVAYQDLSKYKQRRLAGAEEWVGDRKQWISVRAEVLTTFALCGFANFSSIGIMLGGLTSMVPQRKSDFSQIVLRALFTGACVSLVNACMAGILYMPRGAEVDCMSLLNTTLSSSSFEIYQCCREAFQSVNPEFSPEALDNCCRFYNHTICAQ

SEQ ID NO: 4128 - protein, 658 aa, unidentified
MEKASGRQSIALSTVETGTVNPGLELMEKEVEPEGSKRTDAQGHSLGDGLGPSTYQRRSRWPFSKARSFCKTHASLFKKILLGLLCLAYAAYLLAACILNFQRALALFVITCLVIFVLVHSFLKKLLGKKLTRCLKPFENSRLRLWTKWVFAGVSLVGLILWLALDTAQRPEQLIPFAGICMFILILFACSKHHSAVSWRTVFSGLGLQFVFGILVIRTDLGYTVFQWLGEQVQIFLNYTVAGSSFVFGDTLVKDVFAFQALPIIIFFGCVVSILYYLGLVQWVVQKVAWFLQITMGTTATETLAVAGNIFVGMTEAPLLIRPYLGDMTLSEIHAVMTGGFATISGTVLGAFIAFGVDASSLISASVMAAPCALASSKLAYPEVEESKFKSEEGVKLPRGKERNVLEAASNGAVDAIGLATNVAANLIAFLAVLAFINAALSWLGELVDIQGLTFQVICSYLLRPMVFMMGVEWTDCPMVAEMVGIKFFINEFVAYQQLSQYKNKRLSGMEEWIEGEKQWISVRAEIITTFSLCGFANLSSIGITLGGLTSIVPHRKSDLSKVVVRALFTGACVSLISACMAGILYVPRGAEADCVSFPNTSFTNRTYETYMCCRGLFQSTSLNGTNPPSFSGPWEDKEFSAMALTNCCGFYNNTVCA

SEQ ID NO: 4129 - protein, 691 aa, unidentified
MELRSTAAPRAEGYSNVGFQNEENFLENENTSGNNSIRSRAVQSREHTNTKQDEEQVTVEQDSPRNREHMEDDDEEMQQKGCLERRYDTVCGFCRKHKTTLRHIIWGILLAGYLVMVISACVLNFHRALPLFVITVAAIFFVVWDHLMAKYEHRIDEMLSPGRRLLNSHWFWLKWVIWSSLVLAVIFWLAFDTAKLGQQQLVSFGGLIMYIVLLFLFSKYPTRVYWRPVLWGIGLQFLLGLLILRTDPGFIAFDWLGRQVQTFLEYTDAGASFVFGEKYKDHFFAFKVLPIVVFFSTVMSMLYYLGLMQWIIRKVGWIMLVTTGSSPIESVVASGNIFVGQTESPLLVRPYLPYITKSELHAIMTAGFSTIAGSVLGAYISFGVPSSHLLTASVMSAPASLAAAKLFWPETEKPKITLKNAMKMESGDSGNLLEAATQGASSSISLVANIAVNLIAFLALLSFMNSALSWFGNMFDYPQLSFELICSYIFMPFSFMMGVEWQDSFMVARLIGYKTFFNEFVAYEHLSKWIHLRKEGGPKFVNGVQQYISIRSEIIATYALCGFANIGSLGIVIGGLTSMAPSRKRDIASGAVRALIAGTVACFMTACIAGILSSTPVDINCHHVLENAFNSTFPGNTTKVIACCQSLLSSTVAKGPGEVIPGGNHSLYSLKGCCTLLNPSTFNCNGISNTF

SEQ ID NO: 4130 - protein, 456 aa, unidentified [sequence omitted]

SEQ ID NO: 4131 - protein, 456 aa, unidentified
MARGDAPRDSYHLVGISFFILGLGTLLPWNFFITAIPYFQARLAGAGNSTARILSTNHTGPEDAFNFNNWVTLLSQLPLLLFTLLNSFLYQCVPETVRILGSLLAILLLFALTAALVKVDMSPGPFFSITMASVCFINSFSAVLQGSLFGQLGTMPSTYSTLFLSGQGLAGIFAALAMLLSMASGVDAETSALGYFITPCVGILMSIVCYLSLPHLKFARYYLANKSSQAQAQELETKAELLQSDENGIPSSPQKVALTLDLDLEKEPESEPDEPQKPGKPSVFTVFQKIWLTALCLVLVFTVTLSVFPAITAMVTSSTSPGKWSQFFNPICCFLLFNIMDWLGRSLTSYFLWPDEDSRLLPLLVCLRFLFVPLFMLCHVPQRSRLPILFPQDAYFITFMLLFAVSNGYLVSLTMCLAPRQVLPHEREVAGALMTFFLALGLSCGASLSFLFKALL

SEQ ID NO: 4132 - protein, 475 aa, unidentified
MAVVSEDDFQHSSNSTYRTTSSSLRADQEALLEKLLDRPPPGLQRPEDRFCGTYIIFFSLGIGSLLPWNFFITAKEYWMFKLRNSSSPATGEDPEGSDILNYFESYLAVASTVPSMLCLVANFLLVNRVAVHIRVLASLTVILAIFMVITALVKVDTSSWTRGFFAVTIVCMVILSGASTVFSSSIYGMTGSFPMRNSQALISGGAMGGTVSAVASLVDLAASSDVRNSALAFFLTATVFLVLCMGLYLLLSRLEYARYYMRPVLAAHVFSGEEELPQDSLSAPSVASRFIDSHTPPLRPILKKTASLGFCVTYVFFITSLIYPAICTNIESLNKGSGSLWTTKFFIPLTTFLLYNFADLCGRQLTAWIQVPGPNSKALPGFVLLRTCLIPLFVLCNYQPRVHLKTVVFQSDVYPALLSSLLGLSNGYLSTLALLYGPKIVPRELAEATGVVMSFYVCLGLTLGSACSTLLVHLI

SEQ ID NO: 4133 - protein, 530 aa, unidentified
MGSVGSQRLEEPSVAGTPDPGVVMSFTFDSHQLEEAAEAAQGQGLRARGVPAFTDTTLDEPVPDDRYHAIYFAMLLAGVGFLLPYNSFITDVDYLHHKYPGTSIVFDMSLTYILVALAAVLLNNVLVERLTLHTRITAGYLLALGPLLFISICDVWLQLFSRDQAYAINLAAVGTVAFGCTVQQSSFYGYTGMLPKRYTQGVMTGESTAGVMISLSRILTKLLLPDERASTLIFFLVSVALELLCFLLHLLVRRSRFVLFYTTRPRDSHRGRPGLGRGYGYRVHHDVVAGDVHFEHPAPALAPNESPKDSPAHEVTGSGGAYMRFDVPRPRVQRSWPTFRALLLHRYVVARVIWADMLSIAVTYFITLCLFPGLESEIRHCILGEWLPILIMAVFNLSDFVGKILAALPVDWRGTHLLACSCLRVVFIPLFILCVYPSGMPALRHPAWPCIFSLLMGISNGYFGSVPMILAAGKVSPKQRELAGNTMTVSYMSGLTLGSAVAYCTYSLTRDAHGSCLHASTANGSILAGL

SEQ ID NO: 4134 - protein, 492 aa, unidentified
MEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTALRGALGTLHQLGIVVGILIAQVFGLDSIMGNKDLWPLLLSIIFIPALLQCIVLPFCPESPRFLLINRNEENRAKSVLKKLRGTADVTHDLQEMKEESRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAILMTIALALLEQLPWMSYLSIVAIFGFVAFFEVGPGPIPWFIVAELFSQGPRPAAIAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 4135 - protein, 541 aa, unidentified
MGHSPPVLPLCASVSLLGGLTFGYELAVISGALLPLQLDFGLSCLEQEFLVGSLLLGALLASLVGGFLIDCYGRKQAILGSNLVLLAGSLTLGLAGSLAWLVLGRAVVGFAISLSSMACCIYVSELVGPRQRGVLVSLYEAGITVGILLSYALNYALAGTPWGWRHMFGWATAPAVLQSLSLLFLPAGTDETATHKDLIPLQGGEAPKLGPGRPRYSFLDLFRARDNMRGRTTVGLGLVLFQQLTGQPNVLCYASTIFSSVGFHGGSSAVLASVGLGAVKVAATLTAMGLVDRAGRRALLLAGCALMALSVSGIGLVSFAVPMDSGPSCLAVPNATGQTGLPGDSGLLQDSSLPPIPRTNEDQREPILSTAKKTKPHPRSGDPSAPPRLALSSALPGPPLPARGHALLRWTALLCLMVFVSAFSFGFGPVTWLVLSEIYPVEIRGRAFAFCNSFNWAANLFISLSFLDLIGTIGLSWTFLLYGLTAVLGLGFIYLFVPETKGQSLAEIDQQFQKRRFTLSFGHRQNSTGIPYSRIEISAAS

SEQ ID NO: 4136 - protein, 496 aa, unidentified
MRALRRLIQGRILLLTICAAGIGGTFQFGYNLSIINAPTLHIQEFTNETWQARTGEPLPDHLVLLMWSLIVSLYPLGGLFGALLAGPLAITLGRKKSLLVNNIFVVSAAILFGFSRKAGSFEMIMLGRLLVGVNAGVSMNIQPMYLGESAPKELRGAVAMSSAIFTALGIVMGQVVGLRELLGGPQAWPLLLASCLVPGALQLASLPLLPESPRYLLIDCGDTEACLAALRRLRGSGDLAGELEELEEERAACQGCRARRPWELFQHRALRRQVTSLVVLGSAMELCGNDSVYAYASSVFRKAGVPEAKIQYAIIGTGSCELLTAVVSCVVIERVGRRVLLIGGYSLMTCWGSIFTVALCLQSSFPWTLYLAMACIFAFILSFGIGPAGVTGILATELFDQMARPAACMVCGALMWIMLILVGLGFPFIMEALSHFLYVPFLGVCVCGAIYTGLFLPETKGKTFQEISKELHRLNFPRRAQGPTWRSLEVIQSTEL

SEQ ID NO: 4137 - protein, 617 aa, unidentified
MVPVENTEGPSLLNQKGTAVETEGSGSRHPPWARGCGMFTFLSSVTAAVSGLLVGYELGIISGALLQIKTLLALSCHEQEMVVSSLVIGALLASLTGGVLIDRYGRRTAIILSSCLLGLGSLVLILSLSYTVLIVGRIAIGVSISLSSIATCVYIAEIAPQHRRGLLVSLNELMIVIGILSAYISNYAFANVFHGWKYMFGLVIPLGVLQAIAMYFLPPSPRFLVMKGQEGAASKVLGRLRALSDTTEELTVIKSSLKDEYQYSFWDLFRSKDNMRTRIMIGLTLVFFVQITGQPNILFYASTVLKSVGFQSNEAASLASTGVGVVKVISTIPATLLVDHVGSKTFLCIGSSVMAASLVTMGIVNLNIHMNFTHICRSHNSINQSLDESVIYGPGNLSTNNNTLRDHFKGISSHSRSSLMPLRNDVDKRGETTSASLLNAGLSHTEYQIVTDPGDVPAFLKWLSLASLLVYVAAFSIGLGPMPWLVLSEIFPGGIRGRAMALTSSMNWGINLLISLTFLTVTDLIGLPWVCFIYTIMSLASLLFVVMFIPETKGCSLEQISMELAKVNYVKNNICFMSHHQEELVPKQPQKRKPQEQLLECNKLCGRGQSRQLSPET

SEQ ID NO: 4138 - protein, 648 aa, unidentified
MSRKASENVEYTLRSLSSLMGERRRKQPEPDAASAAGECSLLAAAESSTSLQSAGAGGGGVGDLERAARRQFQQDETPAFVYVVAVFSALGGFLFGYDTGVVSGAMLLLKRQLSLDALWQELLVSSTVGAAAVSALAGGALNGVFGRRAAILLASALFTAGSAVLAAANNKETLLAGRLVVGLGIGIASMTVPVYIAEVSPPNLRGRLVTINTLFITGGQFFASVVDGAFSYLQKDGWRYMLGLAAVPAVIQFFGFLFLPESPRWLIQKGQTQKARRILSQMRGNQTIDEEYDSIKNNIEEEEKEVGSAGPVICRMLSYPPTRRALIVGCGLQMFQQLSGINTIMYYSATILQMSGVEDDRLAIWLASVTAFTNFIFTLVGVWLVEKVGRRKLTFGSLAGTTVALIILALGFVLSAQVSPRITFKPIAPSGQNATCTRYSYCNECMLDPDCGFCYKMNKSTVIDSSCVPVNKASTNEAAWGRCENETKFKTEDIFWAYNFCPTPYSWTALLGLILYLVFFAPGMGPMPWTVNSEIYPLWARSTGNACSSGINWIFNVLVSLTFLHTAEYLTYYGAFFLYAGFAAVGLLFIYGCLPETKGKKLEEIESLFDNRLCTCGTSDSDEGRYIEYIRVKGSNYHLSDNDASDVE

SEQ ID NO: 4139 - protein, 520 aa, unidentified
MEFHNGGHVSGIGGFLVSLTSRMKPHTLAVTPALIFAITVATIGSFQFGYNTGVINAPETIIKEFINKTLTDKANAPPSEVLLTNLWSLSVAIFSVGGMIGSFSVGLFVNRFGRRNSMLIVNLLAATGGCLMGLCKIAESVEMLILGRLVIGLFCGLCTGFVPMYIGEISPTALRGAFGTLNQLGIVIGILVAQIFGLELILGSEELWPVLLGFTILPAILQSAALPCCPESPRFLLINRKKEENATRILQRLWGTQDVSQDIQEMKDESARMSQEKQVTVLELFRVSSYRQPIIISIVLQLSQQLSGINAVFYYSTGIFKDAGVQQPIYATISAGVVNTIFTLLSLFLVERAGRRTLHMIGLGGMAFCSTLMTVSLLLKNHYNGMSFVCIGAILVFVACFEIGPGPIPWFIVAELFSQGPRPAAMAVAGCSNWTSNFLVGLLFPSAAYYLGAYVFIIFTGFLITFLAFTFFKVPETRGRTFEDITRAFEGQAHGADRSGKDGVMGMNSIEPAKETTTNV

SEQ ID NO: 4140 - protein, 524 aa, unidentified
MTEDKVTGTLVFTVITAVLGSFQFGYDIGVINAPQQVIISHYRHVLGVPLDDRKAINNYVINSTDELPTISYSMNPKPTPWAEEETVAAAQLITMLWSLSVSSFAVGGMTASFFGGWLGDTLGRIKAMLVANILSLVGALLMGFSKLGPSHILIIAGRSISGLYCGLISGLVPMYIGEIAPTALRGALGTFHQLAIVTGILISQIIGLEFILGNYDLWHILLGLSGVRAILQSLLLFFCPESPRYLYIKLDEEVKAKQSLKRLRGYDDVTKDINEMRKEREEASSEQKVSIIQLFTNSSYRQPILVALMLHVAQQFSGINGIFYYSTSIFQTAGISKPVYATIGVGAVNMVFTAVSVFLVEKAGRRSLFLIGMSGMFVCAIFMSVGLVLLNKFSWMSYVSMIAIFLFVSFFEIGPGPIPWFMVAEFFSQGPRPAALAIAAFSNWTCNFIVALCFQYIADFCGPYVFFLFAGVLLAFTLFTFFKVPETKGKSFEEIAAEFQKKSGSAHRPKAAVEMKFLGATETV

SEQ ID NO: 4141 - protein, 496 aa, unidentified
MGTQKVTPALIFAITVATIGSFQFGYNTGVINAPEKIIKEFINKTLTDKGNAPPSEVLLTSLWSLSVAIFSVGGMIGSFSVGLFVNRFGRRNSMLIVNLLAVTGGCFMGLCKVAKSVEMLILGRLVIGLFCGLCTGFVPMYIGEISPTALRGAFGTLNQLGIVVGILVAQIFGLEFILGSEELWPLLLGFTILPAILQSAALPFCPESPRFLLINRKEEENAKQILQRLWGTQDVSQDIQEMKDESARMSQEKQVTVLELFRVSSYRQPIIISIVLQLSQQLSGINAVFYYSTGIFKDAGVQEPIYATIGAGVVNTIFTVVSLFLVERAGRRTLHMIGLGGMAFCSTLMTVSLLLKDNYNGMSFVCIGAILVFVAFFEIGPGPIPWFIVAELFSQGPRPAAMAVAGCSNWTSNFLVGLLFPSAAHYLGAYVFIIFTGFLITFLAFTFFKVPETRGRTFEDITRAFEGQAHGADRSGKDGVMEMNSIEPAKETTTNV

SEQ ID NO: 4142 - protein, 509 aa, unidentified
MPSGFQQIGSEDGEPPQQRVTGTLVLAVFSAVLGSLQFGYNIGVINAPQKVIEQSYNETWLGRQGPEGPSSIPPGTLTTLWALSVAIFSVGGMISSFLIGIISQWLGRKRAMLVNNVLAVLGGSLMGLANAAASYEMLILGRFLIGAYSGLTSGLVPMYVGEIAPTHLRGALGTLNQLAIVIGILIAQVLGLESLLGTASLWPLLLGLTVLPALLQLVLLPFCPESPRYLYIIQNLEGPARKSLKRLTGWADVSGVLAELKDEKRKLERERPLSLLQLLGSRTHRQPLIIAVVLQLSQQLSGINAVFYYSTSIFETAGVGQPAYATIGAGVVNTVFTLVSVLLVERAGRRTLHLLGLAGMCGCAILMTVALLLLERVPAMSYVSIVAIFGFVAFFEIGPGPIPWFIVAELFSQGPRPAAMAVAGFSNWTSNFIIGMGFQYVAEAMGPYVFLLFAVLLLGFFIFTFLRVPETRGRTFDQISAAFHRTPSLLEQEVKPSTELEYLGPDEND

SEQ ID NO: 4143 - protein, 501 aa, unidentified
MEQQDQSMKEGRLTLVLALATLIAAFGSSFQYGYNVAAVNSPALLMQQFYNETYYGRTGEFMEDFPLTLLWSVTVSMFPFGGFIGSLLVGPLVNKFGRKGALLFNNIFSIVPAILMGCSRVATSFELIIISRLLVGICAGVSSNVVPMYLGELAPKNLRGALGVVPQLFITVGILVAQIFGLRNLLANVDGWPILLGLTGVPAALQLLLLPFFPESPRYLLIQKKDEAAAKKALQTLRGWDSVDREVAEIRQEDEAEKAAGFISVLKLFRMRSLRWQLLSIIVLMGGQQLSGVNAIYYYADQIYLSAGVPEEHVQYVTAGTGAVNVVMTFCAVFVVELLGRRLLLLLGFSICLIACCVLTAALALQDTVSWMPYISIVCVISYVIGHALGPSPIPALLITEIFLQSSRPSAFMVGGSVHWLSNFTVGLIFPFIQEGLGPYSFIVFAVICLLTTIYIFLIVPETKAKTFIEINQIFTKMNKVSEVYPEKEELKELPPVTSEQ

SEQ ID NO: 4144 - protein, 507 aa, unidentified
MQEPLLGAEGPDYDTFPEKPPPSPGDRARVGTLQNKRVFLATFAAVLGNFSFGYALVYTSPVIPALERSLDPDLHLTKSQASWFGSVFTLGAAAGGLSAMILNDLLGRKLSIMFSAVPSAAGYALMAGAHGLWMLLLGRTLTGFAGGLTAACIPVYVSEIAPPGVRGALGATPQLMAVFGSLSLYALGLLLPWRWLAVAGEAPVLIMILLLSFMPNSPRFLLSRGRDEEALRALAWLRGTDVDVHWEFEQIQDNVRRQSSRVSWAEARAPHVCRPITVALLMRLLQQLTGITPILVYLQSIFDSTAVLLPPKDDAAIVGAVRLLSVLIAALTMDLAGRKVLLFVSAAIMFAANLTLGLYIHFGPRPLSPNSTAGLESESWGDLAQPLAAPAGYLTLVPLLATMLFIMGYAVGWGPITWLLMSEVLPLRARGVASGLCVLASWLTAFVLTKSFLPVVSTFGLQVPFFFFAAICLVSLVFTGCCVPETKGRSLEQIESFFRTGRRSFLR

SEQ ID NO: 4145 - protein, 512 aa, unidentified
MENKEAGTPPPIPSREGRLQPTLLLATLSAAFGSAFQYGYNLSVVNTPHKVFKSFYNETYFERHATFMDGKLMLLLWSCTVSMFPLGGLLGSLLVGLLVDSCGRKGTLLINNIFAIIPAILMGVSKVAKAFELIVFSRVVLGVCAGISYSALPMYLGELAPKNLRGMVGTMTEVFVIVGVFLAQIFSLQAILGNPAGWPVLLALTGVPALLQLLTLPFFPESPRYSLIQKGDEATARQALRRLRGHTDMEAELEDMRAEARAERAEGHLSVLHLCALRSLRWQLLSIIVLMAGQQLSGINAINYYADTIYTSAGVEAAHSQYVTVGSGVVNIVMTITSAVLVERLGRRHLLLAGYGICGSACLVLTVVLLFQNRVPELSYLGIICVFAYIAGHSIGPSPVPSVVRTEIFLQSSRRAAFMVDGAVHWLTNFIIGFLFPSIQEAIGAYSFIIFAGICLLTAIYIYVVIPETKGKTFVEINRIFAKRNRVKLPEEKEETIDAGPPTASPAKETSF

SEQ ID NO: 4146 - protein, 477 aa, unidentified
MTPEDPEETQPLLGPPGGSAPRGRRVFLAAFAAALGPLSFGFALGYSSPAIPSLQRAAPPAPRLDDAAASWFGAVVTLGAAAGGVLGGWLVDRAGRKLSLLLCSVPFVAGFAVITAAQDVWMLLGGRLLTGLACGVASLVAPVYISEIAYPAVRGLLGSCVQLMVVVGILLAYLAGWVLEWRWLAVLGCVPPSLMLLLMCFMPETPRFLLTQHRRQEAMAALRFLWGSEQGWEDPPIGAEQSFHLALLRQPGIYKPFIIGVSLMAFQQLSGVNAVMFYAETIFEEAKFKDSSLASVVVGVIQVLFTAVAALIMDRAGRRLLLVLSGVVMVFSTSAFGAYFKLTQGGPGNSSHVAISAPVSAQPVDASVGLAWLAVGSMCLFIAGFAVGWGPIPWLLMSEIFPLHVKGVATGICVLTNWLMAFLVTKEFSSLMEVLRPYGAFWLASAFCIFSVLFTLFCVPETKGKTLEQITAHFEGR

SEQ ID NO: 4147 - protein, 540 aa, unidentified
MARKQNRNSKELGLVPLTDDTSHAGPPGPGRALLECDHLRSGVPGGRRRKDWSCSLLVASLAGAFGSSFLYGYNLSVVNAPTPYIKAFYNESWERRHGRPIDPDTLTLLWSVTVSIFAIGGLVGTLIVKMIGKVLGRKHTLLANNGFAISAALLMACSLQAGAFEMLIVGRFIMGIDGGVALSVLPMYLSEISPKEIRGSLGQVTAIFICIGVFTGQLLGLPELLGKESTWPYLFGVIVVPAVVQLLSLPFLPDSPRYLLLEKHNEARAVKAFQTFLGKADVSQEVEEVLAESRVQRSIRLVSVLELLRAPYVRWQVVTVIVTMACYQLCGLNAIWFYTNSIFGKAGIPPAKIPYVTLSTGGIETLAAVFSGLVIEHLGRRPLLIGGFGLMGLFFGTLTITLTLQDHAPWVPYLSIVGILAIIASFCSGPGGIPFILTGEFFQQSQRPAAFIIAGTVNWLSNFAVGLLFPFIQKSLDTYCFLVFATICITGAIYLYFVLPETKNRTYAEISQAFSKRNKAYPPEEKIDSAVTDGKINGRP

SEQ ID NO: 4148 - protein, 507 aa, unidentified
MGCWGRNRGRLLCMLALTFMFMVLEVVVSRVTSSLAMLSDSFHMLSDVLALVVALVAERFARRTHATQKNTFGWIRAEVMGALVNAIFLTGLCFAILLEAIERFIEPHEMQQPLVVLGVGVAGLLVNVLGLCLFHHHSGFSQDSGHGHSHGGHGHGHGLPKGPRVKSTRPGSSDINVAPGEQGPDQEETNTLVANTSNSNGLKLDPADPENPRSGDTVEVQVNGNLVREPDHMELEEDRAGQLNMRGVFLHVLGDALGSVIVVVNALVFYFSWKGCSEGDFCVNPCFPDPCKAFVEIINSTHASVYEAGPCWVLYLDPTLCVVMVCILLYTTYPLLKESALILLQTVPKQIDIRNLIKELRNVEGVEEVHELHVWQLAGSRIIATAHIKCEDPTSYMEVAKTIKDVFHNHGIHATTIQPEFASVGSKSSVVPCELACRTQCALKQCCGTLPQAPSGKDAEKTPAVSISCLELSNNLEKKPRRTKAENIPAVVIEIKNMPNKQPESSL

SEQ ID NO: 4149 - protein, 485 aa, unidentified
MGRYSGKTCRLLFMLVLTVAFFVAELVSGYLGNSIALLSDSFNMLSDLISLCVGLSAGYIARRPTRGFSATYGYARAEVVGALSNAVFLTALCFTIFVEAVLRLARPERIDDPELVLIVGVLGLLVNVVGLLIFQDCAAWFACCLRGRSRRLQQRQQLAEGCVPGAFGGPQGAEDPRRAADPTAPGSDSAVTLRGTSVERKREKGATVFANVAGDSFNTQNEPEDMMKKEKKSEALNIRGVLLHVMGDALGSVVVVITAIIFYVLPLKSEDPCNWQCYIDPSLTVLMVIIILSSAFPLIKETAAILLQMVPKGVNMEELMSKLSAVPGISSVHEVHIWELVSGKIIATLHIKYPKDRGYQDASTKIREIFHHAGIHNVTIQFENVDLKEPLEQKDLLLLCNSPCISKGCAKQLCCPPGALPLAHVNGCAEHNGGPSLDTYGSDGLSRRDAREVAIEVSLDSCLSDHGQSLNKTQEDQCYVNRTHF

SEQ ID NO: 4150 - protein, 323 aa, unidentified
MEAKEKQHLLDARPAIRSYTGSLWQEGAGWIPLPRPGLDLQAIELAAQSNHHCHAQKGPDSHCDPKKGKAQRQLYVASAICLLFMIGEVVEILGALVSVLSIWVVTGVLVYLAVERLISGDYEIDGGTMLITSGCAVAVNIIMGLTLHQSGHGHSHGTTNQQEENPSVRAAFIHVIGDFMQSMGVLVAAYILYFKPEYKYVDPICTFVFSILVLGTTLTILRDVILVLMEGTPKGVDFTAVRDLLLSVEGVEALHSLHIWALTVAQPVLSVHIAIAQNTDAQAVLKTASSRLQGKFHFHTVTIQIEDYSEDMKDCQACQGPSD

SEQ ID NO: 4151 - protein, 388 aa, unidentified
MEPSPAAGGLETTRLVSPRDRGGAGGSLRLKSLFTEPSEPLPEESKPVEMPFHHCHRDPLPPPGLTPERLHARRQLYAACAVCFVFMAGEVVGGYLAHSLAIMTDAAHLLADVGSMMGSLFSLWLSTRPATRTMTFGWHRSETLGALASVVSLWMVTGILLYLAFVRLLHSDYHIEGGAMLLTASIAVCANLLMAFVLHQAGPPHSHGSRGAEYAPLEEGPEEPLPLGNTSVRAAFVHVLGDLLQSFGVLAASILIYFKPQYKAADPISTFLFSICALGSTAPTLRDVLRILMEGTPRNVGFEPVRDTLLSVPGVRATHELHLWALTLTYHVASAHLAIDSTADPEAVLAEASSRLYSRFGFSSCTLQVEQYQPEMAQCLRCQEPPQA

SEQ ID NO: 4152 - protein, 429 aa, unidentified
MAGSGAWKRLKSMLRKDDAPLFLNDTSAFDFSDEAGDEGLSRFNKLRVVVADDGSEAPERPVNGAHPTLQADDDSLLDQDLPLTNSQLSLKVDSCDNCSKQREILKQRKVKARLTIAAVLYLLFMIGELVGGYIANSLAIMTDALHMLTDLSAIILTLLALWLSSKSPTKRFTFGFHRLEVLSAMISVLLVYILMGFLLYEAVQRTIHMNYEINGDIMLITAAVGVAVNVIMGFLLNQSGHRHSHSHSLPSNSPTRGSGCERNHGQDSLAVRAAFVHALGDLVQSVGVLIAAYIIRFKPEYKIADPICTYVFSLLVAFTTFRIIWDTVVIILEGVPSHLNVDYIKEALMKIEDVYSVEDLNIWSLTSGKSTAIVHIQLIPGSSSKWEEVQSKANHLLLNTFGMYRCTIQLQSYRQEVDRTCANCQSSSP

SEQ ID NO: 4153 - protein, 765 aa, unidentified
MEEKYGGDVLAGPGGGGGLGPVDVPSARLTKYIVLLCFTKFLKAVGLFESYDLLKAVHIVQFIFILKLGTAFFMVLFQKPFSSGKTITKHQWIKIFKHAVAGCIISLLWFFGLTLCGPLRTLLLFEHSDIVVISLLSVLFTSSGGGPAKTRGAAFFIIAVICLLLFDNDDLMAKMAEHPEGHHDSALTHMLYTAIAFLGVADHKGGVLLLVLALCCKVGFHTASRKLSVDVGGAKRLQALSHLVSVLLLCPWVIVLSVTTESKVESWFSLIMPFATVIFFVMILDFYVDSICSVKMEVSKCARYGSFPIFISALLFGNFWTHPITDQLRAMNKAAHQESTEHVLSGGVVVSAIFFILSANILSSPSKRGQKGTLIGYSPEGTPLYNFMGDAFQHSSQSIPRFIKESLKQILEESDSRQIFYFLCLNLLFTFVELFYGVLTNSLGLISDGFHMLFDCSALVMGLFAALMSRWKATRIFSYGYGRIEILSGFINGLFLIVIAFFVFMESVARLIDPPELDTHMLTPVSVGGLIVNLIGICAFSHAHSHAHGASQGSCHSSDHSHSHHMHGHSDHGHGHSHGSAGGGMNANMRGVFLHVLADTLGSIGVIVSTVLIEQFGWFIADPLCSLFIAILIFLSVVPLIKDACQVLLLRLPPEYEKELHIALEKIQKIEGLISYRDPHFWRHSASIVAGTIHIQVTSDVLEQRIVQQVTGILKDAGVNNLTIQVEKEAYFQHMSGLSTGFHDVLAMTKQMESMKYCKDGTYIM

SEQ ID NO: 4154 - protein, 461 aa, unidentified
MGTIHLFRKPQRSFFGKLLREFRLVAADRRSWKILLFGVINLICTGFLLMWCSSTNSIALTAYTYLTIFDLFSLMTCLISYWVTLRKPSPVYSFGFERLEVLAVFASTVLAQLGALFILKESAERFLEQPEIHTGRLLVGTFVALCFNLFTMLSIRNKPFAYVSEAASTSWLQEHVADLSRSLCGIIPGLSSIFLPRMNPFVLIDLAGAFALCITYMLIEINNYFAVDTASAIAIALMTFGTMYPMSVYSGKVLLQTTPPHVIGQLDKLIREVSTLDGVLEVRNEHFWTLGFGSLAGSVHVRIRRDANEQMVLAHVTNRLYTLVSTLTVQIFKDDWIRPALLSGPVAANVLNFSDHHVIPMPLLKGTDDLNPVTSTPAKPSSPPPEFSFNTPGKNVNPVILLNTQTRPYGFGLNHGHTPYSSMLNQGLGVPGIGATQGLRTGFTNIPSRYGTNNRIGQPRP

SEQ ID NO: 4155 - protein, 376 aa, unidentified
MLPLSIKDDEYKPPKFNLFGKISGWFRSILSDKTSRNLFFFLCLNLSFAFVELLYGIWSNCLGLISDSFHMFFDSTAILAGLAASVISKWRDNDAFSYGYVRAEVLAGFVNGLFLIFTAFFIFSEGVERALAPPDVHHERLLLVSILGFVVNLIGIFVFKHGGHGHSHGSGHGHSHSLFNGALDQAHGHVDHCHSHEVKHGAAHSHDHAHGHGHFHSHDGPSLKETTGPSRQILQGVFLHILADTLGSIGVIASAIMMQNFGLMIADPICSILIAILIVVSVIPLLRESVGILMQRTPPLLENSLPQCYQRVQQLQGVYSLQEQHFWTLCSDVYVGTLKLIVAPDADARWILSQTHNIFTQAGVRQLYVQIDFAAM

SEQ ID NO: 4156 - protein, 369 aa, unidentified
MEFLERTYLVNDKAAKMYAFTLESVELQQKPVNKDQCPRERPEELESGGMYHCHSGSKPTEKGANEYAYAKWKLCSASAICFIFMIAEVVGGHIAGSLAVVTDAAHLLIDLTSFLLSLFSLWLSSKPPSKRLTFGWHRAEILGALLSILCIWVVTGVLVYLACERLLYPDYQIQATVMIIVSSCAVAANIVLTVVLHQRCLGHNHKEVQANASVRAAFVHALGDLFQSISVLISALIIYFKPEYKIADPICTFIFSILVLASTITILKDFSILLMEGVPKSLNYSGVKELILAVDGVLSVHSLHIWSLTMNQVILSAHVATAASRDSQVVRREIAKALSKSFTMHSLTIQMESPVDQDPDCLFCEDPCD

SEQ ID NO: 4157 - protein, 568 aa, unidentified
MLPGLAAAAAHRCSWSSLCRLRLRCRAAACNPSDRQEWQNLVTFGSFSNMVPCSHPYIGTLSQVKLYSTNVQKEGQGSQTLRVEKVPSFETAEGIGTELKAPLKQEPLQVRVKAVLKKREYGSKYTQNNFITGVRAINEFCLKSSDLEQLRKIRRRSPHEDTESFTVYLRSDVEAKSLEVWGSPEALAREKKLRKEAEIEYRERLFRNQKILREYRDFLGNTKPRSRTASVFFKGPGKVVMVAICINGLNCFFKFLAWIYTGSASMFSEAIHSLSDTCNQGLLALGISKSVQTPDPSHPYGFSNMRYISSLISGVGIFMMGAGLSWYHGVMGLLHPQPIESLLWAYCILAGSLVSEGATLLVAVNELRRNARAKGMSFYKYVMESRDPSTNVILLEDTAAVLGVIIAATCMGLTSITGNPLYDSLGSLGVGTLLGMVSAFLIYTNTEALLGRSIQPEQVQRLTELLENDPSVRAIHDVKATDLGLGKVRFKAEVDFDGRVVTRSYLEKQDFDQMLQEIQEVKTPEELETFMLKHGENIIDTLGAEVDRLEKELKKRNPEVRHVDLEIL

SEQ ID NO: 4158 - protein, 190 aa, unidentified
MDHSHHMGMSYMDSNSTMQPSHHHPTTSASHSHGGGDSSMMMMPMTFYFGFKNVELLFSGLVINTAGEMAGAFVAVFLLAMFYEGLKIARESLLRKSQVSIRYNSMPVPGPNGTILMETHKTVGQQMLSFPHLLQTVLHIIQVVISYFLMLIFMTYNGYLCIAVAAGAGTGYFLFSWKKAVVVDITEHCH

SEQ ID NO: 4159 - protein, 143 aa, unidentified
MAMHFIFSDTAVLLFDFWSVHSPAGMALSVLVLLLLAVLYEGIKVGKAKLLNQVLVNLPTSISQQTIAETDGDSAGSDSFPVGRTHHRWYLCHFGQSLIHVIQVVIGYFIMLAVMSYNTWIFLGVVLGSAVGYYLAYPLLSTA

SEQ ID NO: 4160 - protein, 525 aa, unidentified
MATLLRSKLSNVATSVSNKSQAKMSGMFARMGFQAATDEEAVGFAHCDDLDFEHRQGLQMDILKAEGEPCGDEGAEAPVEGDIHYQRGSGAPLPPSGSKDQVGGGGEFGGHDKPKITAWEAGWNVTNAIQGMFVLGLPYAILHGGYLGLFLIIFAAVVCCYTGKILIACLYEENEDGEVVRVRDSYVAIANACCAPRFPTLGGRVVNVAQIIELVMTCILYVVVSGNLMYNSFPGLPVSQKSWSIIATAVLLPCAFLKNLKAVSKFSLLCTLAHFVINILVIAYCLSRARDWAWEKVKFYIDVKKFPISIGIIVFSYTSQIFLPSLEGNMQQPSEFHCMMNWTHIAACVLKGLFALVAYLTWADETKEVITDNLPGSIRAVVNIFLVAKALLSYPLPFFAAVEVLEKSLFQEGSRAFFPACYSGDGRLKSWGLTLRCALVVFTLLMAIYVPHFALLMGLTGSLTGAGLCFLLPSLFHLRLLWRKLLWHQVFFDVAIFVIGGICSVSGFVHSLEGLIEAYRTNAED

SEQ ID NO: 4161 - protein, 549 aa, unidentified
MSPTISHKDSSRQRRPGNFSHSLDMKSGPLPPGGWDDSHLDSAGREGDREALLGDTGTGDFLKAPQSFRAELSSILLLLFLYVLQGIPLGLAGSIPLILQSKNVSYTDQAFFSFVFWPFSLKLLWAPLVDAVYVKNFGRRKSWLVPTQYILGLFMIYLSTQVDRLLGNTDDRTPDVIALTVAFFLFEFLAATQDIAVDGWALTMLSRENVGYASTCNSVGQTAGYFLGNVLFLALESADFCNKYLRFQPQPRGIVTLSDFLFFWGTVFLITTTLVALLKKENEVSVVKEETQGITDTYKLLFAIIKMPAVLTFCLLILTAKIGFSAADAVTGLKLVEEGVPKEHLALLAVPMVPLQIILPLIISKYTAGPQPLNTFYKAMPYRLLLGLEYALLVWWTPKVEHQGGFPIYYYIVVLLSYALHQVTVYSMYVSIMAFNAKVSDPLIGGTYMTLLNTVSNLGGNWPSTVALWLVDPLTVKECVGASNQNCRTPDAVELCKKLGGSCVTALDGYYVESIICVFIGFGWWFFLGPKFKKLQDEGSSSWKCKRNN

SEQ ID NO: 4162 - protein, 639 aa, unidentified
MLSYGERLGSPAVSPLPVRGGHVMRGTAFAYVPSPQVLHRIPGTSAYAFPSLGPVALAEHTCPCGEVLERHEPLPAKLALEEEQKPESRLVPKLRQAGAMLLKVPLMLTFLYLFVCSLDMLSSAFQLAGGKVAGDIFKDNAILSNPVAGLVVGILVTVLVQSSSTSTSIIVSMVSSGLLEVSSAIPIIMGSNIGTSVTNTIVALMQAGDRTDFRRAFAGATVHDCFNWLSVLVLLPLEAATGYLHHITRLVVASFNIHGGRDAPDLLKIITEPFTKLIIQLDESVITSIATGDESLRNHSLIQIWCHPDSLQAPTSMSRAEANSSQTLGNATMEKCNHIFVDTGLPDLAVGLILLAGSLVLLCTCLILLVKMLNSLLKGQVAKVIQKVINTDFPAPFTWVTGYFAMVVGASMTFVVQSSSVFTSAITPLIGLGVISIERAYPLTLGSNIGTTTTAILAALASPREKLSSAFQIALCHFFFNISGILLWYPVPCTRLPIRMAKALGKRTAKYRWFAVLYLLVCFLLLPSLVFGISMAGWQVMVGVGTPFGALLAFVVLINVLQSRSPGHLPKWLQTWDFLPRWMHSLKPLDHLITRATLCCARPEPRSPPLPPRVFLEELPPATPSPRLALPAHHNATRL

SEQ ID NO: 4163 - protein, 690 aa, unidentified
MAPWPELGDAQPNPDKYLEGAAGQQPTAPDKSKETNKTDNTEAPVTKIELLPSYSTATLIDEPTEVDDPWNLPTLQDSGIKWSERDTKGKILCFFQGIGRLILLLGFLYFFVCSLDILSSAFQLVGGKMAGQFFSNSSIMSNPLLGLVIGVLVTVLVQSSSTSTSIVVSMVSSSLLTVRAAIPIIMGANIGTSITNTIVALMQVGDRSEFRRAFAGATVHDFFNWLSVLVLLPVEVATHYLEIITQLIVESFHFKNGEDAPDLLKVITKPFTKLIVQLDKKVISQIAMNDEKAKNKSLVKIWCKTFTNKTQINVTVPSTANCTSPSLCWTDGIQNWTMKNVTYKENIAKCQHIFVNFHLPDLAVGTILLILSLLVLCGCLIMIVKILGSVLKGQVATVIKKTINTDFPFPFAWLTGYLAILVGAGMTFIVQSSSVFTSALTPLIGIGVITIERAYPLTLGSNIGTTTTAILAALASPGNALRSSLQIALCHFFFNISGILLWYPIPFTRLPIRMAKGLGNISAKYRWFAVFYLIIFFFLIPLTVFGLSLAGWRVLVGVGVPVVFIIILVLCLRLLQSRCPRVLPKKLQNWNFLPLWMRSLKPWDAVVSKFTGCFQMRCCCCCRVCCRACCLLCDCPKCCRCSKCCEDLEEAQEGQDVPVKAPETFDNITISREAQGEVPASDSKTECTAL

SEQ ID NO: 4164 - protein, 599 aa, unidentified
MPSSLPGSQVPHPTLDAVDLVEKTLRNEGTSSSAPVLEEGDTDPWTLPQLKDTSQPWKELRVAGRLRRVAGSVLKACGLLGSLYFFICSLDVLSSAFQLLGSKVAGDIFKDNVVLSNPVAGLVIGVLVTALVQSSSTSSSIVVSMVAAKLLTVRVSVPIIMGVNVGTSITSTLVSMAQSGDRDEFQRAFSGSAVHGIFNWLTVLVLLPLESATALLERLSELALGAASLTPRAQAPDILKVLTKPLTHLIVQLDSDMIMSSATGNATNSSLIKHWCGTTGQPTQENSSCGAFGPCTEKNSTAPADRLPCRHLFAGTELTDLAVGCILLAGSLLVLCGCLVLIVKLLNSVLRGRVAQVVRTVINADFPFPLGWLGGYLAVLAGAGLTFALQSSSVFTAAVVPLMGVGVISLDRAYPLLLGSNIGTTTTALLAALASPADRMLSALQVALIHFFFNLAGILLWYLVPALRLPIPLARHFGVVTARYRWVAGVYLLLGFLLLPLAAFGLSLAGGMELAAVGGPLVGLVLLVILVTVLQRRRPAWLPVRLRSWAWLPVWLHSLEPWDRLVTRCCPCNVCSPPKATTKEAYCYENPEILASQQL

SEQ ID NO: 4165 - protein, 337 aa, unidentified
MAAPRDNVTLLFKLYCLAVMTLMAAVYTIALRYTRTSDKELYFSTTAVCITEVIKLLLSVGILAKETGSLGRFKASLRENVLGSPKELLKLSVPSLVYAVQNNMAFLALSNLDAAVYQVTYQLKIPCTALCTVLMLNRTLSKLQWVSVFMLCAGVTLVQWKPAQATKVVVEQNPLLGFGAIAIAVLCSGFAGVYFEKVLKSSDTSLWVRNIQMYLSGIIVTLAGVYLSDGAEIKEKGFFYGYTYYVWFVIFLASVGGLYTSVVVKYTDNIMKGFSAAAAIVLSTIASVMLFGLQITLTFALGTLLVCVSIYLYGLPRQDTTSIQQGETASKERVIGV

SEQ ID NO: 4166 - protein, 396 aa, unidentified
MAAVGAGGSTAAPGPGAVSAGALEPGTASAAHRRLKYISLAVLVVQNASLILSIRYARTLPGDRFFATTAVVMAEVLKGLTCLLLLFAQKRGNVKHLVLFLHEAVLVQYVDTLKLAVPSLIYTLQNNLQYVAISNLPAATFQVTYQLKILTTALFSVLMLNRSLSRLQWASLLLLFTGVAIVQAQQAGGGGPRPLDQNPGAGLAAVVASCLSSGFAGVYFEKILKGSSGSVWLRNLQLGLFGTALGLVGLWWAEGTAVATRGFFFGYTPAVWGVVLNQAFGGLLVAVVVKYADNILKGFATSLSIVLSTVASIRLFGFHVDPLFALGAGLVIGAVYLYSLPRGAAKAIASASASASGPCVHQQPPGQPPPPQLSSHRGDLITEPFLPKLLTKVKGS

SEQ ID NO: 4167 - protein, 324 aa, unidentified
MSVEDGGMPGLGRPRQARWTLMLLLSTAMYGAHAPLLALCHVDGRVPFRPSSAVLLTELTKLLLCAFSLLVGWQAWPQGPPPWRQAAPFALSALLYGANNNLVIYLQRYMDPSTYQVLSNLKIGSTAVLYCLCLRHRLSVRQGLALLLLMAAGACYAAGGLQVPGNTLPSPPPAAAASPMPLHITPLGLLLLILYCLISGLSSVYTELLMKRQRLPLALQNLFLYTFGVLLNLGLHAGGGSGPGLLEGFSGWAALVVLSQALNGLLMSAVMKHGSSITRLFVVSCSLVVNAVLSAVLLRLQLTAAFFLATLLIGLAMRLYYGSR

SEQ ID NO: 4168 - protein, 424 aa, unidentified
MEKQCCSHPVICSLSTMYTFLLGAIFIALSSSRILLVKYSANEENKYDYLPTTVNVCSELVKLVFCVLVSFCVIKKDHQSRNLKYASWKEFSDFMKWSIPAFLYFLDNLIVFYVLSYLQPAMAVIFSNFSIITTALLFRIVLKRRLNWIQWASLLTLFLSIVALTAGTKTLQHNLAGRGFHHDAFFSPSNSCLLFRSECPRKDNCTAKEWTFPEAKWNTTARVFSHIRLGMGHVLIIVQCFISSMANIYNEKILKEGNQLTESIFIQNSKLYFFGILFNGLTLGLQRSNRDQIKNCGFFYGHSAFSVALIFVTAFQGLSVAFILKFLDNMFHVLMAQVTTVIITTVSVLVFDFRPSLEFFLEAPSVLLSIFIYNASKPQVPEYAPRQERIRDLSGNLWERSSGDGEELERLTKPKSDESDEDTF

SEQ ID NO: 4169 - protein, 322 aa, unidentified
MASSSSLVPDRLRLPLCFLGVFVCYFYYGILQEKITRGKYGEGAKQETFTFALTLVFIQCVINAVFAKILIQFFDTARVDRTRSWLYAACSISYLGAMVSSNSALQFVNYPTQVLGKSCKPIPVMLLGVTLLKKKYPLAKYLCVLLIVAGVALFMYKPKKVVGIEEHTVGYGELLLLLSLTLDGLTGVSQDHMRAHYQTGSNHMMLNINLWSTLLLGMGILFTGELWEFLSFAERYPAIIYNILLFGLTSALGQSFIFMTVVYFGPLTCSIITTTRKFFTILASVILFANPISPMQWVGTVLVFLGLGLDAKFGKGAKKTSH

SEQ ID NO: 4170 - protein, 432 aa, unidentified
MDARWWAVVVLAAFPSLGAGGETPEAPPESWTQLWFFRFVVNAAGYASFMVPGYLLVQYFRRKNYLETGRGLCFPLVKACVFGNEPKASDEVPLAPRTEAAETTPMWQALKLLFCATGLQVSYLTWGVLQERVMTRSYGATATSPGERFTDSQFLVLMNRVLALIVAGLSCVLCKQPRHGAPMYRYSFASLSNVLSSWCQYEALKFVSFPTQVLAKASKVIPVMLMGKLVSRRSYEHWEYLTATLISIGVSMFLLSSGPEPRSSPATTLSGLILLAGYIAFDSFTSNWQDALFAYKMSSVQMMFGVNFFSCLFTVGSLLEQGALLEGTRFMGRHSEFAAHALLLSICSACGQLFIFYTIGQFGAAVFTIIMTLRQAFAILLSCLLYGHTVTVVGGLGVAVVFAALLLRVYARGRLKQRGKKAVPVESPVQKV

SEQ ID NO: 4171 - protein, 401 aa, unidentified
MDLTQQAKDIQNITVQETNKNNSESIECSKITMDLKFNNSRKYISITVPSKTQTMSPHIKSVDDVVVLGMNLSKFNKLTQFFICVAGVFVFYLIYGYLQELIFSVEGFKSCGWYLTLVQFAFYSIFGLIELQLIQDKRRRIPGKTYMIIAFLTVGTMGLSNTSLGYLNYPTQVIFKCCKLIPVMLGGVFIQGKRYNVADVSAAICMSLGLIWFTLADSTTAPNFNLTGVVLISLALCADAVIGNVQEKAMKLHNASNSEMVLYSYSIGFVYILLGLTCTSGLGPAVTFCAKNPVRTYGYAFLFSLTGYFGISFVLALIKIFGALIAVTVTTGRKAMTIVLSFIFFAKPFTFQYVWSGLLVVLGIFLNVYSKNMDKIRLPSLYDLINKSVEARKSRTLAQTV

SEQ ID NO: 4172 - protein, 331 aa, unidentified
MRPALAVGLVFAGCCSNVIFLELLARKHPGCGNIVTFAQFLFIAVEGFLFEADLGRKPPAIPIRYYAIMVTMFFTVSVVNNYALNLNIAMPLHMIFRSGSLIANMILGIIILKKRYSIFKYTSIALVSVGIFICTFMSAKQVTSQSSLSENDGFQAFVWWLLGIGALTFALLMSARMGIFQETLYKRFGKHSKEALFYNHALPLPGFVFLASDIYDHAVLFNKSELYEIPVIGVTLPIMWFYLLMNIITQYVCIRGVFILTTECASLTVTLVVTLRKFVSLIFSILYFQNPFTLWHWLGTLFVFIGTLMYTEVWNNLGTTKSEPQKDSKKN

SEQ ID NO: 4173 - protein, 364 aa, unidentified
MNRAPLKRSRILHMALTGASDPSAEAEANGEKPFLLRALQIALVVSLYWVTSISMVFLNKYLLDSPSLRLDTPIFVTFYQCLVTTLLCKGLSALAACCPGAVDFPSLRLDLRVARSVLPLSVVFIGMITFNNLCLKYVGVAFYNVGRSLTTVFNVLLSYLLLKQTTSFYALLTCGIIIGGFWLGVDQEGAEGTLSWLGTVFGVLASLCVSLNAIYTTKVLPAVDGSIWRLTFYNNVNACILFLPLLLLLGELQALRDFAQLGSAHFWGMMTLGGLFGFAIGYVTGLQIKFTSPLTHNVSGTAKACAQTVLAVLYYEETKSFLWWTSNMMVLGGSSAYTWVRGWEMKKTPEEPSPKDSEKSAMGV

SEQ ID NO: 4174 - protein, 365 aa, unidentified
MGRWALDVAFLWKAVLTLGLVLLYYCFSIGITFYNKWLTKSFHFPLFMTMLHLAVIFLFSALSRALVQCSSHRARVVLSWADYLRRVAPTALATALDVGLSNWSFLYVTVSLYTMTKSSAVLFILIFSLIFKLEELRAALVLVVLLIAGGLFMFTYKSTQFNVEGFALVLGASFIGGIRWTLTQMLLQKAELGLQNPIDTMFHLQPLMFLGLFPLFAVFEGLHLSTSEKIFRFQDTGLLLRVLGSLFLGGILAFGLGFSEFLLVSRTSSLTLSIAGIFKEVCTLLLAAHLLGDQISLLNWLGFALCLSGISLHVALKALHSRGDGGPKALKGLGSSPDLELLLRSSQREEGDNEEEEYFVAQGQQ

SEQ ID NO: 4175 - protein, 355 aa, unidentified
MAEVHRRQHARVKGEAPAKSSTLRDEEELGMASAETLTVFLKLLAAGFYGVSSFLIVVVNKSVLTNYRFPSSLCVGLGQMVATVAVLWVGKALRVVKFPDLDRNVPRKTFPLPLLYFGNQITGLFSTKKLNLPMFTVLRRFSILFTMFAEGVLLKKTFSWGIKMTVFAMIIGAFVAASSDLAFDLEGYAFILINDVLTAANGAYVKQKLDSKELGKYGLLYYNALFMILPTLAIAYFTGDAQKAVEFEGWADTLFLLQFTLSCVMGFILMYATVLCTQYNSALTTTIVGCIKNILITYIGMVFGGDYIFTWTNFIGLNISIAGSLVYSYITFTEEQLSKQSEANNKLDIKGKGAV

SEQ ID NO: 4176 - protein, 337 aa, unidentified
MTAGGQAEAEGAGGEPGAARLPSRVARLLSALFYGTCSFLIVLVNKALLTTYGFPSPIFLGIGQMAATIMILYVSKLNKIIHFPDFDKKIPVKLFPLPLLYVGNHISGLSSTSKLSLPMFTVLRKFTIPLTLLLETIILGKQYSLNIILSVFAIILGAFIAAGSDLAFNLEGYIFVFLNDIFTAANGVYTKQKMDPKELGKYGVLFYNACFMIIPTLIISVSTGDLQQATEFNQWKNVVFILQFLLSCFLGFLLMYSTVLCSYYNSALTTAVVGAIKNVSVAYIGILIGGDYIFSLLNFVGLNICMAGGLRYSFLTLSSQLKPKPVGEENICLDLKS

SEQ ID NO: 4177 - protein, 416 aa, unidentified
MRQLCRGRVLGISVAIAHGVFSGSLNILLKFLISRYQFSFLTLVQCLTSSTAALSLELLRRLGLIAVPPFGLSLARSFAGVAVLSTLQSSLTLWSLRGLSLPMYVVFKRCLPLVTMLIGVLVLKNGAPSPGVLAAVLITTCGAALAGAGDLTGDPIGYVTGVLAVLVHAAYLVLIQKASADTEHGPLTAQYVIAVSATPLLVICSFASTDSIHAWTFPGWKDPAMVCIFVACILIGCAMNFTTLHCTYINSAVTTSFVGVVKSIATITVGMVAFSDVEPTSLFIAGVVVNTLGSIIYCVAKFMETRKQSNYEDLEAQPRGEEAQLSGDQLPFVMEELPGEGGNGRSEGGEAAGGPAQESRQEVRGSPRGVPLVAGSSEEGSRRSLKDAYLEVWRLVRGTRYMKKDYLIENEELPSP

SEQ ID NO: 4178 - protein, 410 aa, unidentified
MAAAAVGAGHGAGGPGAASSSGGAREGARVAALCLLWYALSAGGNVVNKVILSAFPFPVTVSLCHILALCAGLPPLLRAWRVPPAPPVSGPGPSPHPSSGPLLPPRFYPRYVLPLAFGKYFASVSAHVSIWKVPVSYAHTVKATMPIWVVLLSRIIMKEKQSTKVYLSLIPIISGVLLATVTELSFDMWGLVSALAATLCFSLQNIFSKKVLRDSRIHHLRLLNILGCHAVFFMIPTWVLVDLSAFLVSSDLTYVYQWPWTLLLLAVSGFCNFAQNVIAFSILNLVSPLSYSVANATKRIMVITVSLIMLRNPVTSTNVLGMMTAILGVFLYNKTKYDANQQARKHLLPVTTADLSSKERHRSPLEKPHNGLLFPQHGDYQYGRNNILTDHFQYSRQSYPNSYSLNRYDV

SEQ ID NO: 4179 - protein, 266 aa, unidentified
MSSSVKTPALEELVPGSEEKPKGRSPLSWGSLFGHRSEKIVFAKSDGGTDENVLTVTITETTVIESDLGVWSSRALLYLTLWFFFSFCTLFLNKYILSLLGGEPSMLGAVQMLSTTVIGCVKTLVPCCLYQHKARLSYPPNFLMTMLFVGLMRFATVVLGLVSLKNVAVSFAETVKSSAPIFTVIMSRMILGEYTGRPSDREEREELQLQPGRGAAASDRRSPVPPSERHGVRPHGENLPGDFQVPQALHRVALSMALPCPMLPAS

SEQ ID NO: 4180 - protein, 405 aa, unidentified
MSSSVKTPALEELVPGSEEKPKGRSPLSWGSLFGHRSEKIVFAKSDGGTDENVLTVTITETTVIESDLGVWSSRALLYLTLWFFFSFCTLFLNKYILSLLGGEPSMLGAVQMLSTTVIGCVKTLVPCCLYQHKARLSYPPNFLMTMLFVGLMRFATVVLGLVSLKNVAVSFAETVKSSAPIFTVIMSRMILGEYTGLLVNLSLIPVMGGLALCTATEISFNVLGFSAALSTNIMDCLQNVFSKKLLSGDKYRFSAPELQFYTSAAAVAMLVPARVFFTDVPVIGRSGKSFSYNQDVVLLLLTDGVLFHLQSVTAYALMGKISPVTFSVASTVKHALSIWLSVIVFGNKITSLSAVGTALVTVGVLLYNKARQHQQEALQSLAAATGRAPDDTVEPLLPQDPRQHP

SEQ ID NO: 4181 - protein, 313 aa, unidentified
MALLVDRVRGHWRIAAGLLFNLLVSICIVFLNKWIYVYHGFPNMSLTLVHFVVTWLGLYICQKLDIFAPKSLPPSRLLLLALSFCGFVVFTNLSLQNNTIGTYQLAKAMTTPVIIAIQTFCYQKTFSTRIQLTLIPITLGVILNSYYDVKFNFLGMVFAALGVLVTSLYQVWVGAKQHELQVNSMQLLYYQAPMSSAMLLVAVPFFEPVFGEGGIFGPWSVSALLMVLLSGVIAFMVNLSIYWIIGNTSPVTYNMFGHFKFCITLFGGYVLFKDPLSINQALGILCTLFGILAYTHFKLSEQEGSRSKLAQRP

SEQ ID NO: 4182 - protein, 350 aa, unidentified
MCRCPPEHHDGRMTSAEVGAAAGGAQAAGPPEWPPGSPQALRQPGRARVAMAALVWLLAGASMSSLNKWIFTVHGFGRPLLLSALHMLVAALACHRGARRPMPGGTRCRVLLLSLTFGTSMACGNVGLRAVPLDLAQLVTTTTPLFTLALSALLLGRRHHPLQLAAMGPLCLGAACSLAGEFRTPPTGCGFLLAATCLRGLKSVQQSALLQEERLDAVTLLYATSLPSFCLLAGAALVLEAGVAPPPTAGDSRLWACILLSCLLSVLYNLASFSLLALTSALTVHVLGNLTVVGNLILSRLLFGSRLSALSYVGIALTLSGMFLYHNCEFVASWAARRGLWRRDQPSKGL

SEQ ID NO: 4183 - protein, 408 aa, unidentified
MIPPEQPQQQLQPPSPAPPNHVVTTIENLPAEGSGGGGSLSASSRAGVRQRIRKVLNREMLISVALGQVLSLLICGIGLTSKYLSEDFHANTPVFQSFLNYILLFLVYTTTLAVRQGEENLLAILRRRWWKYMILGLIDLEANYLVVKAYQYTTLTSIQLLDCFVIPVVILLSWFFLLIRYKAVHFIGIVVCILGMGCMVGADVLVGRHQGAGENKLVGDLLVLGGATLYGISNVWEEYIIRTLSRVEFLGMIGLFGAFFSGIQLAIMEHKELLKVPWDWQIGLLYVGFSACMFGLYSFMPVVIKKTSATSVNLSLLTADLYSLFCGLFLFHYKFSGLYLLSFFTILIGLVLYSSTSTYIAQDPRVYKQFRNPSGPVVDLPTTAQVEPSVTYTSLGQETEEEPHVRVA

SEQ ID NO: 4184 - protein, 374 aa, unidentified
MEADSPAGPGAPEPLAEGAAAEFSSLLRRIKGKLFTWNILKTIALGQMLSLCICGTAITSQYLAERYKVNTPMLQSFINYCLLFLIYTVMLAFRSGSDNLLVILKRKWWKYILLGLADVEANYVIVRAYQYTTLTSVQLLDCFGIPVLMALSWFILHARYRVIHFIAVAVCLLGVGTMVGADILAGREDNSGSDVLIGDILVLLGASLYAISNVCEEYIVKKLSRQEFLGMVGLFGTIISGIQLLIVEYKDIASIHWDWKIALLFVAFALCMFCLYSFMPLVIKVTSATSVNLGILTADLYSLFVGLFLFGYKFSGLYILSFTVIMVGFILYCSTPTRTAEPAESSVPPVTSIGIDNLGLKLEENLQETHSAVL

SEQ ID NO: 4185 - protein, 421 aa, unidentified
MKKHSARVAPLSACNSPVLTLTKVEGEERPRDSPGPAEAQAPAGVEAGGRASRRCWTCSRAQLKKIFWGVAVVLCVCSSWAGSTQLAKLTFRKFDAPFTLTWFATNWNFLFFPLYYVGHVCKSTEKQSVKQRYRECCRFFGDNGLTLKVFFTKAAPFGVLWTLTNYLYLHAIKKINTTDVSVLFCCNKAFVFLLSWIVLRDRFMGVRIVAAILAIAGIVMMTYADGFHSHSVIGIALVVASASMSALYKVLFKLLLGSAKFGEAALFLSILGVFNILFITCIPIILYFTKVEYWSSFDDIPWGNLCGFSVLLLTFNIVLNFGIAVTYPTLMSLGIVLSIPVNAVIDHYTSQIVFNGVRVIAIIIIGLGFLLLLLPEEWDVWLIKLLTRLKVRKKEEPAEGAADLSSGPQSKNRRARPSFAR

SEQ ID NO: 4186 - protein, 521 aa, unidentified
MDELLLDLFHKLTSGRQLAAGNGLCGISHKEQEVWKPGHNILVKMRKEDKSLVWLIHSTLARYTQVTNFLGTSRSSVTRCKPGANCPSSHSGISRQLSPLSVTEDSSAPILELQNQGSSGVCGHRVERQNRSADDGTQTHSENSSQENRIKARCLSCTSMVLKGIWGLLIILSVSSSWVGTTQIVKITYKNFYCPFFMTWFSTNWNIMFFPVYYSGHLATAQEKQSPMKKFRECSRIFGEDGLTLKLFLKRTAPFSILWTLTNYLYLLALKKLTATDVSALFCCNKAFVFLLSWIVLKDRFMGVRIVAAIMAITGIVMMAYADNFHADSIIGVAFAVGSASTSALYKVLFKMFLGSANFGEAAHFVSTLGFFNLIFISFTPVILYFTKVEHWSSFAALPWGCLCGMAGLWLAFNILVNVGVVLTYPILISIGTVLSVPGNAAVDLLKQEVIFNVVRLAATIIICIGFLLMLLPEEWDEITLRFINSLKEKKSEEHVDDVTDPSIHLRGRGRANGTVSIPLA

SEQ ID NO: 4187 - protein, 523 aa, unidentified
MVPPRRHRGAGRPGVLSSSPPFRLRSAKFSGIALEDLRRALKTRLQMVCVFVMNRMNSQNSGFTQRRRMALGIVILLLVDVIWVASSELTSYVFTQYNKPFFSTFAKTSMFVLYLLGFIIWKPWRQQCTRGLRGKHAAFFADAEGYFAACTTDTTMNSSLSEPLYVPVKFHDLPSEKPESTNIDTEKTPKKSRVRFSNIMEIRQLPSSHALEAKLSRMSYPVKEQESILKTVGKLTATQVAKISFFFCFVWFLANLSYQEALSDTQVAIVNILSSTSGLFTLILAAVFPSNSGDRFTLSKLLAVILSIGGVVLVNLAGSEKPAGRDTVGSIWSLAGAMLYAVYIVMIKRKVDREDKLDIPMFFGFVGLFNLLLLWPGFFLLHYTGFEDFEFPNKVVLMCIIINGLIGTVLSEFLWLWGCFLTSSLIGTLALSLTIPLSIIADMCMQKVQFSWLFFAGAIPVFFSFFIVTLLCHYNNWDPVMVGIRRIFAFICRKHRIQRVPEDSEQCESLISMHSVSQEDGAS

SEQ ID NO: 4188 - protein, 371 aa, unidentified
MAWTKYQLFLAGLMLVTGSINTLSAKWADNFMAEGCGGSKEHSFQHPFLQAVGMFLGEFSCLAAFYLLRCRAAGQSDSSVDPQQPFNPLLFLPPALCDMTGTSLMYVALNMTSASSFQMLRGAVIIFTGLFSVAFLGRRLVLSQWLGILATIAGLVVVGLADLLSKHDSQHKLSEVITGDLLIIMAQIIVAIQMVLEEKFVYKHNVHPLRAVGTEGLFGFVILSLLLVPMYYIPAGSFSGNPRGTLEDALDAFCQVGQQPLIAVALLGNISSIAFFNFAGISVTKELSATTRMVLDSLRTVVIWALSLALGWEAFHALQILGFLILLIGTALYNGLHRPLLGRLSRGRPLAEESEQERLLGGTRTPINDAS

SEQ ID NO: 4189 - protein, 365 aa, unidentified
MRPQDSTGVAELQEPGLPLTDDAPPGATEEPAAAEAAGAPDRGRCWLCLSSPCCSRTEPEAKKKAPCPGLGLFYTLLSAFLFSVGSLFVKKVQDVHAVEISAFRCVFQMLVVIPCLIYRKTGFIGPKGQRIFLILRGVLGSTAMMLIYYAYQTMSLADATVITFSSPVFTSIFAWICLKEKYSPWDALFTVFTITGVILIVRPPFLFGSDTSGMEESYSGHLKGTFAAIGSAVFAASTLVILRKMGKSVDYFLSIWYYVVLGLVESVIILSVLGEWSLPYCGLDRLFLIFIGLFGLGGQIFITKALQIEKAGPVAIMKTMDVVFAFIFQIIFFNNVPTWWTVGGALCVVASNVGAAIRKWYQSSK

SEQ ID NO: 4190 - protein, 412 aa, unidentified
MDTSPSRKYPVKKRVKIHPNTVMVKYTSHYPQPGDDGYEEINEGYGNFMEENPKKGLLSEMKKKGRAFFGTMDTLPPPTEDPMINEIGQFQSFAEKNIFQSRKMWIVLFGSALAHGCVALITRLVSDRSKVPSLELIFIRSVFQVLSVLVVCYYQEAPFGPSGYRLRLFFYGVCNVISITCAYTSFSIVPPSNGTTMWRATTTVFSAILAFLLVDEKMAYVDMATVVCSILGVCLVMIPNIVDEDNSLLNAWKEAFGYTMTVMAGLTTALSMIVYRSIKEKISMWTALFTFGWTGTIWGISTMFILQEPIIPLDGETWSYLIAICVCSTAAFLGVYYALDKFHPALVSTVQHLEIVVAMVLQLLVLHIFPSIYDVFGGVIIMISVFVLAGYKLYWRNLRKQDYQEILDSPIK

SEQ ID NO: 4191 - protein, 338 aa, unidentified
MAGSHPYFNQPDSTHPSPPSAPPSLRWYQRCQPSDATSGLLVALLGGGLPAGFVGPLSRMAYQASNLPSLELLIWRCLFHLPIALLLKLRGDPLLGTPDIRSRAFFCALLNILSIGCAYSAVQVVPAGNAATVRKGSSTVCSAVLTLCLESQGLSGYDWCGLLGCILGLIIIVGPGLWTLQEGTTGVYTALGYVEAFLGGLALSLRLLVYRSLHFPPCLPTVAFLSGLVGLLGSVPGLFVLQAPVLPSDLLSWSCVGAVGILALVSFTCVGYAVTKAHPALVCAVLHSEVVVALILQYYMLHETVAPSDIVAAGVVLGSIAIITAQNLSCERTGRVEE

SEQ ID NO: 4192 - protein, 338 aa, unidentified
MAGSHPYFNLPDSTHPSPPSAPPSLRWHQRCQPSGATNGLLVALLGGGLPAGFVGPLSRMAYQGSNLPSLELLICRCLFHLPIALLLKLRGDPLLGPPDIRGWACFCALLNVLSIGCAYSAVQVVPAGNAATVRKGSSTVCSAVLTLCLESQGLGGYEWCGLLGSILGLIIILGPGLWTLQEGTTGVYTTLGYVQAFLGGLALSLGLLVYRSLHFPSCLPTVAFLSGLVGLLGCVPGLFVLQTPVLPSDLLSWSCVGAEGILALVSFTCVGYAVTKAHPALVCAVLHSEVVVALILQYYMLHETVALSDIMGAGVVLGSIAIITARNLSCERTGKVEE

SEQ ID NO: 4193 - protein, 338 aa, unidentified
MAGSHPYLNPPDSTHPSPPSAPPSLRWHQCCQPSDATNGLLVALLGGGLPAGFVGPLSHMAYQASNLPSLELLICRCLFHLPIALLLKLRGDPLLGPPDIRGRAYFYALLNVLSIGCAYSAVQVVPAGNAATVRKGSSTVCSAVLTLCLESQGLSGYDWCGLLGSILGLIIIVGPGLWTLQEGITGVYTALGYGQAFVGGLALSLGLLVYRSLHFPSCLPTVAFLSGLVGLLGSVPGLFVLQPPVLPSDLPSWSCVGAVGILALVSFTCVSYAVTKAHPALVCAVLHSEVVVALILQYYMLHETVAPSDIVGAGVVLGSIAIITAWNLSCEREGKVEE

SEQ ID NO: 4194 - protein, 476 aa, unidentified
MSTQRLRNEDYHDYSSTDVSPEESPSEGLNNLSSPGSYQRFGQSNSTTWFQTLIHLLKGNIGTGLLGLPLAVKNAGIVMGPISLLIIGIVAVHCMGILVKCAHHFCRRLNKSFVDYGDTVMYGLESSPCSWLRNHAHWGRRVVDFFLIVTQLGFCCVYFVFLADNFKQVIEAANGTTNNCHNNETVILTPTMDSRLYMLSFLPFLVLLVFIRNLRALSIFSLLANITMLVSLVMIYQFIVQRIPDPSHLPLVAPWKTYPLFFGTAIFSFEGIGMVLPLENKMKDPRKFPLILYLGMVIVTILYISLGCLGYLQFGANIQGSITLNLPNCWLYQSVKLLYSIGIFFTYALQFYVPAEIIIPFFVSRAPEHCELVVDLFVRTVLVCLTCILAILIPRLDLVISLVGSVSSSALALIIPPLLEVTTFYSEGMSPLTIFKDALISILGFVGFVVGTYEALYELIQPSNAPIFINSTCAFI

SEQ ID NO: 4195 - protein, 483 aa, unidentified
MSVTKSTEGPQGAVAIKLDLMSPPESAKKLENKDSTFLDESPSESAGLKKTKGITVFQALIHLVKGNMGTGILGLPLAVKNAGILMGPLSLLVMGFIACHCMHILVKCAQRFCKRLNKPFMDYGDTVMHGLEANPNAWLQNHAHWGRHIVSFFLIITQLGFCCVYIVFLADNLKQVVEAVNSTTNNCYSNETVILTPTMDSRLYMLSFLPFLVLLVLIRNLRILTIFSMLANISMLVSLVIIIQYITQEIPDPSRLPLVASWKTYPLFFGTAIFSFESIGVVLPLENKMKNARHFPAILSLGMSIVTSLYIGMAALGYLRFGDDIKASISLNLPNCWLYQSVKLLYIAGILCTYALQFYVPAEIIIPFAISRVSTRWALPLDLSIRLVMVCLTCLLAILIPRLDLVISLVGSVSGTALALIIPPLLEVTTFYSEGMSPLTIFKDALISILGFVGFVVGTYQALDELLKSEDSHPFSNSTTFVR

SEQ ID NO: 4196 - protein, 470 aa, unidentified
MSLLGRDYNSELNSLDNGPQSPSESSSSITSENVHPAGEAGLSMMQTLIHLLKCNIGTGLLGLPLAIKNAGLLVGPVSLLAIGVLTVHCMVILLNCAQHLSQRLQKTFVNYGEATMYGLETCPNTWLRAHAVWGRYTVSFLLVITQLGFCSVYFMFMADNLQQMVEKAHVTSNICQPREILTLTPILDIRFYMLIILPFLILLVFIQNLKVLSVFSTLANITTLGSMALIFEYIMEGIPYPSNLPLMANWKTFLLFFGTAIFTFEGVGMVLPLKNQMKHPQQFSFVLYLGMSIVIILYILLGTLGYMKFGSDTQASITLNLPNCWLYQSVKLMYSIGIFFTYALQFHVPAEIIIPFAISQVSESWALFVDLSVRSALVCLTCVSAILIPRLDLVISLVGSVSSSALALIIPALLEIVIFYSEDMSCVTIAKDIMISIVGLLGCIFGTYQALYELPQPISHSMANSTGVHA

SEQ ID NO: 4197 - protein, 504 aa, unidentified
MEAAATPAAAGAARREELDMDVMRPLINEQNFDGTSDEEHEQELLPVQKHYQLDDQEGISFVQTLMHLLKGNIGTGLLGLPLAIKNAGIVLGPISLVFIGIISVHCMHILVRCSHFLCLRFKKSTLGYSDTVSFAMEVSPWSCLQKQAAWGRSVVDFFLVITQLGFCSVYIVFLAENVKQVHEGFLESKVFISNSTNSSNPCERRSVDLRIYMLCFLPFIILLVFIRELKNLFVLSFLANVSMAVSLVIIYQYVVRNMPDPHNLPIVAGWKKYPLFFGTAVFAFEGIGVVLPLENQMKESKRFPQALNIGMGIVTTLYVTLATLGYMCFHDEIKGSITLNLPQDVWLYQSVKILYSFGIFVTYSIQFYVPAEIIIPGITSKFHTKWKQICEFGIRSFLVSITCAGAILIPRLDIVISFVGAVSSSTLALILPPLVEILTFSKEHYNIWMVLKNISIAFTGVVGFLLGTYITVEEIIYPTPKVVAGTPQSPFLNLNSTCLTSGLK

SEQ ID NO: 4198 - protein, 533 aa, unidentified
MARLPAGIRFIISFSRDQWYRAFIFILTFLLYASFHLSRKPISIVKGELHKYCTAWDEADVRFSSQNRKSGSAAPHQLPDNETDCGWAPFDKNNYQQLLGALDYSFLCAYAVGMYLSGIIGERLPIRYYLTFGMLASGAFTALFGLGYFYNIHSFGFYVVTQVINGLVQTTGWPSVVTCLGNWFGKGRRGLIMGVWNSHTSVGNILGSLIAGYWVSTCWGLSFVVPGAIVAAMGIVCFLFLIEHPNDVRCSSTLVTHSKGYENGTNRLRLQKQILKSEKNKPLDPEMQCLLLSDGKGSIHPNHVVILPGDGGSGTAAISFTGALKIPGVIEFSLCLLFAKLVSYTFLFWLPLYITNVDHLDAKKAGELSTLFDVGGIFGGILAGVISDRLEKRASTCGLMLLLAAPTLYIFSTVSKMGLEATIAMLLLSGALVSGPYTLITTAVSADLGTHKSLKGNAHALSTVTAIIDGTGSVGAALGPLLAGLLSPSGWSNVFYMLMFADACALLFLIRLIHKELSCPGSATGDQVPFKEQ

SEQ ID NO: 4199 - protein, 501 aa, unidentified
MRSSLAPGVWFFRAFSRDSWFRGLILLLTFLIYACYHMSRKPISIVKSRLHQNCSEQIKPINDTHSLNDTMWCSWAPFDKDNYKELLGGVDNAFLIAYAIGMFISGVFGERLPLRYYLSAGMLLSGLFTSLFGLGYFWNIHELWYFVVIQVCNGLVQTTGWPSVVTCVGNWFGKGKRGFIMGIWNSHTSVGNILGSLIAGIWVNGQWGLSFIVPGIITAVMGVITFLFLIEHPEDVDCAPPQHHGEPAENQDNPEDPGNSPCSIRESGLETVAKCSKGPCEEPAAISFFGALRIPGVVEFSLCLLFAKLVSYTFLYWLPLYIANVAHFSAKEAGDLSTLFDVGGIIGGIVAGLVSDYTNGRATTCCVMLILAAPMMFLYNYIGQDGIASSIVMLIICGGLVNGPYALITTAVSADLGTHKSLKGNAKALSTVTAIIDGTGSIGAALGPLLAGLISPTGWNNVFYMLISADVLACLLLCRLVYKEILAWKVSLSRGSGYKEI

SEQ ID NO: 4200 - protein, 494 aa, unidentified
MAWPNVFQRGSLLSQFSHHHVVVFLLTFFSYSLLHASRKTFSNVKVSISEQWTPSAFNTSVELPVEIWSSNHLFPSAEKATLFLGTLDTIFLFSYAVGLFISGIVGDRLNLRWVLSFGMCSSALVVFVFGALTEWLRFYNKWLYCCLWIVNGLLQSTGWPCVVAVMGNWFGKAGRGVVFGLWSACASVGNILGACLASSVLQYGYEYAFLVTASVQFAGGIVIFFGLLVSPEEIGLSGIEAEENFEEDSHRPLINGGENEDEYEPNYSIQDDSSVAQVKAISFYQACCLPGVIPYSLAYACLKLVNYSFFFWLPFYLSNNFGWKEAEADKLSIWYDVGGIIGGTLQGFISDVLQKRAPVLALSLLLAVGSLIGYSRSPNDKSINALLMTVTGFFIGGPSNMISSAISADLGRQELIQRSSEALATVTGIVDGSGSIGAAVGQYLVSLIRDKLGWMWVFYFFILMTSCTIVFISPLIVREIFSLVLRRQAHILRE

SEQ ID NO: 4201 - protein, 487 aa, unidentified
MMHFKSGLELTELQNMTVPEDDNISNDSNDFTEVENGQINSKFISDRESRRSLTNSHLEKKKCDEYIPGTTSLGMSVFNLSNAIMGSGILGLAFALANTGILLFLVLLTSVTLLSIYSINLLLICSKETGCMVYEKLGEQVFGTTGKFVIFGATSLQNTGAMLSYLFIVKNELPSAIKFLMGKEETFSAWYVDGRVLVVIVTFGIILPLCLLKNLGYLGYTSGFSLSCMVFFLIVVIYKKFQIPCIVPELNSTISANSTNADTCTPKYVTFNSKTVYALPTIAFAFVCHPSVLPIYSELKDRSQKKMQMVSNISFFAMFVMYFLTAIFGYLTFYDNVQSDLLHKYQSKDDILILTVRLAVIVAVILTVPVLFFTVRSSLFELAKKTKFNLCRHTVVTCILLVVINLLVIFIPSMKDIFGVVGVTSANMLIFILPSSLYLKITDQDGDKGTQRIWAALFLGLGVLFSLVSIPLVIYDWACSSSSDEGH

SEQ ID NO: 4202 - protein, 1119 aa, unidentified
MTAAAASNWGLITNIVNSIVGVSVLTMPFCFKQCGIVLGALLLVFCSWMTHQSCMFLVKSASLSKRRTYAGLAFHAYGKAGKMLVETSMIGLMLGTCIAFYVVIGDLGSNFFARLFGFQVGGTFRMFLLFAVSLCIVLPLSLQRNMMASIQSFSAMALLFYTVFMFVIVLSSLKHGLFSGQWLRRVSYVRWEGVFRCIPIFGMSFACQSQVLPTYDSLDEPSVKTMSSIFASSLNVVTTFYVMVGFFGYVSFTEATAGNVLMHFPSNLVTEMLRVGFMMSVAVGFPMMILPCRQALSTLLCEQQQKDGTFAAGGYMPPLRFKALTLSVVFGTMVGGILIPNVETILGLTGATMGSLICFICPALIYKKIHKNALSSQVVLWVGLGVLVVSTVTTLSVSEEVPEDLAEEAPGGRLGEAEGLMKVEAARLSAQDPVVAVAEDGREKPKLPKEREELEQAQIKGPVDVPGREDGKEAPEEAQLDRPGQGIAVPVGEAHRHEPPVPHDKVVVDEGQDREVPEENKPPSRHAGGKAPGVQGQMAPPLPDSEREKQEPEQGEVGKRPGQAQALEEAGDLPEDPQKVPEADGQPAVQPAKEDLGPGDRGLHPRPQAVLSEQQNGLAVGGGEKAKGGPPPGNAAGDTGQPAEDSDHGGKPPLPAEKPAPGPGLPPEPREQRDVERAGGNQAASQLEEAGRAEMLDHAVLLQVIKEQQVQQKRLLDQQEKLLAVIEEQHKEIHQQRQEDEEDKPRQVEVHQEPGAAVPRGQEAPEGKARETVENLPPLPLDPVLRAPGGRPAPSQDLNQRSLEHSEGPVGRDPAGPPDGGPDTEPRAAQAKLRDGQKDAAPRAAGTVKELPKGPEQVPVPDPAREAGGPEERLAEEFPGQSQDVTGGSQDRKKPGKEVAATGTSILKEANWLVAGPGAETGDPRMKPKQVSRDLGLAADLPGGAEGAAAQPQAVLRQPELRVISDGEQGGQQGHRLDHGGHLEMRKARGGDHVPVSHEQPRGGEDAAVQEPRQRPEPELGLKRAVPGGQRPDNAKPNRDLKLQAGSDLRRRRRDLGPHAEGQLAPRDGVIIGLNPLPDVQVNDLRGALDAQLRQAAGGALQVVHSRQLRQAPGPPEES

SEQ ID NO: 4203 - protein, 406 aa, unidentified
MKQAGFPLGILLLFWVSYVTDFSLVLLIKGGALSGTDTYQSLVNKTFGFPGYLLLSVLQFLYPFIAMISYNIIAGDTLSKVFQRIPGVDPENVFIGRHFIIGLSTVTFTLPLSLYRNIAKLGKVSLISTGLTTLILGIVMARAISLGPHIPKTEDAWVFAKPNAIQAVGVMSFAFICHHNSFLVYSSLEEPTVAKWSRLIHMSIVISVFICIFFATCGYLTFTGFTQGDLFENYCRNDDLVTFGRFCYGVTVILTYPMECFVTREVIANVFFGGNLSSVFHIVVTVMVITVATLVSLLIDCLGIVLELNGVLCATPLIFIIPSACYLKLSEEPRTHSDKIMSCVMLPIGAVVMVFGFVMAITNTQDCTHGQEMFYCFPDNFSLTNTSESHVQQTTQLSTLNISIFQ

SEQ ID NO: 4204 - protein, 506 aa, unidentified
MKKAEMGRFSISPDEDSSSYSSNSDFNYSYPTKQAALKSHYADVDPENQNFLLESNLGKKKYETEFHPGTTSFGMSVFNLSNAIVGSGILGLSYAMANTGIALFIILLTFVSIFSLYSVHLLLKTANEGGSLLYEQLGYKAFGLVGKLAASGSITMQNIGAMSSYLFIVKYELPLVIQALTNIEDKTGLWYLNGNYLVLLVSLVVILPLSLFRNLGYLGYTSGLSLLCMVFFLIVVICKKFQVPCPVEAALIINETINTTLTQPTALVPALSHNVTENDSCRPHYFIFNSQTVYAVPILIFSFVCHPAVLPIYEELKDRSRRRMMNVSKISFFAMFLMYLLAALFGYLTFYEHVESELLHTYSSILGTDILLLIVRLAVLMAVTLTVPVVIFPIRSSVTHLLCASKDFSWWRHSLITVSILAFTNLLVIFVPTIRDIFGFIGASAASMLIFILPSAFYIKLVKKEPMKSVQKIGALFFLLSGVLVMTGSMALIVLDWVHNAPGGGH

SEQ ID NO: 4205 - protein, 547 aa, unidentified
MDPMELRNVNIEPDDESSSGESAPDSYIGIGNSEKAAMSSQFANEDTESQKFLTNGFLGKKKLADYADEHHPGTTSFGMSSFNLSNAIMGSGILGLSYAMANTGIILFIIMLLAVAILSLYSVHLLLKTAKEGGSLIYEKLGEKAFGWPGKIGAFVSITMQNIGAMSSYLFIIKYELPEVIRAFMGLEENTGEWYLNGNYLIIFVSVGIILPLSLLKNLGYLGYTSGFSLTCMVFFVSVVIYKKFQIPCPLPVLDHSVGNLSFNNTLPMHVVMLPNNSESSDVNFMMDYTHRNPAGLDENQAKGSLHDSGVEYEAHSDDKCEPKYFVFNSRTAYAIPILVFAFVCHPEVLPIYSELKDRSRRKMQTVSNISITGMLVMYLLAALFGYLTFYGEVEDELLHAYSKVYTLDIPLLMVRLAVLVAVTLTVPIVLFPIRTSVITLLFPKRPFSWIRHFLIAAVLIALNNVLVILVPTIKYIFGFIGASSATMLIFILPAVFYLKLVKKETFRSPQKVGALIFLVVGIFFMIGSMALIIIDWIYDPPNSKHH

SEQ ID NO: 4206 - protein, 472 aa, unidentified
MELQDPKMNGALPSDAVGYRQEREGFLPSRGPAPGSKPVQFMDFEGKTSFGMSVFNLSNAIMGSGILGLAYAMAHTGVIFFLALLLCIALLSSYSIHLLLTCAGIAGIRAYEQLGQRAFGPAGKVVVATVICLHNVGAMSSYLFIIKSELPLVIGTFLYMDPEGDWFLKGNLLIIIVSVLIILPLALMKHLGYLGYTSGLSLTCMLFFLVSVIYKKFQLGCAIGHNETAMESEALVGLPSQGLNSSCEAQMFTVDSQMSYTVPIMAFAFVCHPEVLPIYTELCRPSKRRMQAVANVSIGAMFCMYGLTATFGYLTFYSSVKAEMLHMYSQKDPLILCVRLAVLLAVTLTVPVVLFPIRRALQQLLFPGKAFSWPRHVAIALILLVLVNVLVICVPTIRDIFGVIGSTSAPSLIFILPSIFYLRIVPSEVEPFLSWPKIQALCFGVLGVLFMAVSLGFMFANWATGQSRMSGH

SEQ ID NO: 4207 - protein, 456 aa, unidentified
MEASWGSFNAERGWYVSVQQPEEAEAEELSPLLSNELHRQRSPGVSFGLSVFNLMNAIMGSGILGLAYVLANTGVFGFSFLLLTVALLASYSVHLLLSMCIQTAVTSYEDLGLFAFGLPGKLVVAGTIIIQNIGAMSSYLLIIKTELPAAIAEFLTGDYSRYWYLDGQTLLIIICVGIVFPLALLPKIGFLGYTSSLSFFFMMFFALVVIIKKWSIPCPLTLNYVEKGFQISNVTDDCKPKLFHFSKESAYALPTMAFSFLCHTSILPIYCELQSPSKKRMQNVTNTAIALSFLIYFISALFGYLTFYDKVESELLKGYSKYLSHDVVVMTVKLCILFAVLLTVPLIHFPARKAVTMMFFSNFPFSWIRHFLITLALNIIIVLLAIYVPDIRNVFGVVGASTSTCLIFIFPGLFYLKLSREDFLSWKKLGAFVLLIFGILVGNFSLALIIFDWINK

SEQ ID NO: 4208 - protein, 462 aa, unidentified
MAQVSINNDYSEWDLSTDAGERARLLQSPCVDTAPKSEWEASPGGLDRGTTSTLGAIFIVVNACLGAGLLNFPAAFSTAGGVAAGIALQMGMLVFIISGLVILAYCSQASNERTYQEVVWAVCGKLTGVLCEVAIAVYTFGTCIAFLIIIGDQQDKIIAVMAKEPEGASGPWYTDRKFTISLTAFLFILPLSIPREIGFQKYASFLSVVGTWYVTAIVIIKYIWPDKEMTPGNILTRPASWMAVFNAMPTICFGFQCHVSSVPVFNSMQQPEVKTWGGVVTAAMVIALAVYMGTGICGFLTFGAAVDPDVLLSYPSEDMAVAVARAFIILSVLTSYPILHFCGRAVVEGLWLRYQGVPVEEDVGRERRRRVLQTLVWFLLTLLLALFIPDIGKVISVIGGLAACFIFVFPGLCLIQAKLSEMEEVKPASWWVLVSYGVLLVTLGAFIFGQTTANAIFVDLLA

SEQ ID NO: 4209 - protein, 435 aa, unidentified
MEGQTPGSRGLPEKPHPATAAATLSSMGAVFILMKSALGAGLLNFPWAFSKAGGVVPAFLVELVSLVFLISGLVILGYAAAVSGQATYQGVVRGLCGPAIGKLCEACFLLNLLMISVAFLRVIGDQLEKLCDSLLSGTPPAPQPWYADQRFTLPLLSVLVILPLSAPREIAFQKYTSILGTLAACYLALVITVQYYLWPQGLVRESHPSLSPASWTSVFSVFPTICFGFQCHEAAVSIYCSMRKRSLSHWALVSVLSLLACCLIYSLTGVYGFLTFGTEVSADVLMSYPGNDMVIIVARVLFAVSIVTVYPIVLFLGRSVMQDFWRRSCLGGWGPSALADPSGLWVRMPLTILWVTVTLAMALFMPDLSEIVSIIGGISSFFIFIFPGLCLICAMGVEPIGPRVKCCLEVWGVVSVLVGTFIFGQSTAAAVWEMF

SEQ ID NO: 4210 - protein, 437 aa, unidentified
MIWNTMMGTSILSIPWGIKQAGFTTGMCVIILMGLLTLYCCYRVVKSRTMMFSLDTTSWEYPDVCRHYFGSFGQWSSLLFSLVSLIGAMIVYWVLMSNFLFNTGKFIFNFIHHINDTDTILSTNNSNPVICPSAGSGGHPDNSSMIFYANDTGAQQFEKWWDKSRTVPFYLVGLLLPLLNFKSPSFFSKFNILGTVSVLYLIFLVTFKAVRLGFHLEFHWFIPTEFFVPEIRFQFPQLTGVLTLAFFIHNCIITLLKNNKKQENNVRDLCIAYMLVTLTYLYIGVLVFASFPSPPLSKDCIEQNFLDNFPSSDTLSFIARIFLLFQMMTVYPLLGYLARVQLLGHIFGDIYPSIFHVLILNLIIVGAGVIMACFYPNIGGIIRYSGAACGLAFVFIYPSLIYIISLHQEERLTWPKLIFHVFIIILGVANLIVQFFM

SEQ ID NO: 4211 - protein, 324 aa, unidentified
MGPWGEPELLVWRPEAVASEPPVPVGLEVKLGALVLLLVLTLLCSLVPICVLRRPGANHEGSASRQKALSLVSCFAGGVFLATCLLDLLPDYLAAIDEALAALHVTLQFPLQEFILAMGFFLVLVMEQITLAYKEQSGPSPLEETRALLGTVNGGPQHWHDGPGVPQASGAPATPSALRACVLVFSLALHSVFEGLAVGLQRDRARAMELCLALLLHKGILAVSLSLRLLQSHLRAQVVAGCGILFSCMTPLGIGLGAALAESAGPLHQLAQSVLEGMAAGTFLYITFLEILPQELASSEQRILKVILLLAGFALLTGLLFIQI

SEQ ID NO: 4212 - protein, 831 aa, unidentified
MKVHMHTKFCLICLLTFIFHHCNHCHEEHDHGPEALHRQHRGMTELEPSKFSKQAAENEKKYYIEKLFERYGENGRLSFFGLEKLLTNLGLGERKVVEINHEDLGHDHVSHLDILAVQEGKHFHSHNHQHSHNHLNSENQTVTSVSTKRNHKCDPEKETVEVSVKSDDKHMHDHNHRLRHHHRLHHHLDHNNTHHFHNDSITPSERGEPSNEPSTETNKTQEQSDVKLPKGKRKKKGRKSNENSEVITPGFPPNHDQGEQYEHNRVHKPDRVHNPGHSHVHLPERNGHDPGRGHQDLDPDNEGELRHTRKREAPHVKNNAIISLRKDLNEDDHHHECLNVTQLLKYYGHGANSPISTDLFTYLCPALLYQIDSRLCIEHFDKLLVEDINKDKNLVPEDEANIGASAWICGIISITVISLLSLLGVILVPIINQGCFKFLLTFLVALAVGTMSGDALLHLLPHSQGGHDHSHQHAHGHGHSHGHESNKFLEEYDAVLKGLVALGGIYLLFIIEHCIRMFKHYKQQRGKQKWFMKQNTEESTIGRKLSDHKLNNTPDSDWLQLKPLAGTDDSVVSEDRLNETELTDLEGQQESPPKNYLCIEEEKIIDHSHSDGLHTIHEHDLHAAAHNHHGENKTVLRKHNHQWHHKHSHHSHGPCHSGSDLKETGIANIAWMVIMGDGIHNFSDGLAIGAAFSAGLTGGISTSIAVFCHELPHELGDFAVLLKAGMTVKQAIVYNLLSAMMAYIGMLIGTAVGQYANNITLWIFAVTAGMFLYVALVDMLPEMLHGDGDNEEHGFCPVGQFILQNLGLLFGFAIMLVIALYEDKIVFDIQF

SEQ ID NO: 4213 - protein, 342 aa, unidentified
MLQGHSSVFQALLGTFFTWGMTAAGAALVFVFSSGQRRILDGSLGFAAGVMLAASYWSLLAPAVEMATSSGGFGAFAFFPVAVGFTLGAAFVYLADLLMPHLGAAEDPQTTLALNFGSTLMKKKSDPEGPALLFPESELSIRIGRAGLLSDKSENGEAYQRKKAAATGLPEGPAVPVPSRGNLAQPGGSSWRRIALLILAITIHNVPEGLAVGVGFGAIEKTASATFESARNLAIGIGIQNFPEGLAVSLPLRGAGFSTWRAFWYGQLSGMVEPLAGVFGAFAVVLAEPILPYALAFAAGAMVYVVMDDIIPEAQISGNGKLASWASILGFVVMMSLDVGLG

SEQ ID NO: 4214 - protein, 691 aa, unidentified
MCFRTKLSVSWVPLFLLLSRVFSTETDKPSAQDSRSRGSSGQPADLLQVLSAGDHPPHNHSRSLIKTLLEKTGCPRRRNGMQGDCNLCFEPDALLLIAGGNFEDQLREEVVQRVSLLLLYYIIHQEEICSSKLNMSNKEYKFYLHSLLSLRQDEDSSFLSQNETEDILAFTRQYFDTSQSQCMETKTLQKKSGIVSSEGANESTLPQLAAMIITLSLQGVCLGQGNLPSPDYFTEYIFSSLNRTNTLRLSELDQLLNTLWTRSTCIKNEKIHQFQRKQNNIITHDQDYSNFSSSMEKESEDGPVSWDQTCFSARQLVEIFLQKGLSLISKEDFKQMSPGIIQQLLSCSCHLPKDQQAKLPPTTLEKYGYSTVAVTLLTLGSMLGTALVLFHSCEENYRLILQLFVGLAVGTLSGDALLHLIPQVLGLHKQEAPEFGHFHESKGHIWKLMGLIGGIHGFFLIEKCFILLVSPNDKQGLSLVNGHVGHSHHLALNSELSDQAGRGKSASTIQLKSPEDSQAAEMPIGSMTASNRKCKAISLLAIMILVGDSLHNFADGLAIGAAFSSSSESGVTTTIAILCHEIPHEMGDFAVLLSSGLSMKTAILMNFISSLTAFMGLYIGLSVSADPCVQDWIFTVTAGMFLYLSLVEMLPEMTHVQTQRPWMMFLLQNFGLILGWLSLLLLAIYEQNIKI

SEQ ID NO: 4215 - protein, 371 aa, unidentified
MPGCPCPGCGMAGPRLLFLTALALELLERAGGSQPALRSRGTATACRLDNKESESWGALLSGERLDTWICSLLGSLMVGLSGVFPLLVIPLEMGTMLRSEAGAWRLKQLLSFALGGLLGNVFLHLLPEAWAYTCSASPGGEGQSLQQQQQLGLWVIAGILTFLALEKMFLDSKEEGTSQAPNKDPTAAAAALNGGHCLAQPAAEPGLGAVVRSIKVSGYLNLLANTIDNFTHGLAVAASFLVSKKIGLLTTMAILLHEIPHEVGDFAILLRAGFDRWSAAKLQLSTALGGLLGAGFAICTQSPKGVVGCSPAAEETAAWVLPFTSGGFLYIALVNVLPDLLEEEDPWRSLQQLLLLCAGIVVMVLFSLFVD

SEQ ID NO: 4216 - protein, 492 aa, unidentified
MKLLLLHPAFQSCLLLTLLGLWRTTPEAHASSLGAPAISAASFLQDLIHRYGEGDSLTLQQLKALLNHLDVGVGRGNVTQHVQGHRNLSTCFSSGDLFTAHNFSEQSRIGSSELQEFCPTILQQLDSRACTSENQENEENEQTEEGRPSAVEVWGYGLLCVTVISLCSLLGASVVPFMKKTFYKRLLLYFIALAIGTLYSNALFQLIPEAFGFNPLEDYYVSKSAVVFGGFYLFFFTEKILKILLKQKNEHHHGHSHYASESLPSKKDQEEGVMEKLQNGDLDHMIPQHCSSELDGKAPMVDEKVIVGSLSVQDLQASQSACYWLKGVRYSDIGTLAWMITLSDGLHNFIDGLAIGASFTVSVFQGISTSVAILCEEFPHELGDFVILLNAGMSIQQALFFNFLSACCCYLGLAFGILAGSHFSANWIFALAGGMFLYISLADMFPEMNEVCQEDERKGSILIPFIIQNLGLLTGFTIMVVLTMYSGQIQIG

SEQ ID NO: 4217 - protein, 309 aa, unidentified
MEQLLGIKLGCLFALLALTLGCGLTPICFKWFQIDAARGHHRLVLRLLGCISAGVFLGAGFMHMTAEALEEIESQIQKFMVQNRSASERNSSGDADSAHMEYPYGELIISLGFFFVFFLESLALQCCPGAAGGSTVQDEEWGGAHIFELHSHGHLPSPSKGPLRALVLLLSLSFHSVFEGLAVGLQPTVAATVQLCLAVLAHKGLVVFGVGMRLVHLGTSSRWAVFSILLLALMSPLGLAVGLAVTGGDSEGGRGLAQAVLEGVAAGTFLYVTFLEILPRELASPEAPLAKWSCVAAGFAFMAFIALWA

SEQ ID NO: 4218 - protein, 314 aa, unidentified
MVKLLVAKILCMVGVFFFMLLGSLLPVKIIETDFEKAHRSKKILSLCNTFGGGVFLATCFNALLPAVREKLQKVLSLGHISTDYPLAETILLLGFFMTVFLEQLILTFRKEKPSFIDLETFNAGSDVGSDSEYESPFMGGARGHALYVEPHGHGPSLSVQGLSRASPVRLLSLAFALSAHSVFEGLALGLQEEGEKVVSLFVGVAVHETLVAVALGISMARSAMPLRDAAKLAVTVSAMIPLGIGLGLGIESAQGVPGSVASVLLQGLAGGTFLFITFLEILAKELEEKSDRLLKVLFLVLGYTVLAGMVFLKW

SEQ ID NO: 4219 - protein, 647 aa, unidentified
MASLVSLELGLLLAVLVVTATASPPAGLLSLLTSGQGALDQEALGGLLNTLADRVHCANGPCGKCLSVEDALGLGEPEGSGLPPGPVLEARYVARLSAAAVLYLSNPEGTCEDARAGLWASHADHLLALLESPKALTPGLSWLLQRMQARAAGQTPKMACVDIPQLLEEAVGAGAPGSAGGVLAALLDHVRSGSCFHALPSPQYFVDFVFQQHSSEVPMTLAELSALMQRLGVGREAHSDHSHRHRGASSRDPVPLISSSNSSSVWDTVCLSARDVMAAYGLSEQAGVTPEAWAQLSPALLQQQLSGACTSQSRPPVQDQLSQSERYLYGSLATLLICLCAVFGLLLLTCTGCRGVTHYILQTFLSLAVGAVTGDAVLHLTPKVLGLHTHSEEGLSPQPTWRLLAMLAGLYAFFLFENLFNLLLPRDPEDLEDGPCGHSSHSHGGHSHGVSLQLAPSELRQPKPPHEGSRADLVAEESPELLNPEPRRLSPELRLLPYMITLGDAVHNFADGLAVGAAFASSWKTGLATSLAVFCHELPHELGDFAALLHAGLSVRQALLLNLASALTAFAGLYVALAVGVSEESEAWILAVATGLFLYVALCDMLPAMLKVRDPRPWLLFLLHNVGLLGGWTVLLLLSLYEDDITF

SEQ ID NO: 4220 - protein, 540 aa, unidentified
MMGSPVSHLLAGFCVWVVLGWVGGSVPNLGPAEQEQNHYLAQLFGLYGENGTLTAGGLARLLHSLGLGRVQGLRLGQHGPLTGRAASPAADNSTHRPQNPELSVDVWAGMPLGPSGWGDLEESKAPHLPRGPAPSGLDLLHRLLLLDHSLADHLNEDCLNGSQLLVNFGLSPAAPLTPRQFALLCPALLYQIDSRVCIGAPAPAPPGDLLSALLQSALAVLLLSLPSPLSLLLLRLLGPRLLRPLLGFLGALAVGTLCGDALLHLLPHAQEGRHAGPGGLPEKDLGPGLSVLGGLFLLFVLENMLGLLRHRGLRPRCCRRKRRNLETRNLDPENGSGMALQPLQAAPEPGAQGQREKNSQHPPALAPPGHQGHSHGHQGGTDITWMVLLGDGLHNLTDGLAIGAAFSDGFSSGLSTTLAVFCHELPHELGDFAMLLQSGLSFRRLLLLSLVSGALGLGGAVLGVGLSLGPVPLTPWVFGVTAGVFLYVALVDMLPALLRPPEPLPTPHVLLQGLGLLLGGGLMLAITLLEERLLPVTTEG

SEQ ID NO: 4221 - protein, 755 aa, unidentified
MARKLSVILILTFALSVTNPLHELKAAAFPQTTEKISPNWESGINVDLAISTRQYHLQQLFYRYGENNSLSVEGFRKLLQNIGIDKIKRIHIHHDHDHHSDHEHHSDHERHSDHEHHSEHEHHSDHDHHSHHNHAASGKNKRKALCPDHDSDSSGKDPRNSQGKGAHRPEHASGRRNVKDSVSASEVTSTVYNTVSEGTHFLETIETPRPGKLFPKDVSSSTPPSVTSKSRVSRLAGRKTNESVSEPRKGFMYSRNTNENPQECFNASKLLTSHGMGIQVPLNATEFNYLCPAIINQIDARSCLIHTSEKKAEIPPKTYSLQIAWVGGFIAISIISFLSLLGVILVPLMNRVFFKFLLSFLVALAVGTLSGDAFLHLLPHSHASHHHSHSHEEPAMEMKRGPLFSHLSSQNIEESAYFDSTWKGLTALGGLYFMFLVEHVLTLIKQFKDKKKKNQKKPENDDDVEIKKQLSKYESQLSTNEEKVDTDDRTEGYLRADSQEPSHFDSQQPAVLEEEEVMIAHAHPQEVYNEYVPRGCKNKCHSHFHDTLGQSDDLIHHHHDYHHILHHHHHQNHHPHSHSQRYSREELKDAGVATLAWMVIMGDGLHNFSDGLAIGAAFTEGLSSGLSTSVAVFCHELPHELGDFAVLLKAGMTVKQAVLYNALSAMLAYLGMATGIFIGHYAENVSMWIFALTAGLFMYVALVDMVPEMLHNDASDHGCSRWGYFFLQNAGMLLGFGIMLLISIFEHKIVFRINF

SEQ ID NO: 4222 - protein, 469 aa, unidentified
MARGLGAPHWVAVGLLTWATLGLLVAGLGGHDDLHDDLQEDFHGHSHRHSHEDFHHGHSHAHGHGHTHESIWHGHTHDHDHGHSHEDLHHGHSHGYSHESLYHRGHGHDHEHSHGGYGESGAPGIKQDLDAVTLWAYALGATVLISAAPFFVLFLIPVESNSPRHRSLLQILLSFASGGLLGDAFLHLIPHALEPHSHHTLEQPGHGHSHSGQGPILSVGLWVLSGIVAFLVVEKFVRHVKGGHGHSHGHGHAHSHTRGSHGHGRQERSTKEKQSSEEEEKETRGVQKRRGGSTVPKDGPVRPQNAEEEKRGLDLRVSGYLNLAADLAHNFTDGLAIGASFRGGRGLGILTTMTVLLHEVPHEVGDFAILVQSGCSKKQAMRLQLLTAVGALAGTACALLTEGGAVGSEIAGGAGPGWVLPFTAGGFIYVATVSVLPELLREASPLQSLLEVLGLLGGVIMMVLIAHLE

SEQ ID NO: 4223 - protein, 460 aa, unidentified
MAPGRAVAGLLLLAAAGLGGVAEGPGLAFSEDVLSVFGANLSLSAAQLQHLLEQMGAASRVGVPEPGQLHFNQCLTAEEIFSLHGFSNATQITSSKFSVICPAVLQQLNFHPCEDRPKHKTRPSHSEVWGYGFLSVTIINLASLLGLILTPLIKKSYFPKILTFFVGLAIGTLFSNAIFQLIPEAFGFDPKVDSYVEKAVAVFGGFYLLFFFERMLKMLLKTYGQNGHTHFGNDNFGPQEKTHQPKALPAINGVTCYANPAVTEANGHIHFDNVSVVSLQDGKKEPSSCTCLKGPKLSEIGTIAWMITLCDALHNFIDGLAIGASCTLSLLQGLSTSIAILCEEFPHELGDFVILLNAGMSTRQALLFNFLSACSCYVGLAFGILVGNNFAPNIIFALAGGMFLYISLADMFPEMNDMLREKVTGRKTDFTFFMIQNAGMLTGFTAILLITLYAGEIELE

SEQ ID NO: 4224 - protein, 307 aa, unidentified
MDDFISISLLSLAMLVGCYVAGIIPLAVNFSEERLKLVTVLGAGLLCGTALAVIVPEGVHALYEDILEGKHHQASETHNVIASDKAAEKSVVHEHEHSHDHTQLHAYIGVSLVLGFVFMLLVDQIGNSHVHSTDDPEAARSSNSKITTTLGLVVHAAADGVALGAAASTSQTSVQLIVFVAIMLHKAPAAFGLVSFLMHAGLERNRIRKHLLVFALAAPVMSMVTYLGLSKSSKEALSEVNATGVAMLFSAGTFLYVATVHVLPEVGGIGHSHKPDATGGRGLSRLEVAALVLGCLIPLILSVGHQH

SEQ ID NO: 4225 - protein, 685 aa, unidentified
MAEDKSKRDSIEMSMKGCQTNNGFVHNEDILEQTPDPGSSTDNLKHSTRGILGSQEPDFKGVQPYAGMPKEVLFQFSGQARYRIPREILFWLTVASVLVLIAATIAIIALSPKCLDWWQEGPMYQIYPRSFKDSNKDGNGDLKGIQDKLDYITALNIKTVWITSFYKSSLKDFRYGVEDFREVDPIFGTMEDFENLVAAIHDKGLKLIIDFIPNHTSDKHIWFQLSRTRTGKYTDYYIWHDCTHENGKTIPPNNWLSVYGNSSWHFDEVRNQCYFHQFMKEQPDLNFRNPDVQEEIKEILRFWLTKGVDGFSLDAVKFLLEAKHLRDEIQVNKTQIPDTVTQYSELYHDFTTTQVGMHDIVRSFRQTMDQYSTEPGRYRFMGTEAYAESIDRTVMYYGLPFIQEADFPFNNYLSMLDTVSGNSVYEVITSWMENMPEGKWPNWMIGGPDSSRLTSRLGNQYVNVMNMLLFTLPGTPITYYGEEIGMGNIVAANLNESYDINTLRSKSPMQWDNSSNAGFSEASNTWLPTNSDYHTVNVDVQKTQPRSALKLYQDLSLLHANELLLNRGWFCHLRNDSHYVVYTRELDGIDRIFIVVLNFGESTLLNLHNMISGLPAKMRIRLSTNSADKGSKVDTSGIFLDKGEGLIFEHNTKNLLHRQTAFRDRCFVSNRACYSSVLNILYTSC

SEQ ID NO: 4226 - protein, 630 aa, unidentified
MELQPPEASIAVVSIPRQLPGSHSEAGVQGLSAGDDSELGSHCVAQTGLELLASGDPLPSASQNAEMIETGSDCVTQAGLQLLASSDPPALASKNAEVTGTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 4227 - protein, 571 aa, unidentified
MTRAGDHNRQRGCCGSLADYLTSAKFLLYLGHSLSTWGDRMWHFAVSVFLVELYGNSLLLTAVYGLVVAGSVLVLGAIIGDWVDKNARLKVAQTSLVVQNVSVILCGIILMMVFLHKHELLTMYHGWVLTSCYILIITIANIANLASTATAITIQRDWIVVVAGEDRSKLANMNATIRRIDQLTNILAPMAVGQIMTFGSPVIGCGFISGWNLVSMCVEYVLLWKVYQKTPALAVKAGLKEEETELKQLNLHKDTEPKPLEGTHLMGVKDSNIHELEHEQEPTCASQMAEPFRTFRDGWVSYYNQPVFLAGMGLAFLYMTVLGFDCITTGYAYTQGLSGSILSILMGASAITGIMGTVAFTWLRRKCGLVRTGLISGLAQLSCLILCVISVFMPGSPLDLSVSPFEDIRSRFIQGESITPTKIPEITTEIYMSNGSNSANIVPETSPESVPIISVSLLFAGVIAARIGLWSFDLTVTQLLQENVIESERGIINGVQNSMNYLLDLLHFIMVILAPNPEAFGLLVLISVSFVAMGHIMYFRFAQNTLGNKLFACGPDAKEVRKENQANTSVV

SEQ ID NO: 4228 - protein, 513 aa, unidentified
MSSKPEPKDVHQLNGTGPSASPCSSDGPGREPLAGTSEFLGPDGAGVEVVIESRANAKGVREEDALLENGSQSNESDDVSTDRGPAPPSPLKETSFSIGLQVLFPFLLAGFGTVAAGMVLDIVQHWEVFQKVTEVFILVPALLGLKGNLEMTLASRLSTAANIGHMDTPKELWRMITGNMALIQVQATVVGFLASIAAVVFGWIPDGHFSIPHAFLLCASSVATAFIASLVLGMIMIGVIIGSRKIGINPDNVATPIAASLGDLITLALLSGISWGLYLELNHWRYIYPLVCAFFVALLPVWVVLARRSPATREVLYSGWEPVIIAMAISSVGGLILDKTVSDPNFAGMAVFTPVINGVGGNLVAVQASRISTFLHMNGMPGENSEQAPRRCPSPCTTFFSPDVNSRSARVLFLLVVPGHLVFLYTISCMQGGHTTLTLIFIIFYMTAALLQVLILLYIADWMVHWMWGRGLDPDNFSIPYLTALGDLLGTGLLALSFHVLWLIGDRDTDVGD

SEQ ID NO: 4229 - protein, 573 aa, unidentified
MTNSKGRSITDKTSGGPSSGGGFVDWTLRLNTIQSDKFLNLLLSMVPVIYQKNQEDRHKKANGIWQDGLSTAVQTFSNRSEQHMEYHSFSEQSFHANNGHASSSCSQKYDDYANYNYCDGRETSETTAMLQDEDISSDGDEDAIVEVTPKLPKESSGIMALQILVPFLLAGFGTVSAGMVLDIVQHWEVFRKVTEVFILVPALLGLKGNLEMTLASRLSTAVNIGKMDSPIEKWNLIIGNLALKQVQATVVGFLAAVAAIILGWIPEGKYYLDHSILLCSSSVATAFIASLLQGIIMVGVIVGSKKTGINPDNVATPIAASFGDLITLAILAWISQGLYSCLETYYYISPLVGVFFLALTPIWIIIAAKHPATRTVLHSGWEPVITAMVISSIGGLILDTTVSDPNLVGIVVYTPVINGIGGNLVAIQASRISTYLHLHSIPGELPDEPKGCYYPFRTFFGPGVNNKSAQVLLLLVIPGHLIFLYTIHLMKSGHTSLTIIFIVVYLFGAVLQVFTLLWIADWMVHHFWRKGKDPDSFSIPYLTALGDLLGTALLALSFHFLWLIGDRDGDVGD

SEQ ID NO: 4230 - protein, 507 aa, unidentified
MDGTETRQRRLDSCGKPGELGLPHPLSTGGLPVASEDGALRAPESQSVTPKPLETEPSRETTWSIGLQVTVPFMFAGLGLSWAGMLLDYFQHWPVFVEVKDLLTLVPPLVGLKGNLEMTLASRLSTAANTGQIDDPQEQHRVISSNLALIQVQATVVGLLAAVAALLLGVVSREEVDVAKVELLCASSVLTAFLAAFALGVLMVCIVIGARKLGVNPDNIATPIAASLGDLITLSILALVSSFFYRHKDSRYLTPLVCLSFAALTPVWVLIAKQSPPIVKILKFGWFPIILAMVISSFGGLILSKTVSKQQYKGMAIFTPVICGVGGNLVAIQTSRISTYLHMWSAPGVLPLQMKKFWPNPCSTFCTSEINSMSARVLLLLVVPGHLIFFYIIYLVEGQSVINSQTFVVLYLLAGLIQVTILLYLAEVMVRLTWHQALDPDNHCIPYLTGLGDLLGSSSVGHTAAVPRRCTASPGWGLIQPFICTQHLIVSLLSFYFPFCLLAKTSI

SEQ ID NO: 4231 - protein, 559 aa, unidentified
MAPTLQQAYRRRWWMACTAVLENLFFSAVLLGWGSLLIILKNEGFYSSTCPAESSTNTTQDEQRRWPGCDQQDEMLNLGFTIGSFVLSATTLPLGILMDRFGPRPVRLVGSACFTASCTLMALASRDVEALSPLIFLALSLNGFGGICLTFTSLTLPNMFGNLRSTLMALMIGSYASSAITFPGIKLIYDAGVAFVVIMFTWSGLACLIFLNCTLNWPIEAFPAPEEVNYTKKIKLSGLALDHKVTGDLFYTHVTTMGQRLSQKAPSLEDGSDAFMSPQDVRGTSENLPERSVPLRKSLCSPTFLWSLLTMGMTQLRIIFYMAAVNKMLEYLVTGGQEHETNEQQQKVAETVGFYSSVFGAMQLLCLLTCPLIGYIMDWRIKDCVDAPTQGTVLGDARDGVATKSIRPRYCKIQKLTNAISAFTLTNLLLVGFGITCLINNLHLQFVTFVLHTIVRGFFHSACGSLYAAVFPSNHFGTLTGLQSLISAVFALLQQPLFMAMVGPLKGEPFWVNLGLLLFSLLGFLLPSYLFYYRARLQQEYAANGMGPLKVLSGSEVTA

SEQ ID NO: 4232 - protein, 569 aa, unidentified
MAPTLATAHRRRWWMACTAVLENLLFSAVLLGWGSLLIMLKSEGFYSYLCTEPENVTNGTVGGTAEPGHEEVSWMNGWLSCQAQDEMLNLAFTVGSFLLSAITLPLGIVMDKYGPRKLRLLGSACFAVSCLLIAYGASKPNALSVLIFIALALNGFGGMCMTFTSLTLPNMFGDLRSTFIALMIGSYASSAVTFPGIKLIYDAGVSFIVVLVVWAGCSGLVFLNCFFNWPLEPFPGPEDMDYSVKIKFSWLGFDHKITGKQFYKQVTTVGRRLSVGSSMRSAKEQVALQEGHKLCLSTVDLEVKCQPDAAVAPSFMHSVFSPILLLSLVTMCVTQLRLIFYMGAMNNILKFLVSGDQKTVGLYTSIFGVLQLLCLLTAPVIGYIMDWRLKECEDASEEPEEKDANQGEKKKKKRDRQIQKITNAMRAFAFTNLLLVGFGVTCLIPNLPLQILSFILHTIVRGFIHSAVGGLYAAVYPSTQFGSLTGLQSLISALFALLQQPLFLAMMGPLQGDPLWVNVGLLLLSLLGFCLPLYLICYRRQLERQLQQRQEDDKLFLKINGSSNQEAFV

SEQ ID NO: 4233 - protein, 491 aa, unidentified
MAGQGLPLHVATLLTGLLECLGFAGVLFGWPSLVFVFKNEDYFKDLCGPDAGPIGNATGQADCKAQDERFSLIFTLGSFMNNFMTFPTGYIFDRFKTTVARLIAIFFYTTATLIIAFTSAGSAVLLFLAMPMLTIGGILFLITNLQIGNLFGQHRSTIITLYNGAFDSSSAVFLIIKLLYEKGISLRASFIFISVCSTWHVARTFLLMPRGHIPYPLPPNYSYGLCPGNGTTKEEKETAEHENRELQSKEFLSAKEETPGAGQKQELRSFWSYAFSRRFAWHLVWLSVIQLWHYLFIGTLNSLLTNMAGGDMARVSTYTNAFAFTQFGVLCAPWNGLLMDRLKQKYQKEARKTGSSTLAVALCSTVPSLALTSLLCLGFALCASVPILPLQYLTFILQVISRSFLYGSNAAFLTLAFPSEHFGKLFGLVMALSAVVSLLQFPIFTLIKGSLQNDPFYVNVMFMLAILLTFFHPFLVYRECRTWKESPSAIA

SEQ ID NO: 4234 - protein, 657 aa, unidentified
MGCCSSASSAAQSSKREWKPLEDRSCTDIPWLLLFILFCIGMGFICGFSIATGAAARLVSGYDSYGNICGQKNTKLEAIPNSGMDHTQRKYVFFLDPCNLDLINRKIKSVALCVAACPRQELKTLSDVQKFAEINGSALCSYNLKPSEYTTSPKSSVLCPKLPVPASAPIPFFHRCAPVNISCYAKFAEALITFVSDNSVLHRLISGVMTSKEIILGLCLLSLVLSMILMVIIRYISRVLVWILTILVILGSLGGTGVLWWLYAKQRRSPKETVTPEQLQIAEDNLRALLIYAISATVFTVILFLIMLVMRKRVALTIALFHVAGKVFIHLPLLVFQPFWTFFALVLFWVYWIMTLLFLGTTGSPVQNEQGFVEFKISGPLQYMWWYHVVGLIWISEFILACQQMTVAGAVVTYYFTRDKRNLPFTPILASVNRLIRYHLGTVAKGSFIITLVKIPRMILMYIHSQLKGKENACARCVLKSCICCLWCLEKCLNYLNQNAYTATAINSTNFCTSAKDAFVILVENALRVATINTVGDFMLFLGKVLIVCSTGLAGIMLLNYQQDYTVWVLPLIIVCLFAFLVAHCFLSIYEMVVDVLFLCFAIDTKYNDGSPGREFYMDKVLMEFVENSRKAMKEAGKGGVADSRELKPMASGASSA

SEQ ID NO: 4235 - protein, 706 aa, unidentified
MGDERPHYYGKHGTPQKYDPTFKGPIYNRGCTDIICCVFLLLAIVGYVAVGIIAWTHGDPRKVIYPTDSRGEFCGQKGTKNENKPYLFYFNIVKCASPLVLLEFQCPTPQICVEKCPDRYLTYLNARSSRDFEYYKQFCVPGFKNNKGVAEVLQDGDCPAVLIPSKPLARRCFPAIHAYKGVLMVGNETTYEDGHGSRKNITDLVEGAKKANGVLEARQLAMRIFEDYTVSWYWIIIGLVIAMAMSLLFIILLRFLAGIMVWVMIIMVILVLGYGIFHCYMEYSRLRGEAGSDVSLVDLGFQTDFRVYLHLRQTWLAFMIILSILEVIIILLLIFLRKRILIAIALIKEASRAVGYVMCSLLYPLVTFFLLCLCIAYWASTAVFLSTSNEAVYKIFDDSPCPFTAKTCNPETFPSSNESRQCPNARCQFAFYGGESGYHRALLGLQIFNAFMFFWLANFVLALGQVTLAGAFASYYWALRKPDDLPAFPLFSAFGRALRYHTGSLAFGALILAIVQIIRVILEYLDQRLKAAENKFAKCLMTCLKCCFWCLEKFIKFLNRNAYIMIAIYGTNFCTSARNAFFLLMRNIIRVAVLDKVTDFLFLLGKLLIVGSVGILAFFFFTHRIRIVQDTAPPLNYYWVPILTVIVGSYLIAHGFFSVYGMCVDTLFLCFLEDLERNDGSAERPYFMSSTLKKLLNKTNKKAAES

SEQ ID NO: 4236 - protein, 653 aa, unidentified
MHCLGAEYLVSAEGAPRQREWRPQIYRKCTDTAWLFLFFLFWTGLVFIMGYSVVAGAAGRLLFGYDSFGNMCGKKNSPVEGAPLSGQDMTLKKHVFFMNSCNLEVKGTQLNRMALCVSNCPEEQLDSLEEVQFFANTSGSFLCVYSLNSFNYTHSPKADSLCPRLPVPPSKSFPLFNRCVPQTPECYSLFASVLINDVDTLHRILSGIMSGRDTILGLCILALALSLAMMFTFRFITTLLVHIFISLVILGLLFVCGVLWWLYYDYTNDLSIELDTERENMKCVLGFAIVSTGITAVLLVLIFVLRKRIKLTVELFQITNKAISSAPFLLFQPLWTFAILIFFWVLWVAVLLSLGTAGAAQVMEGGQVEYKPLSGIRYMWSYHLIGLIWTSEFILACQQMTIAGAVVTCYFNRSKNDPPDHPILSSLSILFFYHQGTVVKGSFLISVVRIPRIIVMYMQNALKEQQHGALSRYLFRCCYCCFWCLDKYLLHLNQNAYTTTAINGTDFCTSAKDAFKILSKNSSHFTSINCFGDFIIFLGKVLVVCFTVFGGLMAFNYNRAFQVWAVPLLLVAFFAYLVAHSFLSVFETVLDALFLCFAVDLETNDGSSEKPYFMDQEFLSFVKRSNKLNNARAQQDKHSLRNEEGTELQAIVR

SEQ ID NO: 4237 - protein, 710 aa, unidentified
MGGKQRDEDDEAYGKPVKYDPSFRGPIKNRSCTDVICCVLFLLFILGYIVVGIVAWLYGDPRQVLYPRNSTGAYCGMGENKDKPYLLYFNIFSCILSSNIISVAENGLQCPTPQVCVSSCPEDPWTVGKNEFSQTVGEVFYTKNRNFCLPGVPWNMTVITSLQQELCPSFLLPSAPALGRCFPWTNVTPPALPGITNDTTIQQGISGLIDSLNARDISVKIFEDFAQSWYWILVALGVALVLSLLFILLLRLVAGPLVLVLILGVLGVLAYGIYYCWEEYRVLRDKGASISQLGFTTNLSAYQSVQETWLAALIVLAVLEAILLLMLIFLRQRIRIAIALLKEASKAVGQMMSTMFYPLVTFVLLLICIAYWAMTALYLATSGQPQYVLWASNISSPGCEKVPINTSCNPTAHLVNSSCPGLMCVFQGYSSKGLIQRSVFNLQIYGVLGLFWTLNWVLALGQCVLAGAFASFYWAFHKPQDIPTFPLISAFIRTLRYHTGSLAFGALILTLVQIARVILEYIDHKLRGVQNPVARCIMCCFKCCLWCLEKFIKFLNRNAYIMIAIYGKNFCVSAKNAFMLLMRNIVRVVVLDKVTDLLLFFGKLLVVGGVGVLSFFFFSGRIPGLGKDFKSPHLNYYWLPIMTSILGAYVIASGFFSVFGMCVDTLFLCFLEDLERNNGSLDRPYYMSKSLLKILGKKNEAPPDNKKRKK

SEQ ID NO: 4238 - protein, 719 aa, unidentified
MNDTEKPADTPSEEEDFGDPRTYDPDFKGPVANRSCTDVLCCMIFLLCIIGYIVLGLVAWVHGDPRRAAYPTDSQGHFCGQKGTPNENKTILFYFNLLRCTSPSVLLNLQCPTTQICVSKCPEKFLTYVEMQLLYTKDKSYWEDYRQFCKTTAKPVKSLTQLLLDDDCPTAIFPSKPFLQRCFPDFSTKNGTLTIGSKMMFQDGNGGTRSVVELGIAANGINKLLDAKSLGLKVFEDYARTWYWILIGLTIAMVLSWIFLILLRFIAGCLFWVFMIGVIGIIGYGIWHCYQQYTNLQERPSSVLTIYDIGIQTNISMYFELQQTWFTFMIILCIIEVIVILMLIFLRNRIRVAIILLKEGSKAIGYVPSTLVYPALTFILLSICICYWVVTAVFLATSGVPVYKVIAPGGHCIHENQTCDPEIFNTTEIAKACPGALCNFAFYGGKSLYHQYIPTFHVYNLFVFLWLINFVIALGQCALAGAFATYYWAMKKPDDIPRYPLFTAFGRAIRYHTGSLAFGSLIIALIQMFKIVLEYLDHRLKRTQNTLSKFLQCCLRCCFWCLENAIKFLNRNAYIMIAIYGRNFCRSAKDAFNLLMRNVLKVAVTDEVTYFVLFLGKLLVAGSIGVLAFLFFTQRLPVIAQGPASLNYYWVPLLTVIFGSYLIAHGFFSVYAMCVETIFICFCEDLERNDGSTEKPYFVTPNLHGILIKKQLVPQKQKE

SEQ ID NO: 4239 - protein, 782 aa, unidentified
MLQQPGPRPGRQQPSGDRDACRLHPQGRPPALPTMIPAASSTPPGDALFPSVAPQDFWRSQVTGYSGSVTRHLSHRANNFKRHPKRRKCIRPSPPPPPNTPCPLELVDFGDLHPQRSFRELLFNGCILFGIEFSYAMETAYVTPVLLQMGLPDQLYSLVWFISPILGFLLQPLLGAWSDRCTSRFGRRRPFILVLAIGALLGLSLLLNGRDIGIALADVTGNHKWGLLLTVCGVVLMDFSADSADNPSHAYMMDVCSPADQDRGLNIHALLAGLGGGFGYVVGGIHWDKTGFGRALGGQLRVIYLFTAVTLSVTTVLTLVSIPERPLRPPSEKRAAMKSPSLPLPPSPPVLPEEGPGDSLPSHTATNFSSPISPPSPLTPKYGSFISRDSSLTGISEFASSFGTANIDSVLIDCFTGGHDSYLAIPGSVPRPPISVSFPRAPDGFYRQDRGLLEGREGALTSGCDGDILRVGSLDTSKPRSSGILKRPQTLAIPDAAGGGGPETSRRRNVTFSQQVANILLNGVKYESELTGSSERAEQPLSVGRLCSTICNMPKALRTLCVNHFLGWLSFEGMLLFYTDFMGEVVFQGDPKAPHTSEAYQKYNSGVTMGCWGMCIYAFSAAFYSAILEKLEEFLSVRTLYFIAYLAFGLGTGLATLSRNLYVVLSLCITYGILFSTLCTLPYSLLCDYYQSKKFAGSSADGTRRGMGVDISLLSCQYFLAQILVSLVLGPLTSAVGSANGVMYFSSLVSFLGCLYSSLFVIYEIPPSDAADEEHRPLLLNV

SEQ ID NO: 4240 - protein, 530 aa, unidentified
MGSNSGQAGRHIYKSLADDGPFDSVEPPKRPTSRLIMHSMAMFGREFCYAVEAAYVTPVLLSVGLPSSLYSIVWFLSPILGFLLQPVVGSASDHCRSRWGRRRPYILTLGVMMLVGMALYLNGATVVAALIANPRRKLVWAISVTMIGVVLFDFAADFIDGPIKAYLFDVCSHQDKEKGLHYHALFTGFGGALGYLLGAIDWAHLELGRLLGTEFQVMFFFSALVLTLCFTVHLCSISEAPLTEVAKGIPPQQTPQDPPLSSDGMYEYGSIEKVKNGYVNPELAMQGAKNKNHAEQTRRAMTLKSLLRALVNMPPHYRYLCISHLIGWTAFLSNMLFFTDFMGQIVYRGDPYSAHNSTEFLIYERGVEVGCWGLCINSVFSSLYSYFQKVLVSYIGLKGLYFTGYLLFGLGTGFIGLFPNVYSTLVLCSLFGVMSSTLYTVPFNLITEYHREEEKERQQAPGGDPDNSVRGKGMDCATLTCMVQLAQILVGGGLGFLVNTAGTVVVVVITASAVALIGCCFVALFVRYVD

SEQ ID NO: 4241 - protein, 553 aa, unidentified
MVQRLWVSRLLRHRKAQLLLVNLLTFGLEVCLAAGITYVPPLLLEVGVEEKFMTMVLGIGPVLGLVCVPLLGSASDHWRGRYGRRRPFIWALSLGILLSLFLIPRAGWLAGLLCPDPRPLELALLILGVGLLDFCGQVCFTPLEALLSDLFRDPDHCRQAYSVYAFMISLGGCLGYLLPAIDWDTSALAPYLGTQEECLFGLLTLIFLTCVAATLLVAEEAALGPTEPAEGLSAPSLSPHCCPCRARLAFRNLGALLPRLHQLCCRMPRTLRRLFVAELCSWMALMTFTLFYTDFVGEGLYQGVPRAEPGTEARRHYDEGVRMGSLGLFLQCAISLVFSLVMDRLVQRFGTRAVYLASVAAFPVAAGATCLSHSVAVVTASAALTGFTFSALQILPYTLASLYHREKQVFLPKYRGDTGGASSEDSLMTSFLPGPKPGAPFPNGHVGAGGSGLLPPPPALCGASACDVSVRVVVGEPTEARVVPGRGICLDLAILDSAFLLSQVAPSLFMGSIVQLSQSVTAYMVSAAGLGLVAIYFATQVVFDKSDLAKYSA

SEQ ID NO: 4242 - protein, 768 aa, unidentified
MKMAPQNADPESMQVQELSVPLPDPQKAGGAEAENCETISEGSIDRIPMRLWVMHGAVMFGREFCYAMETALVTPILLQIGLPEQYYSLTWFLSPILGLIFTPLIGSASDRCTLSWGRRRPFILALCVGVLFGVALFLNGSAIGLALGDVPNRQPIGIVLTVLGVVVLDFSADATEGPIRAYLLDVVDSEEQDMALNIHAFSAGLGGAIGYVLGGLDWTQTFLGSWFRTQNQVLFFFAAIIFTVSVALHLFSIDEEQYSPQQERSAEEPGALDGGEPHGVPAFPDEVQSEHELALDYPDVDIMRSKSDSALHVPDTALDLEPELLFLHDIEPSIFHDASYPATPRSTSQELAKTKLPRLATFLKEAAKEDETLLDNHLNEAKVPNGSGSPTKDALGGYTRVDTKPSATSSSMRRRRHAFRRQASSTFSYYGKLGSHCYRYRRANAVVLIKPSRSMSDLYDMQKRQRQHRHRNQSGATTSSGDTESEEGEGETTVRLLWLSMLKMPRELMRLCLCHLLTWFSVIAEAVFYTDFMGQVIFEGDPKAPSNSTAWQAYNAGVKMGCWGLVIYAATGAICSALLQKYLDNYDLSVRVIYVLGTLGFSVGTAVMAMFPNVYVAMVTISTMGIVSMSISYCPYALLGQYHDIKQYIHHSPGNSKRGFGIDCAILSCQVYISQILVASALGGVVDAVGTVRVIPMVASVGSFLGFLTATFLVIYPNVSEEAKEEQKGLSSPLAGEGRAGGNSEKPTVLKLTRKEGLQGPVETESVV

SEQ ID NO: 4243 - protein, 459 aa, unidentified
MEGSASPPEKPRARPAAAVLCRGPVEPLVFLANFALVLQGPLTTQYLWHRFSADLGYNGTRQRGGCSNRSADPTMQEVETLTSHWTLYMNVGGFLVGLFSSTLLGAWSDSVGRRPLLVLASLGLLLQALVSVFVVQLQLHVGYFVLGRILCALLGDFGGLLAASFASVADVSSSRSRTFRMALLEASIGVAGMLASLLGGHWLRAQGYANPFWLALALLIAMTLYAAFCFGETLKEPKSTRLFTFRHHRSIVQLYVAPAPEKSRKHLALYSLAIFVVITVHFGAQDILTLYELSTPLCWDSKLIGYGSAAQHLPYLTSLLALKLLQYCLADAWVAEIGLAFNILGMVVFAFATITPLMFTGYGLLFLSLVITPVIRAKLSKLVRETEQGALFSAVACVNSLAMLTASGIFNSLYPATLNFMKGFPFLLGAGLLLIPAVLIGMLEKADPHLEFQQFPQSP

SEQ ID NO: 4244 - protein, 475 aa, unidentified
MSPEVTCPRRGHLPRFHPRTWVEPVVASSQVAASLYDAGLLLVVKASYGTGGSSNHSASPSPRGALEDQQQRAISNFYIIYNLVVGLSPLLSAYGLGWLSDRYHRKISICMSLLGFLLSRLGLLLKVLLDWPVEVLYGAAALNGLFGGFSAFWSGVMALGSLGSSEGRRSVRLILIDLMLGLAGFCGSMASGHLFKQMAGHSGQGLILTACSVSCASFALLYSLLVLKVPESVAKPSQELPAVDTVSGTVGTYRTLDPDQLDQQYAVGHPPSPGKAKPHKTTIALLFVGAIIYDLAVVGTVDVIPLFVLREPLGWNQVQVGYGMAAGYTIFITSFLGVLVFSRCFRDTTMIMIGMVSFGSGALLLAFVKETYMFYIARAVMLFALIPVTTIRSAMSKLIKGSSYGKVFVILQLSLALTGVVTSTLYNKIYQLTMDMFVGSCFALSSFLSFLAIIPISIVAYKQVPLSPYGDIIEK

SEQ ID NO: 4245 - protein, 461 aa, unidentified
MKILFVEPAIFLSAFAMTLTGPLTTQYVYRRIWEETGNYTFSSDSNISECEKNKSSPIFAFQEEVQKKVSRFNLQMDISGLIPGLVSTFILLSISDHYGRKFPMILSSVGALATSVWLCLLCYFAFPFQLLIASTFIGAFCGNYTTFWGACFAYIVDQCKEHKQKTIRIAIIDFLLGLVTGLTGLSSGYFIRELGFEWSFLIIAVSLAVNLIYILFFLGDPVKECSSQNVTMSCSEGFKNLFYRTYMLFKNASGKRRFLLCLLLFTVITYFFVVIGIAPIFILYELDSPLCWNEVFIGYGSALGSASFLTSFLGIWLFSYCMEDIHMAFIGIFTTMTGMAMTAFASTTLMMFLARVPFLFTIVPFSVLRSMLSKVVRSTEQGTLFACIAFLETLGGVTAVSTFNGIYSATVAWYPGFTFLLSAGLLLLPAISLCVVKCTSWNEGSYELLIQEESSEDASDR

SEQ ID NO: 4246 - protein, 570 aa, unidentified
MEAPEEPAPVRGGPEATLEVRGSRCLRLSAFREELRALLVLAGPAFLVQLMVFLISFISSVFCGHLGKLELDAVTLAIAVINVTGVSVGFGLSSACDTLISQTYGSQNLKHVGVILQRSALVLLLCCFPCWALFLNTQHILLLFRQDPDVSRLTQTYVTIFIPALPATFLYMLQVKYLLNQGIVLPQIVTGVAANLVNALANYLFLHQLHLGVIGSALANLISQYTLALLLFLYILGKKLHQATWGGWSLECLQDWASFLRLAIPSMLMLCMEWWAYEVGSFLSGILGMVELGAQSIVYELAIIVYMVPAGFSVAASVRVGNALGAGDMEQARKSSTVSLLITVLFAVAFSVLLLSCKDHVGYIFTTDRDIINLVAQVVPIYAVSHLFEALACTSGGVLRGSGNQKVGAIVNTIGYYVVGLPIGIALMFATTLGVMGLWSGIIICTVFQAVCFLGFIIQLNWKKACQQAQVHANLKVNNVPRSGNSALPQDPLHPGCPENLEGILTNDVGKTGEPQSDQQMRQEEPLPEHPQDGAKLSRKQLVLRRGLLLLGVFLILLVGILVRFYVRIQ

SEQ ID NO: 4247 - protein, 602 aa, unidentified
MDSLQDTVALDHGGCCPALSRLVPRGFGTEMWTLFALSGPLFLFQVLTFMIYIVSTVFCGHLGKVELASVTLAVAFVNVCGVSVGVGLSSACDTLMSQSFGSPNKKHVGVILQRGALVLLLCCLPCWALFLNTQHILLLFRQDPDVSRLTQDYVMIFIPGLPVIFLYNLLAKYLQNQGWLKGQEEESPFQTPGLSILHPSHSHLSRASFHLFQKITWPQVLSGVVGNCVNGVANYALVSVLNLGVRGSAYANIISQFAQTVFLLLYIVLKKLHLETWAGWSSQCLQDWGPFFSLAVPSMLMICVEWWAYEIGSFLMGLLSVVDLSAQAVIYEVATVTYMIPLGLSIGVCVRVGMALGAADTVQAKRSAVSGVLSIVGISLVLGTLISILKNQLGHIFTNDEDVIALVSQVLPVYSVFHVFEAICCVYGGVLRGTGKQAFGAAVNAITYYIIGLPLGILLTFVVRMRIMGLWLGMLACVFLATAAFVAYTARLDWKLAAEEAKKHSGRQQQQRAESTATRPGPEKAVLSSVATGSSPGITLTTYSRSECHVDFFRTPEEAHALSAPTSRLSVKQLVIRRGAALGAASATLMVGLTVRILATRH

SEQ ID NO: 4248 - protein, 146 aa, unidentified
MAPSRLQLGLRAAYSGISSVAGFSIFLVWTVVYRQPGTAAMGGLAGVLALWVLVTHVMYMQDYWRTWLKGLRGFFFVGVLFSAVSIAAFCTFLVLAITRHQSLTDPTSYYLSSVWSFISFKWAFLLSLYAHRYRADFADISILSDF

SEQ ID NO: 4249 - protein, 911 aa, unidentified
MEELQDDYEDMMEENLEQEEYEDPDIPESQMEEPAAHDTEATATDYHTTSHPGTHKVYVELQELVMDEKNQELRWMEAARWVQLEENLGENGAWGRPHLSHLTFWSLLELRRVFTKGTVLLDLQETSLAGVANQLLDRFIFEDQIRPQDREELLRALLLKHSHAGELEALGGVKPAVLTRSGDPSQPLLPQHSSLETQLFCEQGDGGTEGHSPSGILEKIPPDSEATLVLVGRADFLEQPVLGFVRLQEAAELEAVELPVPIRFLFVLLGPEAPHIDYTQLGRAAATLMSERVFRIDAYMAQSRGELLHSLEGFLDCSLVLPPTDAPSEQALLSLVPVQRELLRRRYQSSPAKPDSSFYKGLDLNGGPDDPLQQTGQLFGGLVRDIRRRYPYYLSDITDAFSPQVLAAVIFIYFAALSPAITFGGLLGEKTRNQMGVSELLISTAVQGILFALLGAQPLLVVGFSGPLLVFEEAFFSFCETNGLEYIVGRVWIGFWLILLVVLVVAFEGSFLVRFISRYTQEIFSFLISLIFIYETFSKLIKIFQDHPLQKTYNYNVLMVPKPQGPLPNTALLSLVLMAGTFFFAMMLRKFKNSSYFPGKLRRVIGDFGVPISILIMVLVDFFIQDTYTQKLSVPDGFKVSNSSARGWVIHPLGLRSEFPIWMMFASALPALLVFILIFLESQITTLIVSKPERKMVKGSGFHLDLLLVVGMGGVAALFGMPWLSATTVRSVTHANALTVMGKASTPGAAAQIQEVKEQRISGLLVAVLVGLSILMEPILSRIPLAVLFGIFLYMGVTSLSGIQLFDRILLLFKPPKYHPDVPYVKRVKTWRMHLFTGIQIICLAVLWVVKSTPASLALPFVLILTVPLRRVLLPLIFRNVELQCLDADDAKATFDEEEGRDEYDEVAMPV

SEQ ID NO: 4250 - protein, 1118 aa, unidentified
MEIKDQGAQMEPLLPTRNDEEAVVDRGGTRSILKTHFEKEDLEGHRTLFIGVHVPLGGRKSHRRHRHRGHKHRKRDRERDSGLEDGRESPSFDTPSQRVQFILGTEDDDEEHIPHDLFTELDEICWREGEDAEWRETARWLKFEEDVEDGGERWSKPYVATLSLHSLFELRSCILNGTVLLDMHANTLEEIADMVLDQQVSSGQLNEDVRHRVHEALMKQHHHQNQKKLTNRIPIVRSFADIGKKQSEPNSMDKNAGQVVSPQSAPACVENKNDVSRENSTVDFSKGLGGQQKGHTSPCGMKQRHEKGPPHQQEREVDLHFMKKIPPGAEASNILVGELEFLDRTVVAFVRLSPAVLLQGLAEVPIPTRFLFILLGPLGKGQQYHEIGRSIATLMTDEVFHDVAYKAKDRNDLVSGIDEFLDQVTVLPPGEWDPSIRIEPPKNVPSQEKRKIPAVPNGTAAHGEAEPHGGHSGPELQRTGRIFGGLILDIKRKAPYFWSDFRDAFSLQCLASFLFLYCACMSPVITFGGLLGEATEGRISAIESLFGASMTGIAYSLFGGQPLTILGSTGPVLVFEKILFKFCKEYGLSYLSLRASIGLWTATLCIILVATDASSLVCYITRFTEEAFASLICIIFIYEALEKLFELSEAYPINMHNDLELLTQYSCNCVEPHNPSNGTLKEWRESNISASDIIWENLTVSECKSLHGEYVGRACGHDHPYVPDVLFWSVILFFSTVTLSATLKQFKTSRYFPTKVRSIVSDFAVFLTILCMVLIDYAIGIPSPKLQVPSVFKPTRDDRGWFVTPLGPNPWWTVIAAIIPALLCTILIFMDQQITAVIINRKEHKLKKGCGYHLDLLMVAVMLGVCSIMGLPWFVAATVLSITHVNSLKLESECSAPGEQPKFLGIREQRVTGLMIFILMGSSVFMTSILKFIPMPVLYGVFLYMGASSLKGIQFFDRIKLFWMPAKHQPDFIYLRHVPLRKVHLFTIIQMSCLGLLWIIKVSRAAIVFPMMVLALVFVRKLMDLLFTKRELSWLDDLMPESKKKKLEDAEKEEEQSMLAMEDEGTVQLPLEGHYRDDPSVINISDEMSKTALWRNLLITADNSKDKESSFPSKSSPS

SEQ ID NO: 4251 - protein, 891 aa, unidentified
MSQVGGRGDRCTQEVQGLVHGAGDLSASLAENSPTMSQNGYFEDSSYYKCDTDDTFEAREEILGDEAFDTANSSIVSGESIRFFVNVNLEMQATNTENEATSGGCVLLHTSRKYLKLKNFKEEIRAHRDLDGFLAQASIVLNETATSLDNVLRTMLRRFARDPDNNEPNCNLDLLMAMLFTDAGAPMRGKVHLLSDTIQGVTATVTGVRYQQSWLCIICTMKALQKRHVCISRLVRPQNWGENSCEVRFVILVLAPPKMKSTKTAMEVARTFATMFSDIAFRQKLLETRTEEEFKEALVHQRQLLTMVSHGPVAPRTKERSTVSLPAHRHPEPPKCKDFVPFGKGIREDIARRFPLYPLDFTDGIIGKNKAVGKYITTTLFLYFACLLPTIAFGSLNDENTDGAIDVQKTIAGQSIGGLLYALFSGQPLVILLTTAPLALYIQVIRVICDDYDLDFNSFYAWTGLWNSFFLALYAFFNLSLVMSLFKRSTEEIIALFISITFVLDAVKGTVKIFWKYYYGHYLDDYHTKRTSSLVSLSGLGASLNASLHTALNASFLASPTELPSATHSGQATAVLSLLIMLGTLWLGYTLYQFKKSPYLHPCVREILSDCALPIAVLAFSLISSHGFREIEMSKFRYNPSESPFAMAQIQSLSLRAVSGAMGLGFLLSMLFFIEQNLVAALVNAPENRLVKGTAYHWDLLLLAIINTGLSLFGLPWIHAAYPHSPLHVRALALVEERVENGHIYDTIVNVKETRLTSLGASVLVGLSLLLLPVPLQWIPKPVLYGLFLYIALTSLDGNQLVQRVALLLKEQTAYPPTHYIRRVPQRKIHYFTGLQVLQLLLLCAFGMSSLPYMKMIFPLIMIAMIPIRYILLPRIIEAKYLDVMDAEHRP

SEQ ID NO: 4252 - protein, 1241 aa, unidentified
MSSAPRRPAKGADSFCTPEPESLGPGTPGFPEQEEDELHRTLGVERFEEILQEAGSRGGEEPGRSYGEEDFEYHRQSSHHIHHPLSTHLPPDARRRKTPQGPGRKPRRRPGASPTGETPTIEEGEEDEDEASEAEGARALTQPSPVSTPSSVQFFLQEDDSADRKAERTSPSSPAPLPHQEATPRASKGAQAGTQVEEAEAEAVAVASGTAGGDDGGASGRPLPKAQPGHRSYNLQERRRIGSMTGAEQALLPRVPTDEIEAQTLATADLDLMKSHRFEDVPGVRRHLVRKNAKGSTQSGREGREPGPTPRARPRAPHKPHEVFVELNELLLDKNQEPQWRETARWIKFEEDVEEETERWGKPHVASLSFRSLLELRRTLAHGAVLLDLDQQTLPGVAHQVVEQMVISDQIKAEDRANVLRALLLKHSHPSDEKDFSFPRNISAGSLGSLLGHHHGQGAESDPHVTEPLMGGVPETRLEVERERELPPPAPPAGITRSKSKHELKLLEKIPENAEATVVLVGCVEFLSRPTMAFVRLREAVELDAVLEVPVPVRFLFLLLGPSSANMDYHEIGRSISTLMSDKQFHEAAYLADEREDLLTAINAFLDCSVVLPPSEVQGEELLRSVAHFQRQMLKKREEQGRLLPTGAGLEPKSAQDKALLQMVEAAGAAEDDPLRRTGRPFGGLIRDVRRRYPHYLSDFRDALDPQCLAAVIFIYFAALSPAITFGGLLGEKTQDLIGVSELIMSTALQGVVFCLLGAQPLLVIGFSGPLLVFEEAFFSFCSSNHLEYLVGRVWIGFWLVFLALLMVALEGSFLVRFVSRFTQEIFAFLISLIFIYETFYKLVKIFQEHPLHGCSASNSSEVDGGENMTWAGARPTLGPGNRSLAGQSGQGKPRGQPNTALLSLVLMAGTFFIAFFLRKFKNSRFFPGRIRRVIGDFGVPIAILIMVLVDYSIEDTYTQKLSVPSGFSVTAPEKRGWVINPLGEKSPFPVWMMVASLLPAILVFILIFMETQITTLIISKKERMLQKGSGFHLDLLLIVAMGGICALFGLPWLAAATVRSVTHANALTVMSKAVAPGDKPKIQEVKEQRVTGLLVALLVGLSIVIGDLLRQIPLAVLFGIFLYMGVTSLNGIQFYERLHLLLMPPKHHPDVTYVKKVRTLRMHLFTALQLLCLALLWAVMSTAASLAFPFILILTVPLRMVVLTRIFTDREMKCLDANEAEPVFDEREGVDEYNEMPMPV

SEQ ID NO: 4253 - protein, 1232 aa, unidentified
MANGVIPPPGGASPLPQVRVPLEEPPLSPDVEEEDDDLGKTLAVSRFGDLISKPPAWDPEKPSRSYSERDFEFHRHTSHHTHHPLSARLPPPHKLRRLPPTSARHTRRKRKKEKTSAPPSEGTPPIQEEGGAGVDEEEEEEEEEEGESEAEPVEPPHSGTPQKAKFSIGSDEDDSPGLPGRAAVTKPLPSVGPHTDKSPQHSSSSPSPRARASRLAGEKSRPWSPSASYDLRERLCPGSALGNPGGPEQQVPTDEAEAQMLGSADLDDMKSHRLEDNPGVRRHLVKKPSRTQGGRGSPSGLAPILRRKKKKKKLDRRPHEVFVELNELMLDRSQEPHWRETARWIKFEEDVEEETERWGKPHVASLSFRSLLELRRTIAHGAALLDLEQTTLPGIAHLVVETMIVSDQIRPEDRASVLRTLLLKHSHPNDDKDSGFFPRNPSSSSMNSVLGNHHPTPSHGPDGAVPTMADDLGEPAPLWPHDPDAKEKPLHMPGGDGHRGKSLKLLEKIPEDAEATVVLVGCVPFLEQPAAAFVRLNEAVLLESVLEVPVPVRFLFVMLGPSHTSTDYHELGRSIATLMSDKLFHEAAYQADDRQDLLSAISEFLDGSIVIPPSEVEGRDLLRSVAAFQRELLRKRREREQTKVEMTTRGGYTAPGKELSLELGGSEATPEDDPLLRTGSVFGGLVRDVRRRYPHYPSDLRDALHSQCVAAVLFIYFAALSPAITFGGLLGEKTEGLMGVSELIVSTAVLGVLFSLLGAQPLLVVGFSGPLLVFEEAFFKFCRAQDLEYLTGRVWVGLWLVVFVLALVAAEGSFLVRYISPFTQEIFAFLISLIFIYETFYKLYKVFTEHPLLPFYPPEGALEGSLDAGLEPNGSALPPTEGPPSPRNQPNTALLSLILMLGTFFIAFFLRKFRNSRFLGGKARRIIGDFGIPISILVMVLVDYSITDTYTQKLTVPTGLSVTSPDKRSWFIPPLGSARPFPPWMMVAAAVPALLVLILIFMETQITALIVSQKARRLLKGSGFHLDLLLIGSLGGLCGLFGLPWLTAATVRSVTHVNALTVMRTAIAPGDKPQIQEVREQRVTGVLIASLVGLSIVMGAVLRRIPLAVLFGIFLYMGVTSLSGIQLSQRLLLILMPAKHHPEQPYVTKVKTWRMHLFTCIQLGCIALLWVVKSTAASLAFPFLLLLTVPLRHCLLPRLFQDRELQALDSEDAEPNFDEDGQDEYNELHMPV

SEQ ID NO: 4254 - protein, 1079 aa, unidentified
MEDEAVLDRGASFLKHVCDEEEVEGHHTIYIGVHVPKSYRRRRRHKRKTGHKEKKEKERISENYSDKSDIENADESSSSILKPLISPAAERIRFILGEEDDSPAPPQLFTELDELLAVDGQEMEWKETARWIKFEEKVEQGGERWSKPHVATLSLHSLFELRTCMEKGSIMLDREASSLPQLVEMIVDHQIETGLLKPELKDKVTYTLLRKHRHQTKKSNLRSLADIGKTVSSASRMFTNPDNGSPAMTHRNLTSSSLNDISDKPEKDQLKNKFMKKLPRDAEASNVLVGEVDFLDTPFIAFVRLQQAVMLGALTEVPVPTRFLFILLGPKGKAKSYHEIGRAIATLMSDEVFHDIAYKAKDRHDLIAGIDEFLDEVIVLPPGEWDPAIRIEPPKSLPSSDKRKNMYSGGENVQMNGDTPHDGGHGGGGHGDCEELQRTGRFCGGLIKDIKRKAPFFASDFYDALNIQALSAILFIYLATVTNAITFGGLLGDATDNMQGVLESFLGTAVSGAIFCLFAGQPLTILSSTGPVLVFERLLFNFSKDNNFDYLEFRLWIGLWSAFLCLILVATDASFLVQYFTRFTEEGFSSLISFIFIYDAFKKMIKLADYYPINSNFKVGYNTLFSCTCVPPDPANISISNDTTLAPEYLPTMSSTDMYHNTTFDWAFLSKKECSKYGGNLVGNNCNFVPDITLMSFILFLGTYTSSMALKKFKTSPYFPTTARKLISDFAIILSILIFCVIDALVGVDTPKLIVPSEFKPTSPNRGWFVPPFGENPWWVCLAAAIPALLVTILIFMDQQITAVIVNRKEHKLKKGAGYHLDLFWVAILMVICSLMALPWYVAATVISIAHIDSLKMETETSAPGEQPKFLGVREQRVTGTLVFILTGLSVFMAPILKFIPMPVLYGVFLYMGVASLNGVQFMDRLKLLLMPLKHQPDFIYLRHVPLRRVHLFTFLQVLCLALLWILKSTVAAIIFPVMILALVAVRKGMDYLFSQHDLSFLDDVIPEKDKKKKEDEKKKKKKKGSLDSDNDDSDCPYSEKVPSIKIPMDIMEQQPFLSDSKPSDRERSPTFLERHTSC

SEQ ID NO: 4255 - protein, 1137 aa, unidentified
MKVKEEKAGVGKLDHTNHRRRFPDQKECPPIHIGLPVPTYPQRKTDQKGHLSGLQKVHWGLRPDQPQQELTGPGSGASSQDSSMDLISRTRSPAAEQLQDILGEEDEAPNPTLFTEMDTLQHDGDQMEWKESARWIKFEEKVEEGGERWSKPHVSTLSLHSLFELRTCLQTGTVLLDLDSGSLPQIIDDVIEKQIEDGLLRPELRERVSYVLLRRHRHQTKKPIHRSLADIGKSVSTTNRSPARSPGAGPSLHHSTEDLRMRQSANYGRLCHAQSRSMNDISLTPNTDQRKNKFMKKIPKDSEASNVLVGEVDFLDQPFIAFVRLIQSAMLGGVTEVPVPTRFLFILLGPSGRAKSYNEIGRAIATLMVDDLFSDVAYKARNREDLIAGIDEFLDEVIVLPPGEWDPNIRIEPPKKVPSADKRKSVFSLAELGQMNGSVGGGGGAPGGGNGGGGGGGSGGGAGSGGAGGTSSGDDGEMPAMHEIGEELIWTGRFFGGLCLDIKRKLPWFPSDFYDGFHIQSISAILFIYLGCITNAITFGGLLGDATDNYQGVMESFLGTAMAGSLFCLFSGQPLIILSSTGPILIFEKLLFDFSKGNGLDYMEFRLWIGLHSAVQCLILVATDASFIIKYITRFTEEGFSTLISFIFIYDAIKKMIGAFKYYPINMDFKPNFITTYKCECVAPDTVNTTVFNASAPLAPDTNASLYNLLNLTALDWSLLSKKECLSYGGRLLGNSCKFIPDLALMSFILFFGTYSMTLTLKKFKFSRYFPTKVRALVADFSIVFSILMFCGIDACFGLETPKLHVPSVIKPTRPDRGWFVAPFGKNPWWVYPASILPALLVTILIFMDQQITAVIVNRKENKLKKAAGYHLDLFWVGILMALCSFMGLPWYVAATVISIAHIDSLKMETETSAPGEQPQFLGVREQRVTGIIVFILTGISVFLAPILKCIPLPVLYGVFLYMGVASLNGIQMGTGGSEFKIQKKLTPFWERCKLFLMPAKHQPDHAFLRHVPLRRIHLFTLVQILCLAVLWILKSTVAAIIFPVMILGLIIVRRLLDFIFSQHDLAWIDNILPEKEKKETDKKRKRKKGAHEDCDEEPQFPPPSVIKIPMESVQSDPQNGIHCIARKRSSSWSYSL

SEQ ID NO: 4256 - protein, 1214 aa, unidentified
MERFRLEKKLPGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGEGLSASRHSLRTGLSASNLSLRGESPLSLLLGHLLPSSRAGTPAGSRCTTPVPTPQNSPPSSPSISRLTSRSSQESQRQAPELLVSPASDDIPTVVIHPPEEDLEAALKGEEQKNEENVDLTPGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSPDKPVSVKISFEDEPRKKYVDAETSL

SEQ ID NO: 4257 - protein, 1093 aa, unidentified
MPAAGSNEPDGVLSYQRPDEEAVVDQGGTSTILNIHYEKEELEGHRTLYVGVRMPLGRQSHRHHRTHGQKHRRRGRGKGASQGEEGLEALAHDTPSQRVQFILGTEEDEEHVPHELFTELDEICMKEGEDAEWKETARWLKFEEDVEDGGERWSKPYVATLSLHSLFELRSCLINGTVLLDMHANSIEEISDLILDQQELSSDLNDSMRVKVREALLKKHHHQNEKKRNNLIPIVRSFAEVGKKQSDPHLMDKHGQTVSPQSVPTTNLEVKNGVNCEHSPVDLSKVDLHFMKKIPTGAEASNVLVGEVDILDRPIVAFVRLSPAVLLSGLTEVPIPTRFLFILLGPVGKGQQYHEIGRSMATIMTDEIFHDVAYKAKERDDLLAGIDEFLDQVTVLPPGEWDPSIRIEPPKNVPSQEKRKMPGVPNGNVCHIEQEPHGGHSGPELQRTGRLFGGLVLDIKRKAPWYWSDYRDALSLQCLASFLFLYCACMSPVITFGGLLGEATEGRISAIESLFGASMTGIAYSLFAGQALTILGSTGPVLVFEKILFKFCKDYALSYLSLRACIGLWTAFLCIVLVATDASSLVCYITRFTEEAFASLICIIFIYEAIEKLIHLAETYPIHMHSQLDHLSLYYCRCTLPENPNNHTLQYWKDHNIVTAEVHWANLTVSECQEMHGEFMGSACGHHGPYTPDVLFWSCILFFTTFILSSTLKTFKTSRYFPTRVRSMVSDFAVFLTIFTMVIIDFLIGVPSPKLQVPSVFKPTRDDRGWIINPIGPNPWWTVIAAIIPALLCTILIFMDQQITAVIINRKEHKLKKGCGYHLDLLMVAIMLGVCSIMGLPWFVAATVLSITHVNSLKLESECSAPGEQPKFLGIREQRVTGLMIFVLMGCSVFMTAILKFIPMPVLYGVFLYMGVSSLQGIQFFDRLKLFGMPAKHQPDFIYLRHVPLRKVHLFTLIQLTCLVLLWVIKASPAAIVFPMMVLALVFVRKVMDLCFSKRELSWLDDLMPESKKKKLDDAKKKAKEEEEAEKMLEIGGDKFPLESRKLLSSPGKNISCRCDPSEINISDEMPKTTVWKALSMNSGNAKEKSLFN

SEQ ID NO: 4258 - protein, 983 aa, unidentified
MEMKLPGQEGFEASSAPRNIPSGELDSNPDPGTGPSPDGPSDTESKELGVPKDPLLFIQLNELLGWPQALEWRETGSSSASLLLDMGEMPSITLSTHLHHRWVLFEEKLEVAAGRWSAPHVPTLALPSLQKLRSLLAEGLVLLDCPAQSLLELVEQVTRVESLSPELRGQLQALLLQRPQHYNQTTGTRPCWGSTHPRKASDNEEAPLREQCQNPLRQKLPPGAEAGTVLAGELGFLAQPLGAFVRLRNPVVLGSLTEVSLPSRFFCLLLGPCMLGKGYHEMGRAAAVLLSDPQFQWSVRRASNLHDLLAALDAFLEEVTVLPPGRWDPTARIPPPKCLPSQHKRLPSQQREIRGPAVPRLTSAEDRHRHGPHAHSPELQRTGRLFGGLIQDVRRKVPWYPSDFLDALHLQCFSAVLYIYLATVTNAITFGGLLGDATDGAQGVLESFLGTAVAGAAFCLMAGQPLTILSSTGPVLVFERLLFSFSRDYSLDYLPFRLWVGIWVATFCLVLVATEASVLVRYFTRFTEEGFCALISLIFIYDAVGKMLNLTHTYPIQKPGSSAYGCLCQYPGPGGNESQWIRTRPKDRDDIVSMDLGLINASLLPPPECTRQGGHPRGPGCHTVPDIAFFSLLLFLTSFFFAMALKCVKTSRFFPSVVRKGLSDFSSVLAILLGCGLDAFLGLATPKLMVPREFKPTLPGRGWLVSPFGANPWWWSVAAALPALLLSILIFMDQQITAVILNRMEYRLQKGAGFHLDLFCVAVLMLLTSALGLPWYVSATVISLAHMDSLRRESRACAPGERPNFLGIREQRLTGLVVFILTGASIFLAPVLKFIPMPVLYGIFLYMGVAALSSIQFTNRVKLLLMPAKHQPDLLLLRHVPLTRVHLFTAIQLACLGLLWIIKSTPAAIIFPLMLLGLVGVRKALERVFSPQELLWLDELMPEEERSIPEKGLEPEHSFSGSDSEDSELMYQPKAPEINISVN

SEQ ID NO: 4259 - protein, 221 aa, unidentified
MEAGGFLDSLIYGACVVFTLGMFSAGLSDLRHMRMTRSVDNVQFLPFLTTEVNNLGWLSYGALKGDGILIVVNTVGAALQTLYILAYLHYCPRKRVVLLQTATLLGVLLLGYGYFWLLVPNPEARLQQLGLFCSVFTISMYLSPLADLAKVIQTKSTQCLSYPLTIATLLTSASWCLYGFRLRDPYIMVSNFPGIVTSFIRFWLFWKYPQEQDRNYWLLQT

SEQ ID NO: 4260 - protein, 340 aa, unidentified
MEPGRTQIKLDPRYTADLLEVLKTNYGIPSACFSQPPTAAQLLRALGPVELALTSILTLLALGSIAIFLEDAVYLYKNTLCPIKRRTLLWKSSAPTVVSVLCCFGLWIPRSLVLVEMTITSFYAVCFYLLMLVMVEGFGGKEAVLRTLRDTPMMVHTGPCCCCCPCCPRLLLTRKKLQLLMLGPFQYAFLKITLTLVGLFLVPDGIYDPADISEGSTALWINTFLGVSTLLALWTLGIISRQARLHLGEQNMGAKFALFQVLLILTALQPSIFSVLANGGQIACSPPYSSKTRSQVMNCHLLILETFLMTVLTRMYYRRKDHKVGYETFSSPDLDLNLKA

SEQ ID NO: 4261 - protein, 128 aa, unidentified
MEHSEGAPGDPAGTVVPQELLEEMLWFFRVEDASPWNHSILALAAVVVIISMVLLGRSIQASRKEKMQPPEKETPEVLHLDEAKDHNSLNNLRETLLSEKPNLAQVELELKERDVLSVFLPDVPETES

SEQ ID NO: 4262 - protein, 448 aa, unidentified
MAAPTLGRLVLTHLLVALFGMGSWAAVNGIWVELPVVVKDLPEGWSLPSYLSVVVALGNLGLLVVTLWRQLAPGKGEQVPIQVVQVLSVVGTALLAPLWHHVAPVAGQLHSVAFLTLALVLAMACCTSNVTFLPFLSHLPPPFLRSFFLGQGLSALLPCVLALVQGVGRLECPPAPTNGTSGPPLDFPERFPASTFFWALTALLVTSAAAFRGLLLLLPSLPSVTTGGSGPELQLGSPGAEEEEKEEEEALPLQEPPSQAAGTIPGPDPEAHQLFSAHGAFLLGLMAFTSAVTNGVLPSVQSFSCLPYGRLAYHLAVVLGSAANPLACFLAMGVLCRSLAGLVGLSLLGMLFGAYLMALAILSPCPPLVGTTAGVVLVVLSWVLCLCVFSYVKVAASSLLHGGGRPALLAAGVAIQVGSLLGAGAMFPPTSIYHVFQSRKDCVDPCGP

SEQ ID NO: 4263 - protein, 445 aa, unidentified
MAAPTPARPVLTHLLVALFGMGSWAAVNGIWVELPVVVKELPEGWSLPSYVSVLVALGNLGLLVVTLWRRLAPGKDEQVPIRVVQVLGMVGTALLASLWHHVAPVAGQLHSVAFLALAFVLALACCASNVTFLPFLSHLPPRFLRSFFLGQGLSALLPCVLALVQGVGRLECPPAPINGTPGPPLDFLERFPASTFFWALTALLVASAAAFQGLLLLLPPPPSVPTGELGSGLQVGAPGAEEEVEESSPLQEPPSQAAGTTPGPDPKAYQLLSARSACLLGLLAATNALTNGVLPAVQSFSCLPYGRLAYHLAVVLGSAANPLACFLAMGVLCRSLAGLGGLSLLGVFCGGYLMALAVLSPCPPLVGTSAGVVLVVLSWVLCLGVFSYVKVAASSLLHGGGRPALLAAGVAIQVGSLLGAVAMFPPTSIYHVFHSRKDCADPCDS

SEQ ID NO: 4264 - protein, 469 aa, unidentified
MAFLMHLLVCVFGMGSWVTINGLWVELPLLVMELPEGWYLPSYLTVVIQLANIGPLLVTLLHHFRPSCLSEVPIIFTLLGVGTVTCIIFAFLWNMTSWVLDGHHSIAFLVLTFFLALVDCTSSVTFLPFMSRLPTYYLTTFFVGEGLSGLLPALVALAQGSGLTTCVNVTEISDSVPSPVPTRETDIAQGVPRALVSALPGMEAPLSHLESRYLPAHFSPLVFFLLLSIMMACCLVAFFVLQRQPRCWEASVEDLLNDQVTLHSIRPREENDLGPAGTVDSSQGQGYLEEKAAPCCPAHLAFIYTLVAFVNALTNGMLPSVQTYSCLSYGPVAYHLAATLSIVANPLASLVSMFLPNRSLLFLGVLSVLGTCFGGYNMAMAVMSPCPLLQGHWGGEVLIVASWVLFSGCLSYVKVMLGVVLRDLSRSALLWCGAAVQLGSLLGALLMFPLVNVLRLFSSADFCNLHCPA

SEQ ID NO: 4265 - protein, 664 aa, unidentified
MDSSTWSPKTTAVTRPVETHELIRNAADISIIVIYFVVVMAVGLWAMFSTNRGTVGGFFLAGRSMVWWPIGASLFASNIGSGHFVGLAGTGAASGIAIGGFEWNALVLVVVLGWLFVPIYIKAGVVTMPEYLRKRFGGQRIQVYLSLLSLLLYIFTKISADIFSGAIFINLALGLNLYLAIFLLLAITALYTITGGLAAVIYTDTLQTVIMLVGSLILTGFAFHEVGGYDAFMEKYMKAIPTIVSDGNTTFQEKCYTPRADSFHIFRDPLTGDLPWPGFIFGMSILTLWYWCTDQVIVQRCLSAKNMSHVKGGCILCGYLKLMPMFIMVMPGMISRILYTEKIACVVPSECEKYCGTKVGCTNIAYPTLVVELMPNGLRGLMLSVMLASLMSSLTSIFNSASTLFTMDIYAKVRKRASEKELMIAGRLFILVLIGISIAWVPIVQSAQSGQLFDYIQSITSYLGPPIAAVFLLAIFWKRVNEPGAFWGLILGLLIGISRMITEFAYGTGSCMEPSNCPTIICGVHYLYFAIILFAISFITIVVISLLTKPIPDVHLYRLCWSLRNSKEERIDLDAEEENIQEGPKETIEIETQVPEKKKGIFRRAYDLFCGLEQHGAPKMTEEEEKAMKMKMTDTSEKPLWRTVLNVNGIILVTVAVFCHAYFA

SEQ ID NO: 4266 - protein, 596 aa, unidentified
MAANSTSDLHTPGTQLSVADIIVITVYFALNVAVGIWSSCRASRNTVNGYFLAGRDMTWWPIGASLFASSEGSGLFIGLAGSGAAGGLAVAGFEWNATYVLLALAWVFVPIYISSEIVTLPEYIQKRYGGQRIRMYLSVLSLLLSVFTKISLDLYAGALFVHICLGWNFYLSTILTLGITALYTIAGGLAAVIYTDALQTLIMVVGAVILTIKAFDQIGGYGQLEAAYAQAIPSRTIANTTCHLPRTDAMHMFRDPHTGDLPWTGMTFGLTIMATWYWCTDQVIVQRSLSARDLNHAKAGSILASYLKMLPMGLIIMPGMISRALFPDDVGCVVPSECLRACGAEVGCSNIAYPKLVMELMPIGLRGLMIAVMLAALMSSLTSIFNSSSTLFTMDIWRRLRPRSGERELLLVGRLVIVALIGVSVAWIPVLQDSNSGQLFIYMQSVTSSLAPPVTAVFVLGVFWRRANEQGAFWGLIAGLVVGATRLVLEFLNPAPPCGEPDTRPAVLGSIHYLHFAVALFALSGAVVVAGSLLTPPPQSVQIENLTWWTLAQDVPLGTKAGDGQTPQKHAFWARVCGFNAILLMCVNIFFYAYFA

SEQ ID NO: 4267 - protein, 675 aa, unidentified
MESGTSSPQPPQLDPLDAFPQKGLEPGDIAVLVLYFLFVLAVGLWSTVKTKRDTVKGYFLAGGDMVWWPVGASLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 4268 - protein, 618 aa, unidentified
MEVKNFAVWDYVVFAALFFISSGIGVFFAIKERKKATSREFLVGGRQMSFGPVGLSLTASFMSAVTVLGTPSEVYRFGASFLVFFIAYLFVILLTSELFLPVFYRSGITSTYEYLQLRFNKPVRYAATVIYIVQTILYTGVVVYAPALALNQVTGFDLWGSVFATGIVCTFYCTLGGLKAVVWTDAFQMVVMIVGFLTVLIQGSTHAGGFHNVLEQSTNGSRLHIFDFDVDPLRRHTFWTITVGGTFTWLGIYGVNQSTIQRCISCKTEKHAKLALYFNLLGLWIILVCAVFSGLIMYSHFKDCDPWTSGIISAPDQLMPYFVMEIFATMPGLPGLFVACAFSGTLSTVASSINALATVTFEDFVKSCFPHLSDKLSTWISKGLCLLFGVMCTSMAVAASVMGGVVQASLSIHGMCGGPMLGLFSLGIVFPFVNWKGALGGLLTGITLSFWVAIGAFIYPAPASKTWPLPLSTDQCIKSNVTATGPPVLSSRPGIADTWYSISYLYYSAVGCLGCIVAGVIISLITGRQRGEDIQPLLIRPVCNLFCFWSKKYKTLCWCGVQHDSGTEQENLENGSARKQGAESVLQNGLRRESLVHVPGYDPKDKSYNNMAFETTHF

SEQ ID NO: 4269 - protein, 672 aa, unidentified
MEEHTEAGSAPEMGAQKALIDNPADILVIAAYFLLVIGVGLWSMCRTNRGTVGGYFLAGRSMVWWPVGASLFASNIGSGHFVGLAGTGAASGLAVAGFEWNALFVVLLLGWLFAPVYLTAGVITMPQYLRKRFGGRRIRLYLSVLSLFLYIFTKISVDMFSGAVFIQQALGWNIYASVIALLGITMIYTVTGGLAALMYTDTVQTFVILGGACILMGYAFHEVGGYSGLFDKYLGAATSLTVSEDPAVGNISSFCYRPRPDSYHLLRHPVTGDLPWPALLLGLTIVSGWYWCSDQVIVQRCLAGKSLTHIKAGCILCGYLKLTPMFLMVMPGMISRILYPDEVACVVPEVCRRVCGTEVGCSNIAYPRLVVKLMPNGLRGLMLAVMLAALMSSLASIFNSSSTLFTMDIYTRLRPRAGDRELLLVGRLWVVFIVVVSVAWLPVVQAAQGGQLFDYIQAVSSYLAPPVSAVFVLALFVPRVNEQGAFWGLIGGLLMGLARLIPEFSFGSGSCVQPSACPAFLCGVHYLYFAIVLFFCSGLLTLTVSLCTAPIPRKHLHRLVFSLRHSKEEREDLDADEQQGSSLPVQNGCPESAMEMNEPQAPAPSLFRQCLLWFCGMSRGGVGSPPPLTQEEAAAAARRLEDISEDPSWARVVNLNALLMMAVAVFLWGFYA

SEQ ID NO: 4270 - protein, 718 aa, unidentified
MRAVLDTADIAIVALYFILVMCIGFFAMWKSNRSTVSGYFLAGRSMTWVTIGASLFVSNIGSEHFIGLAGSGAASGFAVGAWEFNALLLLQLLGWVFIPIYIRSGVYTMPEYLSKRFGGHRIQVYFAALSLILYIFTKLSVDLYSGALFIQESLGWNLYVSVILLIGMTALLTVTGGLVAVIYTDTLQALLMIIGALTLMIISIMEIGGFEEVKRRYMLASPDVTSILLTYNLSNTNSCNVSPKKEALKMLRNPTDEDVPWPGFILGQTPASVWYWCADQVIVQRVLAAKNIAHAKGSTLMAGFLKLLPMFIIVVPGMISRILFTDDIACINPEHCMLVCGSRAGCSNIAYPRLVMKLVPVGLRGLMMAVMIAALMSDLDSIFNSASTIFTLDVYKLIRKSASSRELMIVGRIFVAFMVVISIAWVPIIVEMQGGQMYLYIQEVADYLTPPVAALFLLAIFWKRCNEQGAFYGGMAGFVLGAVRLILAFAYRAPECDQPDNRPGFIKDIHYMYVATGLFWVTGLITVIVSLLTPPPTKEQIRTTTFWSKKNLVVKENCSPKEEPYQMQEKSILRCSENNETINHIIPNGKSEDSIKGLQPEDVNLLVTCREEGNPVASLGHSEAETPVDAYSNGQAALMGEKERKKETDDGGRYWKFIDWFCGFKSKSLSKRSLRDLMEEEAVCLQMLEETRQVKVILNIGLFAVCSLGIFMFVYFSL

SEQ ID NO: 4271 - protein, 659 aa, unidentified
MASTVSPSTIAETPEPPPLSDHIRNAADISVIVIYFLVVMAVGLWAMLKTNRGTIGGFFLAGRDMAWWPMGASLFASNIGSNHYVGLAGTGAASGVATVTFEWTSSVMLLILGWIFVPIYIKSGVMTMPEYLKKRFGGERLQVYLSILSLFICVVLLISADIFAGAIFIKLALGLDLYLAIFILLAMTAVYTTTGGLASVIYTDTLQTIIMLIGSFILMGFAFNEVGGYESFTEKYVNATPSVVEGDNLTISASCYTPRADSFHIFRDAVTGDIPWPGIIFGMPITALWYWCTNQVIVQRCLCGKDMSHVKAACIMCAYLKLLPMFLMVMPGMISRILYTDMVACVVPSECVKHCGVDVGCTNYAYPTMVLELMPQGLRGLMLSVMLASLMSSLTSIFNSASTLFTIDLYTKMRKQASEKELLIAGRIFVLLLTVVSIVWVPLVQVSQNGQLIHYTESISSYLGPPIAAVFVLAIFCKRVNEQGAFWGLMVGLAMGLIRMITEFAYGTGSCLAPSNCPKIICGVHYLYFSIVLFFGSMLVTLGISLLTKPIPDVHLYRLCWVLRNSTEERIDIDAEEKSQEETDDGVEEDYPEKSRGCLKKAYDLFCGLQKGPKLTKEEEEALSKKLTDTSERPSWRTIVNINAILLLAVVVFIHGYYA

SEQ ID NO: 4272 - protein, 643 aa, unidentified
MEAVETGERPTFGAWDYGVFALMLLVSTGIGLWVGLARGGQRSAEDFFTGGRRLAALPVGLSLSASFMSAVQVLGVPSEAYRYGLKFLWMCLGQLLNSVLTALLFMPVFYRLGLTSTYEYLEMRFSRAVRLCGTLQYIVATMLYTGIVIYAPALILNQVTGLDIWASLLSTGIICTFYTAVGGMKAVVWTDVFQVVVMLSGFWVVLARGVMLVGGPRQVLTLAQNHSRINLMDFNPDPRSRYTFWTFVVGGTLVWLSMYGVNQAQVQRYVACRTEKQAKLALLINQVGLFLIVSSAACCGIVMFVFYTDCDPLLLGRISAPDQYMPLLVLDIFEDLPGVPGLFLACAYSGTLSTASTSINAMAAVTVEDLIKPRLRSLAPRKLVIISKGLSLIYGSACLTVAALSSLLGGGVLQGSFTVMGVISGPLLGAFILGMFLPACNTPGVLAGLGAGLALSLWVALGATLYPPSEQTMRVLPSSAARCVALSVNASGLLDPALLPANDSSRAPSSGMDASRPALADSFYAISYLYYGALGTLTTVLCGALISCLTGPTKRSTLAPGLLWWDLARQTASVAPKEEVAILDDNLVKGPEELPTGNKKPPGFLPTNEDRLFFLGQKELEGAGSWTPCVGHDGGRDQQETNL

SEQ ID NO: 4273 - protein, 635 aa, unidentified
MSVGVSTSAPLSPTSGTSVGMSTFSIMDYVVFVLLLVLSLAIGLYHACRGWGRHTVGELLMADRKMGCLPVALSLLATFQSAVAILGVPSEIYRFGTQYWFLGCCYFLGLLIPAHIFIPVFYRLHLTSAYEYLELRFNKTVRVCGTVTFIFQMVIYMGVVLYAPSLALNAVTGFDLWLSVLALGIVCTVYTALGGLKAVIWTDVFQTLVMFLGQLAVIIVGSAKVGGLGRVWAVASQHGRISGFELDPDPFVRHTFWTLAFGGVFMMLSLYGVNQAQVQRYLSSRTEKAAVLSCYAVFPFQQVSLCVGCLIGLVMFAYYQEYPMSIQQAQAAPDQFVLYFVMDLLKGLPGLPGLFIACLFSGSLSTISSAFNSLATVTMEDLIRPWFPEFSEARAIMLSRGLAFGYGLLCLGMAYISSQMGPVLQAAISIFGMVGGPLLGLFCLGMFFPCANPPGAVVGLLAGLVMAFWIGIGSIVTSMGSSMPPSPSNGSSFSLPTNLTVATVTTLMPLTTFSKPTGLQRFYSLSYLWYSAHNSTTVIVVGLIVSLLTGRMRGRSLNPATIYPVLPKLLSLLPLSCQKRLHCRSYGQDHLDTGLFPEKPRNGVLGDSRDKEAMALDGTAYQGSSSTCILQETSL

SEQ ID NO: 4274 - protein, 580 aa, unidentified
MAFHVEGLIAIIVFYLLILLVGIWAAWRTKNSGSAEERSEAIIVGGRDIGLLVGGFTMTATWVGGGYINGTAEAVYVPGYGLAWAQAPIGYSLSLILGGLFFAKPMRSKGYVTMLDPFQQIYGKRMGGLLFIPALMGEMFWAAAIFSALGATISVIIDVDMHISVIISALIATLYTLVGGLYSVAYTDVVQLFCIFVGLWISVPFALSHPAVADIGFTAVHAKYQKPWLGTVDSSEVYSWLDSFLLLMLGGIPWQAYFQRVLSSSSATYAQVLSFLAAFGCLVMAIPAILIGAIGASTDWNQTAYGLPDPKTTEEADMILPIVLQYLCPVYISFFGLGAVSAAVMSSADSSILSASSMFARNIYQLSFRQNASDKEIVWVMRITVFVFGASATAMALLTKTVYGLWYLSSDLVYIVIFPQLLCVLFVKGTNTYGAVAGYVSGLFLRITGGEPYLYLQPLIFYPGYYPDDNGIYNQKFPFKTLAMVTSFLTNICISYLAKYLFESGTLPPKLDVFDAVVARHSEENMDKTILVKNENIKLDELALVKPRQSMTLSSTFTNKEAFLDVDSSPEGSGTEDNLQ

SEQ ID NO: 4275 - protein, 610 aa, unidentified
MDTPRGIGTFVVWDYVVFAGMLVISAAIGIYYAFAGGGQQTSKDFLMGGRRMTAVPVALSLTASFMSAVTVLGTPSEVYRFGAIFSIFAFTYFFVVVISAEVFLPVFYKLGITSTYEYLELRFNKCVRLCGTVLFIVQTILYTGIVIYAPALALNQVTGFDLWGAVVATGVVCTFYCTLGGLKAVIWTDVFQVGIMVAGFASVIIQAVVMQGGISTILNDAYDGGRLNFWNFNPNPLQRHTFWTIIIGGTFTWTSIYGVNQSQVQRYISCKSRFQAKLSLYINLVGLWAILTCSVFCGLALYSRYHDCDPWTAKKVSAPDQLMPYLVLDILQDYPGLPGLFVACAYSGTLSTVSSSINALAAVTVEDLIKPYFRSLSERSLSWISQGMSVVYGALCIGMAALASLMGALLQAALSVFGMVGGPLMGLFALGILVPFANSIGALVGLMAGFAISLWVGIGAQIYPPLPERTLPLHLDIQGCNSTYNETNLMTTTEMPFTTSVFQIYNVQRTPLMDNWYSLSYLYFSTVGTLVTLLVGILVSLSTGGRKQNLDPRYILTKEDFLSNFDIFKKKKHVLSYKSHPVEDGGTDNPAFNHIELNSDQSGKSNGTRL

SEQ ID NO: 4276 - protein, 681 aa, unidentified
MSKELAAMGPGASGDGVRTETAPHIALDSRVGLHAYDISVVVIYFVFVIAVGIWSSIRASRGTIGGYFLAGRSMSWWPIGASLMSSNVGSGLFIGLAGTGAAGGLAVGGFEWNATWLLLALGWVFVPVYIAAGVVTMPQYLKKRFGGQRIQVYMSVLSLILYIFTKISTDIFSGALFIQMALGWNLYLSTGILLVVTAVYTIAGGLMAVIYTDALQTVIMVGGALVLMFLGFQDVGWYPGLEQRYRQAIPNVTVPNTTCHLPRPDAFHILRDPVSGDIPWPGLIFGLTVLATWCWCTDQVIVQRSLSAKSLSHAKGGSVLGGYLKILPMFFIVMPGMISRALFPDEVGCVDPDVCQRICGARVGCSNIAYPKLVMALMPVGLRGLMIAVIMAALMSSLTSIFNSSSTLFTIDVWQRFRRKSTEQELMVVGRVFVVFLVVISILWIPIIQSSNSGQLFDYIQAVTSYLAPPITALFLLAIFCKRVTEPGAFWGLVFGLGVGLLRMILEFSYPAPACGEVDRRPAVLKDFHYLYFAILLCGLTAIVIVIVSLCTTPIPEEQLTRLTWWTRNCPLSELEKEAHESTPEISERPAGECPAGGGAAENSSLGQEQPEAPSRSWGKLLWSWFCGLSGTPEQALSPAEKAALEQKLTSIEEEPLWRHVCNINAVLLLAINIFLWGYFA

SEQ ID NO: 4277 - protein, 599 aa, unidentified [sequence omitted]

SEQ ID NO: 4278 - protein, 632 aa, unidentified
MTAEKALPLGNGKAAEEARESEAPGGGCSSGGAAPARHPRVKRDKAVHERGHWNNKVEFVLSVAGEIIGLGNVWRFPYLCYKNGGGAFLIPYVVFFICCGIPVFFLETALGQFTSEGGITCWRKVCPLFEGIGYATQVIEAHLNVYYIIILAWAIFYLSNCFTTELPWATCGHEWNTENCVEFQKLNVSNYSHVSLQNATSPVMEFWEHRVLAISDGIEHIGNLRWELALCLLAAWTICYFCIWKGTKSTGKVVYVTATFPYIMLLILLIRGVTLPGASEGIKFYLYPDLSRLSDPQVWVDAGTQIFFSYAICLGCLTALGSYNNYNNNCYRDCIMLCCLNSGTSFVAGFAIFSVLGFMAYEQGVPIAEVAESGPGLAFIAYPKAVTMMPLSPLWATLFFMMLIFLGLDSQFVCVESLVTAVVDMYPKVFRRGYRRELLILALSVISYFLGLVMLTEGGMYIFQLFDSYAASGMCLLFVAIFECICIGWVYGSNRFYDNIEDMIGYRPPSLIKWCWMIMTPGICAGIFIFFLIKYKPLKYNNIYTYPAWGYGIGWLMALSSMLCIPLWICITVWKTEGTLPEKLQKLTTPSTDLKMRGKLGVSPRMVTVNDCDAKLKSDGTIAAITEKETHF

SEQ ID NO: 4279 - protein, 614 aa, unidentified
MDGKVAVQECGPPAVSWVPEEGEKLDQEDEDQVKDRGQWTNKMEFVLSVAGEIIGLGNVWRFPYLCYKNGGGAFFIPYFIFFFVCGIPVFFLEVALGQYTSQGSVTAWRKICPLFQGIGLASVVIESYLNVYYIIILAWALFYLFSSFTSELPWTTCNNFWNTEHCTDFLNHSGAGTVTPFENFTSPVMEFWERRVLGITSGIHDLGSLRWELALCLLLAWVICYFCIWKGVKSTGKVVYFTATFPYLMLVILLIRGVTLPGAYQGIIYYLKPDLFRLKDPQVWMDAGTQIFFSFAICQGCLTALGSYNKYHNNCYKDCIALCFLNSATSFVAGFVVFSILGFMSQEQGVPISEVAESGPGLAFIAFPKAVTMMPLSQLWSCLFFIMLIFLGLDSQFVCVECLVTASIDMFPRQLRKSGRRELLILTIAVMCYLIGLFLVTEGGMYIFQLFDYYASSGICLLFLSLFEVVCISWVYGADRFYDNIEDMIGYRPWPLVKISWLFLTPGLCLATFLFSLSKYTPLKYNNVYVYPPWGYSIGWFLALSSMVCVPLFVVITLLKTRGPFRKRLRQLITPDSSLPQPKQHPCLDGSAGRNFGPSPTREGLIAGEKETHL

SEQ ID NO: 4280 - protein, 602 aa, unidentified
MDSRVSGTTSNGETKPVYPVMEKKEEDGTLERGHWNNKMEFVLSVAGEIIGLGNVWRFPYLCYKNGGGAFFIPYLVFLFTCGIPVFLLETALGQYTSQGGVTAWRKICPIFEGIGYASQMIVILLNVYYIIVLAWALFYLFSSFTIDLPWGGCYHEWNTEHCMEFQKTNGSLNGTSENATSPVIEFWERRVLKISDGIQHLGALRWELALCLLLAWVICYFCIWKGVKSTGKVVYFTATFPYLMLVVLLIRGVTLPGAAQGIQFYLYPNLTRLWDPQVWMDAGTQIFFSFAICLGCLTALGSYNKYHNNCYRDCIALCFLNSGTSFVAGFAIFSILGFMSQEQGVPISEVAESGPGLAFIAYPRAVVMLPFSPLWACCFFFMVVLLGLDSQFVCVESLVTALVDMYPHVFRKKNRREVLILGVSVVSFLVGLIMLTEGGMYVFQLFDYYAASGMCLLFVAIFESLCVAWVYGAKRFYDNIEDMIGYRPWPLIKYCWLFLTPAVCTATFLFSLIKYTPLTYNKKYTYPWWGDALGWLLALSSMVCIPAWSLYRLGTLKGPFRERIRQLMCPAEDLPQRNPAGPSAPATPRTSLLRLTELESHC

SEQ ID NO: 4281 - protein, 730 aa, unidentified
MPKNSKVVKRELDDDVTESVKDLLSNEDAADDAFKTSELIVDGQEEKDTDVEEGSEVEDERPAWNSKLQYILAQVGFSVGLGNVWRFPYLCQKNGGGAYLLPYLILLMVIGIPLFFLELSVGQRIRRGSIGVWNYISPKLGGIGFASCVVCYFVALYYNVIIGWSLFYFSQSFQQPLPWDQCPLVKNASHTFVEPECEQSSATTYYWYREALNISSSISESGGLNWKMTICLLAAWVMVCLAMIKGIQSSGKIIYFSSLFPYVVLICFLIRAFLLNGSIDGIRHMFTPKLEIMLEPKVWREAATQVFFALGLGFGGVIAFSSYNKRDNNCHFDAVLVSFINFFTSVLATLVVFAVLGFKANVINEKCITQNSETIMKFLKMGNISQDIIPHHINLSTVTAEDYHLVYDIIQKVKEEEFPALHLNSCKIEEELNKAVQGTGLAFIAFTEAMTHFPASPFWSVMFFLMLVNLGLGSMFGTIEGIVTPIVDTFKVRKEILTVICCLLAFCIGLIFVQRSGNYFVTMFDDYSATLPLLIVVILENIAVCFVYGIDKFMEDLKDMLGFAPSRYYYYMWKYISPLMLLSLLIASVVNMGLSPPGYNAWIEDKASEEFLSYPTWGLVVCVSLVVFAILPVPVVFIVRRFNLIDDSSGNLASVTYKRGRVLKEPVNLEGDDTSLIHGKIPSEMPSPNFGKNIYRKQSGSPTLDTAPNGRYGIGYLMADIMPDMPESDL

SEQ ID NO: 4282 - protein, 736 aa, unidentified
MKTEAQPSTSLLANTSWTGTVISDSVPGSQTWEDKGSLTRSATSWTSEAQVSAARVAEAQARTSQPKQISVLEALTASALNQKPTHEKVQMTEKKESEVLLARPFWSSKTEYILAQVGFSMKPSCLWRFAYLWLNSGGCSFAAIYIFMLFLVGVPLLFLEMAAGQSMRQGGMGVWKIIAPWIGGVGYSSFMVCFILGLYFNVVNSWIIFYMSQSFQFPVPWEKCPLTMNSSGFDPECERTTPSIYFWYQQALKASDRIEDGGSPVYSLVLPFFLCWCLVGAFMINGLKSTGKVIYVLVLLPCFIIVGFFIRTLLLEGAKFGLQQLVVAKISDVYNMSVWSLAGGQVLSNTGIGLGSVASLASYMPQSNNCLSDAFLVSVINLLTLLVFTSFNFCVLGFWATVITHRCCERNAEILLKLINLGKLPPDAKPPVNLLYNPTSIYNAWLSGLPQHIKSMVLREVTECNIETQFLKASEGPKFAFLSFVEAMSFLPPSVFWSFIFFLMLLAMGLSSAIGIMQGIITPLQDTFSFFRKHTKLLIVGVFLLMFVCGLFFTRPSGSYFIRLLSDYWIVFPIIVVVVFETMAVSWAYGARRFLADLTILLGHPISPIFGWLWPHLCPVVLLIIFVTMMVHLCMKPITYMSWDSSTSKEVLRPYPPWALLLMITLFAIVILPIPAYFVYCRIHRIPFRPKSGDGPMTASTSLPLSHQLTPSKEVQKEEILQVDETKYPSTCNVTS

SEQ ID NO: 4283 - protein, 727 aa, unidentified
MPKNSKVTQREHSSEHVTESVADLLALEEPVDYKQSVLNVAGEAGGKQKAVEEELDAEDRPAWNSKLQYILAQIGFSVGLGNIWRFPYLCQKNGGGAYLVPYLVLLIIIGIPLFFLELAVGQRIRRGSIGVWHYICPRLGGIGFSSCIVCLFVGLYYNVIIGWSIFYFFKSFQYPLPWSECPVVRNGSVAVVEAECEKSSATTYFWYREALDISDSISESGGLNWKMTLCLLVAWSIVGMAVVKGIQSSGKVMYFSSLFPYVVLACFLVRGLLLRGAVDGILHMFTPKLDKMLDPQVWREAATQVFFALGLGFGGVIAFSSYNKQDNNCHFDAALVSFINFFTSVLATLVVFAVLGFKANIMNEKCVVENAEKILGYLNTNVLSRDLIPPHVNFSHLTTKDYMEMYNVIMTVKEDQFSALGLDPCLLEDELDKSVQGTGLAFIAFTEAMTHFPASPFWSVMFFLMLINLGLGSMIGTMAGITTPIIDTFKVPKEMFTVGCCVFAFLVGLLFVQRSGNYFVTMFDDYSATLPLTLIVILENIAVAWIYGTKKFMQELTEMLGFRPYRFYFYMWKFVSPLCMAVLTTASIIQLGVTPPGYSAWIKEEAAERYLYFPNWAMALLITLIVVATLPIPVVFVLRHFHLLSDGSNTLSVSYKKGRMMKDISNLEENDETRFILSKVPSEAPSPMPTHRSYLGPGSTSPLETSGNPNGRYGSGYLLASTPESEL

SEQ ID NO: 4284 - protein, 628 aa, unidentified
MAHAPEPDPAACDLGDERPKWDNKAQYLLSCTGFAVGLGNIWRFPYLCQTYGGGAFLIPYVIALVFEGIPIFHVELAIGQRLRKGSVGVWTAISPYLSGVGLGCVTLSFLISLYYNTIVAWVLWYLLNSFQHPLPWSSCPPDLNRTGFVEECQGSSAVSYFWYRQTLNITADINDSGSIQWWLLICLAASWAVVYMCVIRGIETTGKVIYFTALFPYLVLTIFLIRGLTLPGATKGLIYLFTPNMHILQNPRVWLDAATQIFFSLSLAFGGHIAFASYNSPRNDCQKDAVVIALVNRMTSLYASIAVFSVLGFKATNDYEHCLDRNILSLINDFDFPEQSISRDDYPAVLMHLNATWPKRVAQLPLKACLLEDFLDKSASGPGLAFVVFTETDLHMPGAPVWAMLFFGMLFTLGLSTMFGTVEAVITPLLDVGVLPRWVPKEALTGLVCLVCFLSATCFTLQSGNYWLEIFDNFAASPNLLMLAFLEVVGVVYVYGMKRFCDDIAWMTGRRPSPYWRLTWRVVSPLLLTIFVAYIILLFWKPLRYKAWNPKYELFPSRQEKLYPGWARAACVLLSLLPVLWVPVAALAQLLTRRRRTWRDRDARPDTDMRPDTDTRPDTDMRPDTDMR

SEQ ID NO: 4285 - protein, 634 aa, unidentified
MVRLVLPNPGLDARIPSLAELETIEQEEASSRPKWDNKAQYMLTCLGFCVGLGNVWRFPYLCQSHGGGAFMIPFLILLVLEGIPLLYLEFAIGQRLRRGSLGVWSSIHPALKGLGLASMLTSFMVGLYYNTIISWIMWYLFNSFQEPLPWSDCPLNENQTGYVDECARSSPVDYFWYRETLNISTSISDSGSIQWWMLLCLACAWSVLYMCTIRGIETTGKAVYITSTLPYVVLTIFLIRGLTLKGATNGIVFLFTPNVTELAQPDTWLDAGAQVFFSFSLAFGGLISFSSYNSVHNNCEKDSVIVSIINGFTSVYVAIVVYSVIGFRATQRYDDCFSTNILTLINGFDLPEGNVTQENFVDMQQRCNASDPAAYAQLVFQTCDINAFLSEAVEGTGLAFIVFTEAITKMPLSPLWSVLFFIMLFCLGLSSMFGNMEGVVVPLQDLRVIPPKWPKEVLTGLICLGTFLIGFIFTLNSGQYWLSLLDSYAGSIPLLIIAFCEMFSVVYVYGVDRFNKDIEFMIGHKPNIFWQVTWRVVSPLLMLIIFLFFFVVEVSQELTYSIWDPGYEEFPKSQKISYPNWVYVVVVIVAGVPSLTIPGYAIYKLIRNHCQKPGDHQGLVSTLSTASMNGDLKY

SEQ ID NO: 4286 - protein, 617 aa, unidentified [sequence omitted]

SEQ ID NO: 4287 - protein, 592 aa, unidentified
MEKARPLWANSLQFVFACISYAVGLGNVWRFPYLCQMYGGGSFLVPYIIMLIVEGMPLLYLELAVGQRMRQGSIGAWRTISPYLSGVGVASVVVSFFLSMYYNVINAWAFWYLFHSFQDPLPWSVCPLNGNHTGYDEECEKASSTQYFWYRKTLNISPSLQENGGVQWEPALCLLLAWLVVYLCILRGTESTGKVVYFTASLPYCVLIIYLIRGLTLHGATNGLMYMFTPKIEQLANPKAWINAATQIFFSLGLGFGSLIAFASYNEPSNNCQKHAIIVSLINSFTSIFASIVTFSIYGFKATFNYENCLKKVSLLLTNTFDLEDGFLTASNLEQVKGYLASAYPSKYSEMFPQIKNCSLESELDTAVQGTGLAFIVYTEAIKNMEVSQLWSVLYFFMLLMLGIGSMLGNTAAILTPLTDSKIISSHLPKEAISGLVCLVNCAIGMVFTMEAGNYWFDIFNDYAATLSLLLIVLVETIAVCYVYGLRRFESDLKAMTGRAVSWYWKVMWAGVSPLLIVSLFVFYLSDYILTGTLKYQAWDASQGQLVTKDYPAYALAVIGLLVASSTMCIPLAALGTFVQRRLKRGDADPVA

SEQ ID NO: 4288 - protein, 620 aa, unidentified
MSKSKCSVGLMSSVVAPAKEPNAVGPKEVELILVKEQNGVQLTSSTLTNPRQSPVEAQDRETWGKKIDFLLSVIGFAVDLANVWRFPYLCYKNGGGAFLVPYLLFMVIAGMPLFYMELALGQFNREGAAGVWKICPILKGVGFTVILISLYVGFFYNVIIAWALHYLFSSFTTELPWIHCNNSWNSPNCSDAHPGDSSGDSSGLNDTFGTTPAAEYFERGVLHLHQSHGIDDLGPPRWQLTACLVLVIVLLYFSLWKGVKTSGKVVWITATMPYVVLTALLLRGVTLPGAIDGIRAYLSVDFYRLCEASVWIDAATQVCFSLGVGFGVLIAFSSYNKFTNNCYRDAIVTTSINSLTSFSSGFVVFSFLGYMAQKHSVPIGDVAKDGPGLIFIIYPEAIATLPLSSAWAVVFFIMLLTLGIDSAMGGMESVITGLIDEFQLLHRHRELFTLFIVLATFLLSLFCVTNGGIYVFTLLDHFAAGTSILFGVLIEAIGVAWFYGVGQFSDDIQQMTGQRPSLYWRLCWKLVSPCFLLFVVVVSIVTFRPPHYGAYIFPDWANALGWVIATSSMAMVPIYAAYKFCSLPGSFREKLAYAIAPEKDRELVDRGEVRQFTLRHWLKV

SEQ ID NO: 4289 - protein, 630 aa, unidentified
METTPLNSQKQLSACEDGEDCQENGVLQKVVPTPGDKVESGQISNGYSAVPSPGAGDDTRHSIPATTTTLVAELHQGERETWGKKVDFLLSVIGYAVDLGNVWRFPYICYQNGGGAFLLPYTIMAIFGGIPLFYMELALGQYHRNGCISIWRKICPIFKGIGYAICIIAFYIASYYNTIMAWALYYLISSFTDQLPWTSCKNSWNTGNCTNYFSEDNITWTLHSTSPAEEFYTRHVLQIHRSKGLQDLGGISWQLALCIMLIFTVIYFSIWKGVKTSGKVVWVTATFPYIILSVLLVRGATLPGAWRGVLFYLKPNWQKLLETGVWIDAAAQIFFSLGPGFGVLLAFASYNKFNNNCYQDALVTSVVNCMTSFVSGFVIFTVLGYMAEMRNEDVSEVAKDAGPSLLFITYAEAIANMPASTFFAIIFFLMLITLGLDSTFAGLEGVITAVLDEFPHVWAKRRERFVLAVVITCFFGSLVTLTFGGAYVVKLLEEYATGPAVLTVALIEAVAVSWFYGITQFCRDVKEMLGFSPGWFWRICWVAISPLFLLFIICSFLMSPPQLRLFQYNYPYWSIILGYCIGTSSFICIPTYIAYRLIITPGTFKERIIKSITPETPTEIPCGDIRLNAV

SEQ ID NO: 4290 - protein, 797 aa, unidentified
MDCSAPKEMNKLPANSPEAAAAQGHPDGPCAPRTSPEQELPAAAAPPPPRVPRSASTGAQTFQSADARACEAERPGVGSCKLSSPRAQAASAALRDLREAQGAQASPPPGSSGPGNALHCKIPFLRGPEGDANVSVGKGTLERNNTPVVGWVNMSQSTVVLATDGITSVLPGSVATVATQEDEQGDENKARGNWSSKLDFILSMVGYAVGLGNVWRFPYLAFQNGGGAFLIPYLMMLALAGLPIFFLEVSLGQFASQGPVSVWKAIPALQGCGIAMLIISVLIAIYYNVIICYTLFYLFASFVSVLPWGSCNNPWNTPECKDKTKLLLDSCVISDHPKIQIKNSTFCMTAYPNVTMVNFTSQANKTFVSGSEEYFKYFVLKISAGIEYPGEIRWPLALCLFLAWVIVYASLAKGIKTSGKVVYFTATFPYVVLVILLIRGVTLPGAGAGIWYFITPKWEKLTDATVWKDAATQIFFSLSAAWGGLITLSSYNKFHNNCYRDTLIVTCTNSATSIFAGFVIFSVIGFMANERKVNIENVADQGPGIAFVVYPEALTRLPLSPFWAIIFFLMLLTLGLDTMFATIETIVTSISDEFPKYLRTHKPVFTLGCCICFFIMGFPMITQGGIYMFQLVDTYAASYALVIIAIFELVGISYVYGLQRFCEDIEMMIGFQPNIFWKVCWAFVTPTILTFILCFSFYQWEPMTYGSYRYPNWSMVLGWLMLACSVIWIPIMFVIKMHLAPGRFIERLKLVCSPQPDWGPFLAQHRGERYKNMIDPLGTSSLGLKLPVKDLELGTQC

SEQ ID NO: 4291 - protein, 620 aa, unidentified
MATKEKLQCLKDFHKDILKPSPGKSPGTRPEDEAEGKPPQREKWSSKIDFVLSVAGGFVGLGNVWRFPYLCYKNGGGAFLIPYFIFLFGSGLPVFFLEIIIGQYTSEGGITCWEKICPLFSGIGYASVVIVSLLNVYYIVILAWATYYLFQSFQKELPWAHCNHSWNTPHCMEDTMRKNKSVWITISSTNFTSPVIEFWERNVLSLSPGIDHPGSLKWDLALCLLLVWLVCFFCIWKGVRSTGKVVYFTATFPFAMLLVLLVRGLTLPGAGAGIKFYLYPDITRLEDPQVWIDAGTQIFFSYAICLGAMTSLGSYNKYKYNSYRDCMLLGCLNSGTSFVSGFAIFSILGFMAQEQGVDIADVAESGPGLAFIAYPKAVTMMPLPTFWSILFFIMLLLLGLDSQFVEVEGQITSLVDLYPSFLRKGYRREIFIAFVCSISYLLGLTMVTEGGMYVFQLFDYYAASGVCLLWVAFFECFVIAWIYGGDNLYDGIEDMIGYRPGPWMKYSWAVITPVLCVGCFIFSLVKYVPLTYNKTYVYPNWAIGLGWSLALSSMLCVPLVIVIRLCQTEGPFLVRVKYLLTPREPNRWAVEREGATPYNSRTVMNGALVKPTHIIVETMM

SEQ ID NO: 4292 - protein, 636 aa, unidentified
MKKLQGAHLRKPVTPDLLMTPSDQGDVDLDVDFAAHRGNWTGKLDFLLSCIGYCVGLGNVWRFPYRAYTNGGGAFLVPYFLMLAICGIPLFFLELSLGQFSSLGPLAVWKISPLFKGAGAAMLLIVGLVAIYYNMIIAYVLFYLFASLTSDLPWEHCGNWWNTELCLEHRVSKDGNGALPLNLTCTVSPSEEYWSRYVLHIQGSQGIGSPGEIRWNLCLCLLLAWVIVFLCILKGVKSSGKVVYFTATFPYLILLMLLVRGVTLPGAWKGIQFYLTPQFHHLLSSKVWIEAALQIFYSLGVGFGGLLTFASYNTFHQNIYRDTFIVTLGNAITSILAGFAIFSVLGYMSQELGVPVDQVAKAGPGLAFVVYPQAMTMLPLSPFWSFLFFFMLLTLGLDSQFAFLETIVTAVTDEFPYYLRPKKAVFSGLICVAMYLMGLILTTDGGMYWLVLLDDYSASFGLMVVVITTCLAVTRVYGIQRFCRDIHMMLGFKPGLYFRACWLFLSPATLLALMVYSIVKYQPSEYGSYRFPPWAELLGILMGLLSCLMIPAGMLVAVLREEGSLWERLQQASRPAMDWGPSLEENRTGMYVATLAGSQSPKPLMVHMRKYGGITSFENTAIEVDREIAEEEESMM

SEQ ID NO: 4293 - protein, 635 aa, unidentified
MAKKSAENGIYSVSGDEKKGPLIAPGPDGAPAKGDGPVGLGTPGGRLAVPPRETWTRQMDFIMSCVGFAVGLGNVWRFPYLCYKNGGGVFLIPYVLIALVGGIPIFFLEISLGQFMKAGSINVWNICPLFKGLGYASMVIVFYCNTYYIMVLAWGFYYLVKSFTTTLPWATCGHTWNTPDCVEIFRHEDCANASLANLTCDQLADRRSPVIEFWENKVLRLSGGLEVPGALNWEVTLCLLACWVLVYFCVWKGVKSTGKIVYFTATFPYVVLVVLLVRGVLLPGALDGIIYYLKPDWSKLGSPQVWIDAGTQIFFSYAIGLGALTALGSYNRFNNNCYKDAIILALINSGTSFFAGFVVFSILGFMAAEQGVHISKVAESGPGLAFIAYPRAVTLMPVAPLWAALFFFMLLLLGLDSQFVGVEGFITGLLDLLPASYYFRFQREISVALCCALCFVIDLSMVTDGGMYVFQLFDYYSASGTTLLWQAFWECVVVAWVYGADRFMDDIACMIGYRPCPWMKWCWSFFTPLVCMGIFIFNVVYYEPLVYNNTYVYPWWGEAMGWAFALSSMLCVPLHLLGCLLRAKGTMAERWQHLTQPIWGLHHLEYRAQDADVRGLTTLTPVSESSKVVVVESVM

SEQ ID NO: 4294 - protein, 706 aa, unidentified
MSGGDTRAAIARPRMAAAHGPVAPSSPEQVTLLPVQRSFFLPPFSGATPSTSLAESVLKVWHGAYNSGLLPQLMAQHSLAMAQNGAVPSEATKRDQNLKRGNWGNQIEFVLTSVGYAVGLGNVWRFPYLCYRNGGGAFMFPYFIMLIFCGIPLFFMELSFGQFASQGCLGVWRISPMFKGVGYGMMVVSTYIGIYYNVVICIAFYYFFSSMTHVLPWAYCNNPWNTHDCAGVLDASNLTNGSRPAALPSNLSHLLNHSLQRTSPSEEYWRLYVLKLSDDIGNFGEVRLPLLGCLGVSWLVVFLCLIRGVKSSGKVVYFTATFPYVVLTILFVRGVTLEGAFDGIMYYLTPQWDKILEAKVWGDAASQIFYSLGCAWGGLITMASYNKFHNNCYRDSVIISITNCATSVYAGFVIFSILGFMANHLGVDVSRVADHGPGLAFVAYPEALTLLPISPLWSLLFFFMLILLGLGTQFCLLETLVTAIVDEVGNEWILQKKTYVTLGVAVAGFLLGIPLTSQAGIYWLLLMDNYAASFSLVVISCIMCVAIMYIYGHRNYFQDIQMMLGFPPPLFFQICWRFVSPAIIFFILVFTVIQYQPITYNHYQYPGWAVAIGFLMALSSVLCIPLYAMFRLCRTDGDTLLQRLKNATKPSRDWGPALLEHRTGRYAPTIAPSPEDGFEVQPLHPDKAQIPIVGSNGSSRLQDSRI

SEQ ID NO: 4295 - protein, 629 aa, unidentified
MGCKVLLNIGQQMLRRKVVDCSREETRLSRCLNTFDLVALGVGSTLGAGVYVLAGAVARENAGPAIVISFLIAALASVLAGLCYGEFGARVPKTGSAYLYSYVTVGELWAFITGWNLILSYIIGTSSVARAWSATFDELIGRPIGEFSRTHMTLNAPGVLAENPDIFAVIIILILTGLLTLGVKESAMVNKIFTCINVLVLGFIMVSGFVKGSVKNWQLTEEDFGNTSGRLCLNNDTKEGKPGVGGFMPFGFSGVLSGAATCFYAFVGFDCIATTGEEVKNPQKAIPVGIVASLLICFIAYFGVSAALTLMMPYFCLDNNSPLPDAFKHVGWEGAKYAVAVGSLCALSASLLGSMFPMPRVIYAMAEDGLLFKFLANVNDRTKTPIIATLASGAVAAVMAFLFDLKDLVDLMSIGTLLAYSLVAACVLVLRYQPEQPNLVYQMASTSDELDPADQNELASTNDSQLGFLPEAEMFSLKTILSPKNMEPSKISGLIVNISTSLIAVLIITFCIVTVLGREALTKGALWAVFLLAGSALLCAVVTGVIWRQPESKTKLSFKVPFLPVLPILSIFVNVYLMMQLDQGTWVRFAVWMLIGFIIYFGYGLWHSEEASLDADQARTPDGNLDQCK

SEQ ID NO: 4296 - protein, 523 aa, unidentified
MAGHTQQPSGRGNPRPAPSPSPVPGTVPGASERVALKKEIGLLSACTIIIGNIIGSGIFISPKGVLEHSGSVGLALFVWVLGGGVTALGSLCYAELGVAIPKSGGDYAYVTEIFGGLAGFLLLWSAVLIMYPTSLAVISMTFSNYVLQPVFPNCIPPTTASRVLSMACLMLLTWVNSSSVRWATRIQDMFTGGKLLALSLIIGVGLLQIFQGHFEELRPSNAFAFWMTPSVGHLALAFLQGSFAFSGWNFLNYVTEEMVDARKNLPRAIFISIPLVTFVYTFTNIAYFTAMSPQELLSSNAVAVTFGEKLLGYFSWVMPVSVALSTFGGINGYLFTYSRLCFSGAREGHLPSLLAMIHVRHCTPIPALLVCCGATAVIMLVGDTYTLINYVSFINYLCYGVTILGLLLLRWRRPALHRPIKVNLLIPVAYLVFWAFLLVFSFISEPMVCGVGVIIILTGVPIFFLGVFWRSKPKCVHRLTESMTHWGQELCFVVYPQDAPEEEENGPCPPSLLPATDKPSKPQ

SEQ ID NO: 4297 - protein, 501 aa, unidentified
MVRKPVVSTISKGGYLQGNVNGRLPSLGNKEPPGQEKVQLKRKVTLLRGVSIIIGTIIGAGIFISPKGVLQNTGSVGMSLTIWTVCGVLSLFGALSYAELGTTIKKSGGHYTYILEVFGPLPAFVRVWVELLIIRPAATAVISLAFGRYILEPFFIQCEIPELAIKLITAVGITVVMVLNSMSVSWSARIQIFLTFCKLTAILIIIVPGVMQLIKGQTQNFKDAFSGRDSSITRLPLAFYYGMYAYAGWFYLNFVTEEVENPEKTIPLAICISMAIVTIGYVLTNVAYFTTINAEELLLSNAVAVTFSERLLGNFSLAVPIFVALSCFGSMNGGVFAVSRLFYVASREGHLPEILSMIHVRKHTPLPAVIVLHPLTMIMLFSGDLDSLLNFLSFARWLFIGLAVAGLIYLRYKCPDMHRPFKVPLFIPALFSFTCLFMVALSLYSDPFSTGIGFVITLTGVPAYYLFIIWDKKPRWFRIMSEKITRTLQIILEVVPEEDKL

SEQ ID NO: 4298 - protein, 470 aa, unidentified
MDRGEKIQLKRVFGYWWGTSFLLINIIGAGIFVSPKGVLAYSCMNVGVSLCVWAGCAILAMTSTLCSAEISISFPCSGAQYYFLKRYFGSTVAFLNLWTSLFLGSGVVAGQALLLAEYSIQPFFPSCSVPKLPKKCLALAMLWIVGILTSRGVKEVTWLQIASSVLKVSILSFISLTGVVFLIRGKKENVERFQNAFDAELPDISHLIQAIFQGYFAYSGGACFTLIAGELKKPRTTIPKCIFTALPLVTVVYLLVNISYLTVLTPREILSSDAVAITWADRAFPSLAWIMPFAISTSLFSNLLISIFKSSRPIYLASQEGQLPLLFNTLNSHSSPFTAVLLLVTLGSLAIILTSLIDLINYIFFTGSLWSILLMIGILRRRYQEPNLSIPYKVFLSFPLATIVIDVGLVVIPLVKSPNVHYVYVLLLVLSGLLFYIPLIHFKIRLAWFEKMTCYLQLLFNICLPDVSEE

SEQ ID NO: 4299 - protein, 771 aa, unidentified
MSGFFTSLDPRRVQWGAAWYAMHSRILRTKPVESMLEGTGTTTAHGTKLAQVLTTVDLISLGVGSCVGTGMYVVSGLVAKEMAGPGVIVSFIIAAVASILSGVCYAEFGVRVPKTTGSAYTYSYVTVGEFVAFFIGWNLILEYLIGTAAGASALSSMFDSLANHTISRWMADSVGTLNGLGKGEESYPDLLALLIAVIVTIIVALGVKNSIGFNNVLNVLNLAVWVFIMIAGLFFINGKYWAEGQFLPHGWSGVLQGAATCFYAFIGFDIIATTGEEAKNPNTSIPYAITASLVICLTAYVSVSVILTLMVPYYTIDTESPLMEMFVAHGFYAAKFVVAIGSVAGLTVSLLGSLFPMPRVIYAMAGDGLLFRFLAHVSSYTETPVVACIVSGFLAALLALLVSLRDLIEMMSIGTLLAYTLVSVCVLLLRYQPESDIDGFVKFLSEEHTKKKEGILADCEKEACSPVSEGDEFSGPATNTCGAKNLPSLGDNEMLIGKSDKSTYNVNHPNYGTVDMTTGIEADESENIYLIKLKKLIGPHYYTMRIRLGLPGKMDRPTAATGHTVTICVLLLFILMFIFCSFIIFGSDYISEQSWWAILLVVLMVLLISTLVFVILQQPENPKKLPYMAPCLPFVPAFAMLVNIYLMLKLSTITWIRFAVWCFVGLLIYFGYGIWNSTLEISAREEALHQSTYQRYDVDDPFSVEEGFSYATEGESQEDWGGPTEDKGFYYQQMSDAKANGRTSSKAKSKSKHKQNSEALIANDELDYSPE

SEQ ID NO: 4300 - protein, 658 aa, unidentified
MIPCRAALTFARCLIRRKIVTLDSLEDTKLCRCLSTMDLIALGVGSTLGAGVYVLAGEVAKADSGPSIVVSFLIAALASVMAGLCYAEFGARVPKTGSAYLYTYVTVGELWAFITGWNLILSYVIGTSSVARAWSGTFDELLSKQIGQFLRTYFRMNYTGLAEYPDFFAVCLILLLAGLLSFGVKESAWVNKVFTAVNILVLLFVMVAGFVKGNVANWKISEEFLKNISASAREPPSENGTSIYGAGGFMPYGFTGTLAGAATCFYAFVGFDCIATTGEEVRNPQKAIPIGIVTSLLVCFMAYFGVSAALTLMMPYYLLDEKSPLPVAFEYVGWGPAKYVVAAGSLCALSTSLLGSIFPMPRVIYAMAEDGLLFKCLAQINSKTKTPIIATLSSGAVAALMAFLFDLKALVDMMSIGTLMAYSLVAACVLILRYQPGLSYDQPKCSPEKDGLGSSPRVTSKSESQVTMLQRQGFSMRTLFCPSLLPTQQSASLVSFLVGFLAFLVLGLSVLTTYGVHAITRLEAWSLALLALFLVLFVAIVLTIWRQPQNQQKVAFMVPFLPFLPAFSILVNIYLMVQLSADTWVRFSIWMAIGFLIYFSYGIRHSLEGHLRDENNEEDAYPDNVHAAAEEKSAIQANDHHPRNLSSPFIFHEKTSEF

SEQ ID NO: 4301 - protein, 619 aa, unidentified
MPWQAFRRFGQKLVRRRTLESGMAETRLARCLSTLDLVALGVGSTLGAGVYVLAGEVAKDKAGPSIVICFLVAALSSVLAGLCYAEFGARVPRSGSAYLYSYVTVGELWAFTTGWNLILSYVIGTASVARAWSSAFDNLIGNHISKTLQGSIALHVPHVLAEYPDFFALGLVLLLTGLLALGASESALVTKVFTGVNLLVLGFVMISGFVKGDVHNWKLTEEDYELAMAELNDTYSLGPLGSGGFVPFGFEGILRGAATCFYAFVGFDCIATTGEEAQNPQRSIPMGIVISLSVCFLAYFAVSSALTLMMPYYQLQPESPLPEAFLYIGWAPARYVVAVGSLCALSTSLLGSMFPMPRVIYAMAEDGLLFRVLARIHTGTRTPIIATVVSGIIAAFMAFLFKLTDLVDLMSIGTLLAYSLVSICVLILRYQPDQETKTGEEVELQEEAITTESEKLTLWGLFFPLNSIPTPLSGQIVYVCSSLLAVLLTALCLVLAQWSVPLLSGDLLWTAVVVLLLLLIIGIIVVIWRQPQSSTPLHFKVPALPLLPLMSIFVNIYLMMQMTAGTWARFGVWMLIGFAIYFGYGIQHSLEEIKSNQPSRKSRAKTVDLDPGTLYVHSV

SEQ ID NO: 4302 - protein, 635 aa, unidentified
MARGLPTIASLARLCQKLNRLKPLEDSTMETSLRRCLSTLDLTLLGVGGMVGSGLYVLTGAVAKEVAGPAVLLSFGVAAVASLLAALCYAEFGARVPRTGSAYLFTYVSMGELWAFLIGWNVLLEYIIGGAAVARAWSGYLDSMFSHSIRNFTETHVGSWQVPLLGHYPDFLAAGIILLASAFVSCGARVSSWLNHTFSAISLLVILFIVILGFILAQPHNWSADEGGFAPFGFSGVMAGTASCFYAFVGFDVIAASSEEAQNPRRSVPLAIAISLAIAAGAYILVSTVLTLMVPWHSLDPDSALADAFYQRGYRWAGFIVAAGSICAMNTVLLSLLFSLPRIVYAMAADGLFFQVFAHVHPRTQVPVAGTLAFGLLTAFLALLLDLESLVQFLSLGTLLAYTFVATSIIVLRFQKSSPPSSPGPASPGPLTKQQSSFSDHLQLVGTVHASVPEPGELKPALRPYLGFLDGYSPGAVVTWALGVMLASAITIGCVLVFGNSTLHLPHWGYILLLLLTSVMFLLSLLVLGAHQQQYREDLFQIPMVPLIPALSIVLNICLMLKLSYLTWVRFSIWLLMGLAVYFGYGIRHSKENQRELPGLNSTHYVVFPRGSLEETVQAMQPPSQAPAQDPGHME

SEQ ID NO: 4303 - protein, 507 aa, unidentified
MAGAGPKRRALAAPAAEEKEEAREKMLAAKSADGSAPAGEGEGVTLQRNITLLNGVAIIVGTIIGSGIFVTPTGVLKEAGSPGLALVVWAACGVFSIVGALCYAELGTTISKSGGDYAYMLEVYGSLPAFLKLWIELLIIRPSSQYIVALVFATYLLKPLFPTCPVPEEAAKLVACLCVLLLTAVNCYSVKAATRVQDAFAAAKLLALALIILLGFVQIGKGDVSNLDPNFSFEGTKLDVGNIVLALYSGLFAYGGWNYLNFVTEEMINPYRNLPLAIIISLPIVTLVYVLTNLAYFTTLSTEQMLSSEAVAVDFGNYHLGVMSWIIPVFVGLSCFGSVNGSLFTSSRLFFVGSREGHLPSILSMIHPQLLTPVPSLVFTCVMTLLYAFSKDIFSVINFFSFFNWLCVALAIIGMIWLRHRKPELERPIKVNLALPVFFILACLFLIAVSFWKTPVECGIGFTIILSGLPVYFFGVWWKNKPKWLLQGIFSTTVLCQKLMQVVPQET

SEQ ID NO: 4304 - protein, 515 aa, unidentified
MEAREPGRPTPTYHLVPNTSQSQVEEDVSSPPQRSSETMQLKKEISLLNGVSLVVGNMIGSGIFVSPKGVLVHTASYGMSLIVWAIGGLFSVVGALCYAELGTTITKSGASYAYILEAFGGFIAFIRLWVSLLVVEPTGQAIIAITFANYIIQPSFPSCDPPYLACRLLAAACICLLTFVNCAYVKWGTRVQDTFTYAKVVALIAIIVMGLVKLCQGHSEHFQDAFEGSSWDMGNLSLALYSALFSYSGWDTLNFVTEEIKNPERNLPLAIGISMPIVTLIYILTNVAYYTVLNISDVLSSDAVAVTFADQTFGMFSWTIPIAVALSCFGGLNASIFASSRLFFVGSREGHLPDLLSMIHIERFTPIPALLFNCTMALIYLIVEDVFQLINYFSFSYWFFVGLSVVGQLYLRWKEPKRPRPLKLSVFFPIVFCICSVFLVIVPLFTDTINSLIGIGIALSGVPFYFMGVYLPESRRPLFIRNVLAAITRGTQQLCFCVLTELDVAEEKKDERKTD

SEQ ID NO: 4305 - protein, 511 aa, unidentified
MVDSTEYEVASQPEVETSPLGDGASPGPEQVKLKKEISLLNGVCLIVGNMIGSGIFVSPKGVLIYSASFGLSLVIWAVGGLFSVFGALCYAELGTTIKKSGASYAYILEAFGGFLAFIRLWTSLLIIEPTSQAIIAITFANYMVQPLFPSCFAPYAASRLLAAACICLLTFINCAYVKWGTLVQDIFTYAKVLALIAVIVAGIVRLGQGASTHFENSFEGSSFAVGDIALALYSALFSYSGWDTLNYVTEEIKNPERNLPLSIGISMPIVTIIYILTNVAYYTVLDMRDILASDAVAVTFADQIFGIFNWIIPLSVALSCFGGLNASIVAASRLFFVGSREGHLPDAICMIHVERFTPVPSLLFNGIMALIYLCVEDIFQLINYYSFSYWFFVGLSIVGQLYLRWKEPDRPRPLKLSVFFPIVFCLCTIFLVAVPLYSDTINSLIGIAIALSGLPFYFLIIRVPEHKRPLYLRRIVGSATRYLQVLCMSVAAEMDLEDGGEMPKQRDPKSN

SEQ ID NO: 4306 - protein, 535 aa, unidentified
MEEGARHRNNTEKKHPGGGESDASPEAGSGGGGVALKKEIGLVSACGIIVGNIIGSGIFVSPKGVLENAGSVGLALIVWIVTGFITVVGALCYAELGVTIPKSGGDYSYVKDIFGGLAGFLRLWIAVLVIYPTNQAVIALTFSNYVLQPLFPTCFPPESGLRLLAAICLLLLTWVNCSSVRWATRVQDIFTAGKLLALALIIIMGIVQICKGEYFWLEPKNAFENFQEPDIGLVALAFLQGSFAYGGWNFLNYVTEELVDPYKNLPRAIFISIPLVTFVYVFANVAYVTAMSPQELLASNAVAVTFGEKLLGVMAWIMPISVALSTFGGVNGSLFTSSRLFFAGAREGHLPSVLAMIHVKRCTPIPALLFTCISTLLMLVTSDMYTLINYVGFINYLFYGVTVAGQIVLRWKKPDIPRPIKINLLFPIIYLLFWAFLLVFSLWSEPVVCGIGLAIMLTGVPVYFLGVYWQHKPKCFSDFIELLTLVSQKMCVVVYPEVERGSGTEEANEDMEEQQQPMYQPTPTKDKDVAGQPQP

SEQ ID NO: 4307 - protein, 487 aa, unidentified
MGDTGLRKRREDEKSIQSQEPKTTSLQKELGLISGISIIVGTIIGSGIFVSPKSVLSNTEAVGPCLIIWAACGVLATLGALCFAELGTMITKSGGEYPYLMEAYGPIPAYLFSWASLIVIKPTSFAIICLSFSEYVCAPFYVGCKPPQIVVKCLAAAAILFISTVNSLSVRLGSYVQNIFTAAKLVIVAIIIISGLVLLAQGNTKNFDNSFEGAQLSVGAISLAFYNGLWAYDGWNQLNYITEELRNPYRNLPLAIIIGIPLVTACYILMNVSYFTVMTATELLQSQAVAVTFGDRVLYPASWIVPLFVAFSTIGAANGTCFTAGRLIYVAGREGHMLKVLSYISVRRLTPAPAIIFYGIIATIYIIPGDINSLVNYFSFAAWLFYGLTILGLIVMRFTRKELERPIKVPVVIPVLMTLISVFLVLAPIISKPTWEYLYCVLFILSGLLFYFLFVHYKFGWAQKISKPITMHLQMLMEVVPPEEDPE

SEQ ID NO: 4308 - protein, 973 aa, unidentified
MYNMRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKTISVKVIDDEEYEKNKTFFLEIGEPRLVEMSEKKALLLNELGGFTITGKYLFGQPVFRKVHAREHPILSTVITIADEYDDKQPLTSKEEEERRIAEMGRPILGEHTKLEVIIEESYEFKSTVDKLIKKTNLALVVGTNSWREQFIEAITVSAGEDDDDDECGEEKLPSCFDYVMHFLTVFWKVLFAFVPPTEYWNGWACFIVSILMIGLLTAFIGDLASHFGCTIGLKDSVTAVVFVALGTSVPDTFASKVAATQDQYADASIGNVTGSNAVNVFLGIGVAWSIAAIYHAANGEQFKVSPGTLAFSVTLFTIFAFINVGVLLYRRRPEIGGELGGPRTAKLLTSCLFVLLWLLYIFFSSLEAYCHIKGF

SEQ ID NO: 4309 - protein, 921 aa, unidentified
MAPLALVGVTLLLAAPPCSGAATPTPSLPPPPANDSDTSTGGCQGSYRCQPGVLLPVWEPDDPSLGDKAARAVVYFVAMVYMFLGVSIIADRFMAAIEVITSKEKEITITKANGETSVGTVRIWNETVSNLTLMALGSSAPEILLSVIEVCGHNFQAGELGPGTIVGSAAFNMFVVIAVCIYVIPAGESRKIKHLRVFFVTASWSIFAYVWLYLILAVFSPGVVQVWEALLTLVFFPVCVVFAWMADKRLLFYKYVYKRYRTDPRSGIIIGAEGDPPKSIELDGTFVGAEAPGELGGLGPGPAEARELDASRREVIQILKDLKQKHPDKDLEQLVGIANYYALLHQQKSRAFYRIQATRLMTGAGNVLRRHAADASRRAAPAEGAGEDEDDGASRIFFEPSLYHCLENCGSVLLSVTCQGGEGNSTFYVDYRTEDGSAKAGSDYEYSEGTLVFKPGETQKELRIGIIDDDIFEEDEHFFVRLLNLRVGDAQGMFEPDGGGRPKGRLVAPLLATVTILDDDHAGIFSFQDRLLHVSECMGTVDVRVVRSSGARGTVRLPYRTVDGTARGGGVHYEDACGELEFGDDETMKTLQVKIVDDEEYEKKDNFFIELGQPQWLKRGISALLLNQGDGDRKLTAEEEEARRIAEMGKPVLGENCRLEVIIEESYDFKNTVDKLIKKTNLALVIGTHSWREQFLEAITVSAGDEEEEEDGSREERLPSCFDYVMHFLTVFWKVLFACVPPTEYCHGWACFGVSILVIGLLTALIGDLASHFGCTVGLKDSVNAVVFVALGTSIPDTFASKVAALQDQCADASIGNVTGSNAVNVFLGLGVAWSVAAVYWAVQGRPFEVRTGTLAFSVTLFTVFAFVGIAVLLYRRRPHIGGELGGPRGPKLATTALFLGLWLLYILFASLEAYCHIRGF

SEQ ID NO: 4310 - protein, 927 aa, unidentified
MAWLRLQPLTSAFLHFGLVTFVLFLNGLRAEAGGSGDVPSTGQNNESCSGSSDCKEGVILPIWYPENPSLGDKIARVIVYFVALIYMFLGVSIIADRFMASIEVITSQEREVTIKKPNGETSTTTIRVWNETVSNLTLMALGSSAPEILLSLIEVCGHGFIAGDLGPSTIVGSAAFNMFIIIGICVYVIPDGETRKIKHLRVFFITAAWSIFAYIWLYMILAVFSPGVVQVWEGLLTLFFFPVCVLLAWVADKRLLFYKYMHKKYRTDKHRGIIIETEGDHPKGIEMDGKMMNSHFLDGNLVPLEGKEVDESRREMIRILKDLKQKHPEKDLDQLVEMANYYALSHQQKSRAFYRIQATRMMTGAGNILKKHAAEQAKKASSMSEVHTDEPEDFISKVFFDPCSYQCLENCGAVLLTVVRKGGDMSKTMYVDYKTEDGSANAGADYEFTEGTVVLKPGETQKEFSVGIIDDDIFEEDEHFFVRLSNVRIEEEQPEEGMPPAIFNSLPLPRAVLASPCVATVTILDDDHAGIFTFECDTIHVSESIGVMEVKVLRTSGARGTVIVPFRTVEGTAKGGGEDFEDTYGELEFKNDETVKTIRVKIVDEEEYERQENFFIALGEPKWMERGISALLLSPDVTDRKLTMEEEEAKRIAEMGKPVLGEHPKLEVIIEESYEFKTTVDKLIKKTNLALVVGTHSWRDQFMEAITVSAAGDEDEDESGEERLPSCFDYVMHFLTVFWKVLFACVPPTEYCHGWACFAVSILIIGMLTAIIGDLASHFGCTIGLKDSVTAVVFVAFGTSVPDTFASKAAALQDVYADASIGNVTGSNAVNVFLGIGLAWSVAAIYWALQGQEFHVSAGTLAFSVTLFTIFAFVCISVLLYRRRPHLGGELGGPRGCKLATTWLFVSLWLLYILFATLEAYCYIKGF

SEQ ID NO: 4311 - protein, 584 aa, unidentified
MAGRRLNLRWALSVLCVLLMAETVSGTRGSSTGAHISPQFPASGVNQTPVVDCRKVCGLNVSDRCDFIRTNPDCHSDGGYLDYLEGIFCHFPPSLLPLAVTLYVSWLLYLFLILGVTAAKFFCPNLSAISTTLKLSHNVAGVTFLAFGNGAPDIFSALVAFSDPHTAGLALGALFGAGVLVTTVVAGGITILHPFMAASRPFFRDIVFYMVAVFLTFLMLFRGRVTLAWALGYLGLYVFYVVTVILCTWIYQRQRRGSLFCPMPVTPEILSDSEEDRVSSNTNSYDYGDEYRPLFFYQETTAQILVRALNPLDYMKWRRKSAYWKALKVFKLPVEFLLLLTVPVVDPDKDDQNWKRPLNCLHLVISPLVVVLTLQSGTYGVYEIGGLVPVWVVVVIAGTALASVTFFATSDSQPPRLHWLFAFLGFLTSALWINAAATEVVNILRSLGVVFRLSNTVLGLTLLAWGNSIGDAFSDFTLARQGYPRMAFSACFGGIIFNILVGVGLGCLLQISRSHTEVKLEPDGLLVWVLAGALGLSLVFSLVSVPLQCFQLSRVYGFCLLLFYLNFLVVALLTEFGVIHLKSM

SEQ ID NO: 4312 - protein, 815 aa, unidentified
MVLRSGICGLSPHRIFPSLLVVVALVGLLPVLRSHGLQLSPTASTIRSSEPPRERSIGDVTTAPPEVTPESRPVNHSVTDHGMKPRKAFPVLGIDYTHVRTPFEISLWILLACLMKIGFHVIPTISSIVPESCLLIVVGLLVGGLIKGVGETPPFLQSDVFFLFLLPPIILDAGYFLPLRQFTENLGTILIFAVVGTLWNAFFLGGLMYAVCLVGGEQINNIGLLDNLLFGSIISAVDPVAVLAVFEEIHINELLHILVFGESLLNDAVTVVLYHLFEEFANYEHVGIVDIFLGFLSFFVVALGGVLVGVVYGVIAAFTSRFTSHIRVIEPLFVFLYSYMAYLSAELFHLSGIMALIASGVVMRPYVEANISHKSHTTIKYFLKMWSSVSETLIFIFLGVSTVAGSHHWNWTFVISTLLFCLIARVLGVLGLTWFINKFRIVKLTPKDQFIIAYGGLRGAIAFSLGYLLDKKHFPMCDLFLTAIITVIFFTVFVQGMTIRPLVDLLAVKKKQETKRSINEEIHTQFLDHLLTGIEDICGHYGHHHWKDKLNRFNKKYVKKCLIAGERSKEPQLIAFYHKMEMKQAIELVESGGMGKIPSAVSTVSMQNIHPKSLPSERILPALSKDKEEEIRKILRNNLQKTRQRLRSYNRHTLVADPYEEAWNQMLLRRQKARQLEQKINNYLTVPAHKLDSPTMSRARIGSDPLAYEPKEDLPVITIDPASPQSPESVDLVNEELKGKVLGLSRDPAKVAEEDEDDDGGIMMRSKETSSPGTDDVFTPAPSDSPSSQRIQRCLSDPGPHPEPGEGEPFFPKGQ

SEQ ID NO: 4313 - protein, 812 aa, unidentified
MEPLGNWRSLRAPLPPMLLLLLLQVAGPVGALAETLLNAPRAMGTSSSPPSPASVVAPGTTLFEESRLPVFTLDYPHVQIPFEITLWILLASLAKIGFHLYHKLPTIVPESCLLIMVGLLLGGIIFGVDEKSPPAMKTDVFFLYLLPPIVLDAGYFMPTRPFFENIGTIFWYAVVGTLWNSIGIGVSLFGICQIEAFGLSDITLLQNLLFGSLISAVDPVAVLAVFENIHVNEQLYILVFGESLLNDAVTVVLYNLFKSFCQMKTIETIDVFAGIANFFVVGIGGVLIGIFLGFIAAFTTRFTHNIRVIEPLFVFLYSYLSYITAEMFHLSGIMAITACAMTMNKYVEENVSQKSYTTIKYFMKMLSSVSETLIFIFMGVSTVGKNHEWNWAFVCFTLAFCLMWRALGVFVLTQVINRFRTIPLTFKDQFIIAYGGLRGAICFALVFLLPAAVFPRKKLFITAAIVVIFFTVFILGITIRPLVEFLDVKRSNKKQQAVSEEIYCRLFDHVKTGIEDVCGHWGHNFWRDKFKKFDDKYLRKLLIRENQPKSSIVSLYKKLEIKHAIEMAETGMISTVPTFASLNDCREEKIRKVTSSETDEIRELLSRNLYQIRQRTLSYNRHSLTADTSERQAKEILIRRRHSLRESIRKDSSLNREHRASTSTSRYLSLPKNTKLPEKLQKRRTISIADGNSSDSDADAGTTVLNLQPRARRFLPEQFSKKSPQSYKMEWKNEVDVDSGRDMPSTPPTPHSREKGTQTSGLLQQPLLSKDQSGSEREDSLTEGIPPKPPPRLVWRASEPGSRKARFGSEKP

SEQ ID NO: 4314 - protein, 834 aa, unidentified
MWGLGARGPDRGLLLALALGGLARAGGVEVEPGGAHGESGGFQVVTFEWAHVQDPYVIALWILVASLAKIGFHLSHKVTSVVPESALLIVLGLVLGGIVWAADHIASFTLTPTVFFFYLLPPIVLDAGYFMPNRLFFGNLGTILLYAVVGTVWNAATTGLSLYGVFLSGLMGDLQIGLLDFLLFGSLMAAVDPVAVLAVFEEVHVNEVLFIIVFGESLLNDAVTVVLYNVFESFVALGGDNVTGVDCVKGIVSFFVVSLGGTLVGVVFAFLLSLVTRFTKHVRIIEPGFVFIISYLSYLTSEMLSLSAILAITFCGICCQKYVKANISEQSATTVRYTMKMLASSAETIIFMFLGISAVNPFIWTWNTAFVLLTLVFISVYRAIGVVLQTWLLNRYRMVQLEPIDQVVLSYGGLRGAVAFALVVLLDGDKVKEKNLFVSTTIIVVFFTVIFQGLTIKPLVQWLKVKRSEHREPRLNEKLHGRAFDHILSAIEDISGQIGHNYLRDKWSHFDRKFLSRVLMRRSAQKSRDRILNVFHELNLKDAISYVAEGERRGSLAFIRSPSTDNVVNVDFTPRSSTVEASVSYLLRENVSAVCLDMQSLEQRRRSIRDAEDMVTHHTLQQYLYKPRQEYKHLYSRHELTPTEDEKQDREIFHRTMRKRLESFKSTKLGLNQNKKAAKLYKRERAQKRRNSSIPNGKLPMESPAQNFTIKEKDLELSDTEEPPNYDEEMSGGIEFLASVTKDTASDSPAGIDNPVFSPDEALDRSLLARLPPWLSPGETVVPSQRARTQIPYSPGTFCRLMPFRLSSKSVDSFLQADGPEERPPAALPESTHM

SEQ ID NO: 4315 - protein, 798 aa, unidentified
MALQMFVTYSPWNCLLLLVALECSEASSDLNESANSTAQYASNAWFAAASSEPEEGISVFELDYDYVQIPYEVTLWILLASLAKIGFHLYHRLPGLMPESCLLILVGALVGGIIFGTDHKSPPVMDSSIYFLYLLPPIVLEGGYFMPTRPFFENIGSILWWAVLGALINALGIGLSLYLICQVKAFGLGDVNLLQNLLFGSLISAVDPVAVLAVFEEARVNEQLYMMIFGEALLNDGITVVLYNMLIAFTKMHKFEDIETVDILAGCARFIVVGLGGVLFGIVFGFISAFITRFTQNISAIEPLIVFMFSYLSYLAAETLYLSGILAITACAVTMKKYVEENVSQTSYTTIKYFMKMLSSVSETLIFIFMGVSTVGKNHEWNWAFICFTLAFCQIWRAISVFALFYISNQFRTFPFSIKDQCIIFYSGVRGAGSFSLAFLLPLSLFPRKKMFVTATLVVIYFTVFIQGITVGPLVRYLDVKKTNKKESINEELHIRLMDHLKAGIEDVCGHWSHYQVRDKFKKFDHRYLRKILIRKNLPKSSIVSLYKKLEMKQAIEMVETGILSSTAFSIPHQAQRIQGIKRLSPEDVESIRDILTSNMYQVRQRTLSYNKYNLKPQTSEKQAKEILIRRQNTLRESMRKGHSLPWGKPAGTKNIRYLSYPYGNPQSAGRDTRAAGFSDDDSSDPGSPSITFSACSRIGSLQKQEAQEIIPMKSLHRGRKAFSFGYQRNTSQEEYLGGVRRVALRPKPLFHAVDEEGESGGESEGKASLVEVRSRWTADHGHGRDHHRSHSPLLQKK

SEQ ID NO: 4316 - protein, 896 aa, unidentified
MLRAALSLLALPLAGAAEEPTQKPESPGEPPPGLELFRWQWHEVEAPYLVALWILVASLAKIVFHLSRKVTSLVPESCLLILLGLVLGGIVLAVAKKAEYQLEPGTFFLFLLPPIVLDSGYFMPSRLFFDNLGAILTYAVVGTLWNAFTTGAALWGLQQAGLVAPRVQAGLLDFLLFGSLISAVDPVAVLAVFEEVHVNETLFIIVFGESLLNDAVTVVLYKVCNSFVEMGSANVQATDYLKGVASLFVVSLGGAAVGLVFAFLLALTTRFTKRVRIIEPLLVFLLAYAAYLTAEMASLSAILAVTMCGLGCKKYVEANISHKSRTTVKYTMKTLASCAETVIFMLLGISAVDSSKWAWDSGLVLGTLIFILFFRALGVVLQTWVLNQFRLVPLDKIDQVVMSYGGLRGAVAFALVILLDRTKVPAKDYFVATTIVVVFFTVIVQGLTIKPLVKWLKVKRSEHHKPTLNQELHEHTFDHILAAVEDVVGHHGYHYWRDRWEQFDKKYLSQLLMRRSAYRIRDQIWDVYYRLNIRDAISFVDQGGHVLSSTGLTLPSMPSRNSVAETSVTNLLRESGSGACLDLQVIDTVRSGRDREDAVMHHLLCGGLYKPRRRYKASCSRHFISEDAQERQDKEVFQQNMKRRLESFKSTKHNICFTKSKPRPRKTGRRKKDGVANAEATNGKHRGLGFQDTAAVILTVESEEEEEESDSSETEKEDDEGIIFVARATSEVLQEGKVSGSLEVCPSPRIIPPSPTCAEKELPWKSGQGDLAVYVSSETTKIVPVDMQTGWNQSISSLESLASPPCNQAPILTCLPPHPRGTEEPQVPLHLPSDPRSSFAFPPSLAKAGRSRSESSADLPQQQELQPLMGHKDHTHLSPGTATSHWCIQFNRGSRL

SEQ ID NO: 4317 - protein, 669 aa, unidentified
MARRGWRRAPLRRGVGSSPRARRLMRPLWLLLAVGVFDWAGASDGGGGEARAMDEEIVSEKQAEESHRQDSANLLIFILLLTLTILTIWLFKHRRARFLHETGLAMIYGLLVGLVLRYGIHVPSDVNNVTLSCEVQSSPTTLLVTFDPEVFFNILLPPIIFYAGYSLKRRHFFRNLGSILAYAFLGTAISCFVIGSIMYGCVTLMKVTGQLAGDFYFTDCLLFGAIVSATDPVTVLAIFHELQVDVELYALLFGESVLNDAVAIVLSSSIVAYQPAGDNSHTFDVTAMFKSIGIFLGIFSGSFAMGAATGVVTALVTKFTKLREFQLLETGLFFLMSWSTFLLAEAWGFTGVVAVLFCGITQAHYTYNNLSTESQHRTKQLFELLNFLAENFIFSYMGLTLFTFQNHVFNPTFVVGAFVAIFLGRAANIYPLSLLLNLGRRSKIGSNFQHMMMFAGLRGAMAFALAIRDTATYARQMMFSTTLLIVFFTVWVFGGGTTAMLSCLHIRVGVDSDQEHLGVPENERRTTKAESAWLFRMWYNFDHNYLKPLLTHSGPPLTTTLPACCGPIARCLTSPQAYENQEQLKDDDSDLILNDGDISLTYGDSTVNTEPATSSAPRRFMGNSSEDALDRELAFGDHELVIRGTRLVLPMDDSEPPLNLLDNTRHGPA

SEQ ID NO: 4318 - protein, 725 aa, unidentified
MEPGDAARPGSGRATGAPPPRLLLLPLLLGWGLRVAAAASASSSGAAAEDSSAMEELATEKEAEESHRQDSVSLLTFILLLTLTILTIWLFKHRRVRFLHETGLAMIYGLIVGVILRYGTPATSGRDKSLSCTQEDRAFSTLLVNVSGKFFEYTLKGEISPGKINSVEQNDMLRKVTFDPEVFFNILLPPIIFHAGYSLKKRHFFRNLGSILAYAFLGTAVSCFIIGNLMYGVVKLMKIMGQLSDKFYYTDCLFFGAIISATDPVTVLAIFNELHADVDLYALLFGESVLNDAVAIVLSSSIVAYQPAGLNTHAFDAAAFFKSVGIFLGIFSGSFTMGAVTGVNANVTKFTKLHCFPLLETALFFLMSWSTFLLAEACGFTGVVAVLFCGITQAHYTYNNLSVESRSRTKQLFEVLHFLAENFIFSYMGLALFTFQKHVFSPIFIIGAFVAIFLGRAAHIYPLSFFLNLGRRHKIGWNFQHMMMFSGLRGAMAFALAIRDTASYARQMMFTTTLLIVFFTVWIIGGGTTPMLSWLNIRVGVEEPSEEDQNEHHWQYFRVGVDPDQDPPPNNDSFQVLQGDGPDSARGNRTKQESAWIFRLWYSFDHNYLKPILTHSGPPLTTTLPAWCGLLARCLTSPQVYDNQEPLREEDSDFILTEGDLTLTYGDSTVTANGSSSSHTASTSLEGSRRTKSSSEEVLERDLGMGDQKVSSRGTRLVFPLEDNA

SEQ ID NO: 4319 - protein, 581 aa, unidentified
MGEKMAEEERFPNTTHEGFNVTLHTTLVVTTKLVLPTPGKPILPVQTGEQAQQEEQSSGMTIFFSLLVLAICIILVHLLIRYRLHFLPESVAVVSLGILMGAVIKIIEFKKLANWKEEEMFRPNMFFLLLLPPIIFESGYSLHKGNFFQNIGSITLFAVFGTAISAFVVGGGIYFLGQADVISKLNMTDSFAFGSLISAVDPVATIAIFNALHVDPVLNMLVFGESILNDAVSIVLTNTAEGLTRKNMSDVSGWQTFLQALDYFLKMFFGSAALGTLTGLISALVLKHIDLRKTPSLEFGMMIIFAYLPYGLAEGISLSGIMAILFSGIVMSHYTHHNLSPVTQILMQQTLRTVAFLCETCVFAFLGLSIFSFPHKFEISFVIWCIVLVLFGRAVNIFPLSYLLNFFRDHKITPKMMFIMWFSGLRGAIPYALSLHLDLEPMEKRQLIGTTTIVIVLFTILLLGGSTMPLIRLMDIEDAKAHRRNKKDVNLSKTEKMGNTVESEHLSELTEEEYEAHYIRRQDLKGFVWLDAKYLNPFFTRRLTQEDLHHGRIQMKTLTNKWYEEVRQGPSGSEDDEQELL

SEQ ID NO: 4320 - protein, 645 aa, unidentified
MERQSRVMSEKDEYQFQHQGAVELLVFNFLLILTILTIWLFKNHRFRFLHETGGAMVYGLIMGLILRYATAPTDIESGTVYDCVKLTFSPSTLLVNITDQVYEYKYKREISQHNINPHQGNAILEKMTFDPEIFFNVLLPPIIFHAGYSLKKRHFFQNLGSILTYAFLGTAISCIVIGLIMYGFVKAMIHAGQLKNGDFHFTDCLFFGSLMSATDPVTVLAIFHELHVDPDLYTLLFGESVLNDAVAIVLTYSISIYSPKENPNAFDAAAFFQSVGNFLGIFAGSFAMGSAYAIITALLTKFTKLCEFPMLETGLFFLLSWSAFLSAEAAGLTGIVAVLFCGVTQAHYTYNNLSSDSKIRTKQLFEFMNFLAENVIFCYMGLALFTFQNHIFNALFILGAFLAIFVARACNIYPLSFLLNLGRKQKIPWNFQHMMMFSGLRGAIAFALAIRNTESQPKQMMFTTTLLLVFFTVWVFGGGTTPMLTWLQIRVGVDLDENLKEDPSSQHQEANNLDKNMTKAESARLFRMWYSFDHKYLKPILTHSGPPLTTTLPEWCGPISRLLTSPQAYGEQLKEDDVECIVNQDELAINYQEQASSPCSPPARLGLDQKASPQTPGKENIYEGDLGLGGYELKLEQTLGQSQLN

SEQ ID NO: 4321 - protein, 515 aa, unidentified
MHTTESKNEHLEDENFQTSTTPQSLIDPNNTAQEETKTVLSDTEEIKPQTKKETYISCPLRGVLNVIITNGVILFVIWCMTWSILGSEALPGGNLFGLFIIFYSAIIGGKILQLIRIPLVPPLPPLLGMLLAGFTIRNVPFINEHVHVPNTWSSILRSIALTIILIRAGLGLDPQALRHLKVVCFRLAVGPCLMEASAAAVFSHFIMKFPWQWAFLLGFVLGAVSPAVVVPYMMVLQENGYGVEEGIPTLLMAASSMDDILAITGFNTCLSIVFSSGGILNNAIASIRNVCISLLAGIVLGFFVRYFPSEDQKKLTLKRGFLVLTMCVSAVLGSQRIGLHGSGGLCTLVLSFIAGTKWSQEKMKVQKIITTVWDIFQPLLFGLVGAEVSVSSLESNIVGISVATLSLALCVRILTTYLLMCFAGFSFKEKIFIALAWMPKATVQAVLGPLALETARVSAPHLEPYAKDVMTVAFLAILITAPNGALLMGILGPKMLTRHYDPSKIKLQLSTLEHH

SEQ ID NO: 4322 - protein, 537 aa, unidentified
MGDEDKRITYEDSEPSTGMNYTPSMHQEAQEETVMKLKGIDANEPTEGSILLKSSEKKLQETPTEANHVQRLRQMLACPPHGLLDRVITNVTIIVLLWAVVWSITGSECLPGGNLFGIIILFYCAIIGGKLLGLIKLPTLPPLPSLLGMLLAGFLIRNIPVINDNVQIKHKWSSSLRSIALSIILVRAGLGLDSKALKKLKGVCVRLSMGPCIVEACTSALLAHYLLGLPWQWGFILGFVLGAVSPAVVVPSMLLLQGGGYGVEKGVPTLLMAAGSFDDILAITGFNTCLGIAFSTGSTVFNVLRGVLEVVIGVATGSVLGFFIQYFPSRDQDKLVCKRTFLVLGLSVLAVFSSVHFGFPGSGGLCTLVMAFLAGMGWTSEKAEVEKIIAVAWDIFQPLLFGLIGAEVSIASLRPETVGLCVATVGIAVLIRILTTFLMVCFAGFNLKEKIFISFAWLPKATVQAAIGSVALDTARSHGEKQLEDYGMDVLTVAFLSILITAPIGSLLIGLLGPRLLQKVEHQNKDEEVQGETSVQV

SEQ ID NO: 4323 - protein, 1177 aa, unidentified
MAGIFKEFFFSTEDLPEVILTLSLISSIGAFLNRHLEDFPIPVPVILFLLGCSFEVLSFTSSQVQRYANAIQWMSPDLFFRIFTPVVFFTTAFDMDTYMLQKLFWQILLISIPGFLVNYILVLWHLASVNQLLLKPTQWLLFSAILVSSDPMLTAAAIRDLGLSRSLISLINGESLMTSVISLITFTSIMDFDQRLQSKRNHTLAEEIVGGICSYIIASFLFGILSSKLIQFWMSTVFGDDVNHISLIFSILYLIFYICELVGMSGIFTLAIVGLLLNSTSFKAAIEETLLLEFWTFLSRIAFLMVFTFFGLLIPAHTYLYIEFVDIYYSLNIYLTLIVLRFLTLLLISPVLSRVGHEFSWRWIFIMVCSEMKGMPNINMALLLAYSDLYFGSDKEKSQILFHGVLVCLITLVVNRFILPVAVTILGLRDATSTKYKSVCCTFQHFQELTKSAASALKFDKDLANADWNMIEKAITLENPYMLNEEETTEHQKVKCPHCNKEIDEIFNTEAMELANRRLLSAQIASYQRQYRNEILSQSAVQVLVGAAESFGEKKGKCMSLDTIKNYSESQKTVTFARKLLLNWVYNTRKEKEGPSKYFFFRICHTIVFTEEFEHVGYLVILMNIFPFIISWISQLNVIYHSELKHTNYCFLTLYILEALLKIAAMRKDFFSHAWNIFELAITLIGILHVILIEIDTIKYIFNETEVIVFIKVVQFFRILRIFKLIAPKLLQIIDKRMSHQKTFWYGILKGYVQGEADIMTIIDQITSSKQIKQMLLKQVIRNMEHAIKELGYLEYDHPEIAVTVKTKEEINVMLNMATEILKAFGLKGIISKTEGAGINKLIMAKKKEVLDSQSIIRPLTVEEVLYHIPWLDKNKDYINFIQEKAKVVTFDCGNDIFEEGDEPKGIYIIISGMVKLEKSKPGLGIDQMVESKEKDFPIIDTDYMLSGEIIGEINCLTNEPMKYSATCKTVVETCFIPKTHLYDAFEQCSPLIKQKMWLKLGLAITARKIREHLSYEDWNYNMQLKLSNIYVVDIPMSTKTDIYDENLIYVILIHGAVEDCLLRKTYRAPFLIPITCHQIQSIEDFTKVVIIQTPINMKTFRRNIRKFVPKHKSYLTPGLIGSVGTLEEGIQEERNVKEDGAHSAATARSPQPCSLLGTKFNCKESPRINLRKVRKE

SEQ ID NO: 4324 - protein, 1124 aa, unidentified
MSSYFWAQNESNRPDLLCGQPADYLVEEKHFTTLVCFIVVLGGLLKMCLKNCEVIVLTILSLSGFVIGHMAYNSVEVHQIVYPLLRTSSFSLYSYFSPLIIFMVALDVEFYTLKKMFWQVLLTGLISFSTASIIIGYVVIKFNKDSWDLQSCLLFSITLGIIDPLRSVNSLKTIGISKIYIDLIRGESLIICSIASIFFGNFRGNRIHFSIFRDLHVGIELSYDILGSIIFGYWCAKIIQCILADVFSNMLTNIILCFSMVYMTFYIVEFLGMSGTLALAAVGLNLDSLTFKPKIELVITKFLRIFSSVYEHLIYAFFGIVIGCGELSHYEFHTIPFIFILFTTVNLVRLLTILLVSPILMHSNYEYNWRWGVVITWSGIKGVFNLLWAPDVYNLAERKVEVPQMFILYVQVISLLTMGINSYVMTQSARKLDLCVLSLPRQMILQNATQHIQEIVQNTITLFKTEKILTNVNWTLVEDKTRIEYIPFSHVSHNDMKTESTTDEALMEEARLHVAAIQMSSFEKQRNNGILEIEAARILIGAAKCYYSIQGKFMSIYDVSTYMRTRSWLIKFKNVLTFLEYCIEKIHFIPPESNTFLTFIFHIVFSEEFEYTGQIINLIYIYPMIIHLWPMARGLNVSALISINYYFMFLYVLESTLKIIILKRKYFQQCWNTLEFFILVIGIIDIFCVYFVKLRPDNLALIQLTVIMGYLRIIRFLPLFKIIVPILIRIADVQIKKRLSLMYSITKGYIKSQEDAKLLIKQIAVCESIYQKLCEILETNKQDAVKELVLMEHEGRDVVIALKTKQAIRNVIAKALKNLTFLCSRGIIDKHEVIEINKVLLKKLKALNNFPKAIPPPTPDIYLHNIIWLEGKDVLIDFFKERAKLACFDSGDTICKGGEMPQGIYLIISGMAILHSLSPTFGIESNQRCDRGSRDMFTEFCTTGDIIGELSCLLKREIEYTVICETSLQACFISLEDLYEGFDAFWPSLEYKIWLKLALSTAYQYFESSLIDEDLRFQNCVMFNQAYVETLSSYSDMIIDNMTMKFVIIVYGSVIDTKTEEPYFAPCIIPTTCEQVQGTSDLSKLLIIQASELTQRNSNTNVMASVNTVFEQPGKNINGRQKMS

SEQ ID NO: 4325 - protein, 670 aa, unidentified
MGETEKRIETHRIRCLSKLKMFLLAITCAFVSKTLSGSYMNSMLTQIERQFNIPTSLVGFINGSFEIGNLLLIIFVSYFGTKLHRPIMIGIGCVVMGLGCFLKSLPHFLMNQYEYESTVSVSGNLSSNSFLCMENGTQILRPTQDPSECTKEVKSLMWVYVLVGNIVRGMGETPILPLGISYIEDFAKFENSPLYIGLVETGAIIGPLIGLLLASFCANVYVDTGFVNTDDLIITPTDTRWVGAWWFGFLICAGVNVLTAIPFFFLPNTLPKEGLETNADIIKNENEDKQKEEVKKEKYGITKDFLPFMKSLSCNPIYMLFILVSVIQFNAFVNMISFMPKYLEQQYGISSSDAIFLMGIYNLPPICIGYIIGGLIMKKFKITVKQAAHIGCWLSLLEYLLYFLSFLMTCENSSVVGINTSYEGIPQDLYVENDIFADCNVDCNCPSKIWDPVCGNNGLSYLSACLAGCETSIGTGINMVFQNCSCIQTSGNSSAVLGLCDKGPDCSLMLQYFLILSAMSSFIYSLAAIPGYMVLLRCMKSEEKSLGVGLHTFCTRVFAGIPAPIYFGALMDSTCLHWGTLKCGESGACRIYDSTTFRYIYLGLPAALRGSSFVPALIILILLRKCHLPGENASSGTELIETKVKGKENECKDIYQKSTVLKDDELKTKL

SEQ ID NO: 4326 - protein, 691 aa, unidentified
MDQNQHLNKTAEAQPSENKKTRYCNGLKMFLAALSLSFIAKTLGAIIMKSSIIHIERRFEISSSLVGFIDGSFEIGNLLVIVFVSYFGSKLHRPKLIGIGCFIMGIGGVLTALPHFFMGYYRYSKETNINSSENSTSTLSTCLINQILSLNRASPEIVGKGCLKESGSYMWIYVFMGNMLRGIGETPIVPLGLSYIDDFAKEGHSSLYLGILNAIAMIGPIIGFTLGSLFSKMYVDIGYVDLSTIRITPTDSRWVGAWWLNFLVSGLFSIISSIPFFFLPQTPNKPQKERKASLSLHVLETNDEKDQTANLTNQGKNITKNVTGFFQSFKSILTNPLYVMFVLLTLLQVSSYIGAFTYVFKYVEQQYGQPSSKANILLGVITIPIFASGMFLGGYIIKKFKLNTVGIAKFSCFTAVMSLSFYLLYFFILCENKSVAGLTMTYDGNNPVTSHRDVPLSYCNSDCNCDESQWEPVCGNNGITYISPCLAGCKSSSGNKKPIVFYNCSCLEVTGLQNRNYSAHLGECPRDDACTRKFYFFVAIQVLNLFFSALGGTSHVMLIVKIVQPELKSLALGFHSMVIRALGGILAPIYFGALIDTTCIKWSTNNCGTRGSCRTYNSTSFSRVYLGLSSMLRVSSLVLYIILIYAMKKKYQEKDINASENGSVMDEANLESLNKNKHFVPSAGADSETHC

SEQ ID NO: 4327 - protein, 702 aa, unidentified
MDQHQHLNKTAESASSEKKKTRRCNGFKMFLAALSFSYIAKALGGIIMKISITQIERRFDISSSLAGLIDGSFEIGNLLVIVFVSYFGSKLHRPKLIGIGCLLMGTGSILTSLPHFFMGYYRYSKETHINPSENSTSSLSTCLINQTLSFNGTSPEIVEKDCVKESGSHMWIYVFMGNMLRGIGETPIVPLGISYIDDFAKEGHSSLYLGSLNAIGMIGPVIGFALGSLFAKMYVDIGYVDLSTIRITPKDSRWVGAWWLGFLVSGLFSIISSIPFFFLPKNPNKPQKERKISLSLHVLKTNDDRNQTANLTNQGKNVTKNVTGFFQSLKSILTNPLYVIFLLLTLLQVSSFIGSFTYVFKYMEQQYGQSASHANFLLGIITIPTVATGMFLGGFIIKKFKLSLVGIAKFSFLTSMISFLFQLLYFPLICESKSVAGLTLTYDGNNSVASHVDVPLSYCNSECNCDESQWEPVCGNNGITYLSPCLAGCKSSSGIKKHTVFYNCSCVEVTGLQNRNYSAHLGECPRDNTCTRKFFIYVAIQVINSLFSATGGTTFILLTVKIVQPELKALAMGFQSMVIRTLGGILAPIYFGALIDKTCMKWSTNSCGAQGACRIYNSVFFGRVYLGLSIALRFPALVLYIVFIFAMKKKFQGKDTKASDNERKVMDEANLEFLNNGEHFVPSAGTDSKTCNLDMQDNAAAN

SEQ ID NO: 4328 - protein, 640 aa, unidentified
MKISTTQIERRFEISSSLVGLIDGSFEIGNLFVIVFVSYFGSKLHRPKLIGIGCFLMGTGSILMALPHFFMGYYRYSKETNIDPSENSTSNLPNCLINQMLSLNRTPSEIIERGCVKESGSHMWIYVFMGNMLRGIGETPIVPLGISYIDDFAKEGHSSLYLGTVNVMGMTGLVFAFMLGSLFAKMYVDIGYVDLSTIRITPKDSRWVGAWWLGFLVSGIVSIISSIPFFFLPLNPNKPQKERKVSLFLHVLKTNDKRNQIANLTNRRKYITKNVTGFFQSLKSILTNPLYVIFVIFTLLHMSSYIASLTYIIKMVEQQYGWSASKTNFLLGVLALPAVAIGMFSGGYIIKKFKLSLVGLAKLAFCSATVHLLSQVLYFFLICESKSVAGLTLTYDGNSPVRSHVDVPLSYCNSECNCDESQWEPVCGNNGITYLSPCLAGCKSSSGNKEPIVFYNCSCVEVIGLQNKNYSAHLGECPRDDACTRKSYVYFVIQVLDAFLCAVGLTSYSVLVIRIVQPELKALAIGFHSMIMRSLGGILVPIYFGALIDTTCMKWSTNSCGARGACRIYNSTYLGRAFFGLKVALIFPVLVLLTVFIFVVRKKSHGKDTKVLENERQVMDEANLEFLNDSEHFVPSAEEQ

SEQ ID NO: 4329 - protein, 712 aa, unidentified
MDTSSKENIQLFCKTSVQPVGRPSFKTEYPSSEEKQPCCGELKVFLCALSFVYFAKALAEGYLKSTITQIERRFDIPSSLVGVIDGSFEIGNLLVITFVSYFGAKLHRPKIIGAGCVIMGVGTLLIAMPQFFMEQYKYERYSPSSNSTLSISPCLLESSSQLPVSVMEKSKSKISNECEVDTSSSMWIYVFLGNLLRGIGETPIQPLGIAYLDDFASEDNAAFYIGCVQTVAIIGPIFGFLLGSLCAKLYVDIGFVNLDHITITPKDPQWVGAWWLGYLIAGIISLLAAVPFWYLPKSLPRSQSREDSNSSSEKSKFIIDDHTDYQTPQGENAKIMEMARDFLPSLKNLFGNPVYFLYLCTSTVQFNSLFGMVTYKPKYIEQQYGQSSSRANFVIGLINIPAVALGIFSGGIVMKKFRISVCGAAKLYLGSSVFGYLLFLSLFALGCENSDVAGLTVSYQGTKPVSYHERALFSDCNSRCKCSETKWEPMCGENGITYVSACLAGCQTSNRSGKNIIFYNCTCVGIAASKSGNSSGIVGRCQKDNGCPQMFLYFLVISVITSYTLSLGGIPGYILLLRCIKPQLKSFALGIYTLAIRVLAGIPAPVYFGVLIDTSCLKWGFKRCGSRGSCRLYDSNVFRHIYLGLTVILGTVSILLSIAVLFILKKNYVSKHRSFITKRERTMVSTRFQKENYTTSDHLLQPNYWPGKETQL

SEQ ID NO: 4330 - protein, 643 aa, unidentified [sequence omitted]

SEQ ID NO: 4331 - protein, 709 aa, unidentified
MGPRIGPAGEVPQVPDKETKATMGTENTPGGKASPDPQDVRPSVFHNIKLFVLCHSLLQLAQLMISGYLKSSISTVEKRFGLSSQTSGLLASFNEVGNTALIVFVSYFGSRVHRPRMIGYGAILVALAGLLMTLPHFISEPYRYDNTSPEDMPQDFKASLCLPTTSAPASAPSNGNCSSYTETQHLSVVGIMFVAQTLLGVGGVPIQPFGISYIDDFAHNSNSPLYLGILFAVTMMGPGLAFGLGSLMLRLYVDINQMPEGGISLTIKDPRWVGAWWLGFLIAAGAVALAAIPYFFFPKEMPKEKRELQFRRKVLAVTDSPARKGKDSPSKQSPGESTKKQDGLVQIAPNLTVIQFIKVFPRVLLQTLRHPIFLLVVLSQVCLSSMAAGMAIFLPKFLERQFSITASYANLLIGCLSFPSVIVGIVVGGVLVKRLHLGPVGCGALCLLGMLLCLFFSLPLFFIGCSSHQIAGITHQTSAHPGLELSPSCMEACSCPLDGFNPVCDPSTRVEYITPCHAGCSSWVVQDALDNSQVFYTNCSCVVEGNPVLAGSCDSTCSHLVVPFLLLVSLGSALACLTHTPSFMLILRGVKKEDKTLAVGIQFMFLRILAWMPSPVIHGSAIDTTCVHWALSCGRRAVCRYYNNDLLRNRFIGLQFFFKTGSVICFALVLAVLRQQDKEARTKESRSSPAVEQQLLVSGPGKKPEDSRV

SEQ ID NO: 4332 - protein, 710 aa, unidentified
MQGKKPGGSSGGGRSGELQGDEAQRNKKKKKKVSCFSNIKIFLVSECALMLAQGTVGAYLVSVLTTLERRFNLQSADVGVIASSFEIGNLALILFVSYFGARGHRPRLIGCGGIVMALGALLSALPEFLTHQYKYEAGEIRWGAEGRDVCAANGSGGDEGPDPDLICRNRTATNMMYLLLIGAQVLLGIGATPVQPLGVSYIDDHVRRKDSSLYIGILFTMLVFGPACGFILGSFCTKIYVDAVFIDTSNLDITPDDPRWIGAWWGGFLLCGALLFFSSLLMFGFPQSLPPHSEPAMESEQAMLSEREYERPKPSNGVLRHPLEPDSSASCFQQLRVIPKVTKHLLSNPVFTCIILAACMEIAVVAGFAAFLGKYLEQQFNLTTSSANQLLGMTAIPCACLGIFLGGLLVKKLSLSALGAIRMAMLVNLVSTACYVSFLFLGCDTGPVAGVTVPYGNSTAPGSALDPYSPCNNNCECQTDSFTPVCGADGITYLSACFAGCNSTNLTGCACLTTVPAENATVVPGKCPSPGCQEAFLTFLCVMCICSLIGAMAQTPSVIILIRTVSPELKSYALGVLFLLLRLLGFIPPPLIFGAGIDSTCLFWSTFCGEQGACVLYDNVVYRYLYVSIAIALKSFAFILYTTTWQCLRKNYKRYIKNHEGGLSTSEFFASTLTLDNLGRDPVPANQTHRTKFIYNLEDHEWCENMESVL

SEQ ID NO: 4333 - protein, 722 aa, unidentified
MPLHQLGDKPLTFPSPNSAMENGLDHTPPSRRASPGTPLSPGSLRSAAHSPLDTSKQPLCQLWAEKHGARGTHEVRYVSAGQSVACGWWAFAPPCLQVLNTPKGILFFLCAAAFLQGMTVNGFINTVITSLERRYDLHSYQSGLIASSYDIAACLCLTFVSYFGGSGHKPRWLGWGVLLMGTGSLVFALPHFTAGRYEVELDAGVRTCPANPGAVCADSTSGLSRYQLVFMLGQFLHGVGATPLYTLGVTYLDENVKSSCSPVYIAIFYTAAILGPAAGYLIGGALLNIYTEMGRRTELTTESPLWVGAWWVGFLGSGAAAFFTAVPILGYPRQLPGSQRYAVMRAAEMHQLKDSSRGEASNPDFGKTIRDLPLSIWLLLKNPTFILLCLAGATEATLITGMSTFSPKFLESQFSLSASEAATLFGYLVVPAGGGGTFLGGFFVNKLRLRGSAVIKFCLFCTVVSLLGILVFSLHCPSVPMAGVTASYGGSLLPEGHLNLTAPCNAACSCQPEHYSPVCGSDGLMYFSLCHAGCPAATETNVDGQKVYRDCSCIPQNLSSGFGHATAGKCTSTCQRKPLLLVFIFVVIFFTFLSSIPALTATLRCVRDPQRSFALGIQWIVVRILGGIPGPIAFGWVIDKACLLWQDQCGQQGSCLVYQNSAMSRYILIMGLLYKVLGVLFFAIACFLYKPLSESSDGLETCLPSQSSAPDSATDSQLQSSV

SEQ ID NO: 4334 - protein, 724 aa, unidentified
MKSAKGIENLAFVPSSPDILRRLSASPSQIEVSALSSDPQRENSQPQELQKPQEPQKSPEPSLPSAPPNVSEEKLRSLSLSEFEEGSYGWRNFHPQCLQRCNTPGGFLLHYCLLAVTQGIVVNGLVNISISTVEKRYEMKSSLTGLISSSYDISFCLLSLFVSFFGERGHKPRWLAFAAFMIGLGALVFSLPQFFSGEYKLGSLFEDTCVTTRNSTSCTSSTSSLSNYLYVFILGQLLLGAGGTPLYTLGTAFLDDSVPTHKSSLYIGTGYAMSILGPAIGYVLGGQLLTIYIDVAMGESTDVTEDDPRWLGAWWIGFLLSWIFAWSLIIPFSCFPKHLPGTAEIQAGKTSQAHQSNSNADVKFGKSIKDFPAALKNLMKNAVFMCLVLSTSSEALITTGFATFLPKFIENQFGLTSSFAATLGGAVLIPGAALGQILGGFLVSKFRMTCKNTMKFALFTSGVALTLSFVFMYAKCENEPFAGVSESYNGTGELGNLIAPCNANCNCSRSYYYPVCGDGVQYFSPCFAGCSNPVAHRKPKVYYNCSCIERKTEITSTAETFGFEAKAGKCETHCAKLPIFLCIFFIVIIFTFMAGTPITVSILRCVNHRQRSLALGIQFMVLRLLGTIPGPIIFGFTIDSTCILWDINDCGIKGACWIYDNIKMAHMLVAISVTCKVITMFFNGFAIFLYKPPPSATDVSFHKENAVVTNVLAEQDLNKIVKEG

SEQ ID NO: 4335 - protein, 848 aa, unidentified
MDEGTGLQPGAGEQLEAPATAEAVQERCEPETLRSKSLPVLSSASCRPSLSPTSGDANPAFGCVDSSGHQELKQGPNPLAPSPSAPSTSAGLGDCNHRVDLSKTFSVSSALAMLQERRCLYVVLTDSRCFLVCMCFLTFIQALMVSGYLSSVITTIERRYSLKSSESGLLVSCFDIGNLVVVVFVSYFGGRGRRPLWLAVGGLLIAFGAALFALPHFISPPYQIQELNASAPNDGLCQGGNSTATLEPPACPKDSGGNNHWVYVALFICAQILIGMGSTPIYTLGPTYLDDNVKKENSSLYLAIMYVMGALGPAVGYLLGGLLIGFYVDPRNPVHLDQNDPRFIGNWWSGFLLCAIAMFLVIFPMFTFPKKLPPRHKKKKKKKFSVDAVSDDDVLKEKSNNSEQADKKVSSMGFGKDVRDLPRAAVRILSNMTFLFVSLSYTAESAIVTAFITFIPKFIESQFGIPASNASIYTGVIIVPSAGVGIVLGGYIIKKLKLGARESAKLAMICSGVSLLCFSTLFIVGCESINLGGINIPYTTGPSLTMPHRNLTGSCNVNCGCKIHEYEPVCGSDGITYFNPCLAGCVNSGNLSTGIRNYTECTCVQSRQVITPPTVGQRSQLRVVIVKTYLNENGYAVSGKCKRTCNTLIPFLVFLFIVTFITACAQPSAIIVTLRSVEDEERPFALGMQFVLLRTLAYIPTPIYFGAVIDTTCMLWQQECGVQGSCWEYNVTSFRFVYFGLAAGLKFVGFIFIFLAWYSIKYKEDGLQRRRQREFPLSTVSERVGHPDNARTRSCPAFSTQGEFHEETGLQKGIQCAAQTYPGPFPEAISSSADPGLEESPAALEPPS

SEQ ID NO: 4336 - protein, 719 aa, unidentified
MFVGVARHSGSQDEVSRGVEPLEAARAQPAKDRRAKGTPKSSKPGKKHRYLRLLPEALIRFGGFRKRKKAKSSVSKKPGEVDDSLEQPCGLGCLVSTCCECCNNIRCFMIFYCILLICQGVVFGLIDVSIGDFQKEYQLKTIEKLALEKSYDISSGLVAIFIAFYGDRKKVIWFVASSFLIGLGSLLCAFPSINEENKQSKVGIEDICEEIKVVSGCQSSGISFQSKYLSFFILGQTVQGIAGMPLYILGITFIDENVATHSAGIYLGIAECTSMIGYALGYVLGAPLVKVPENTTSATNTTVNNGSPEWLWTWWINFLFAAVVAWCTLIPLSCFPNNMPGSTRIKARKRKQLHFFDSRLKDLKLGTNIKDLCAALWILMKNPVLICLALSKATEYLVIIGASEFLPIYLENQFILTPTVATTLAGLVLIPGGALGQLLGGVIVSTLEMSCKALMRFIMVTSVISLILLVFIIFVRCNPVQFAGINEDYDGTGKLGNLTAPCNEKCRCSSSIYSSICGRDDIEYFSPCFAGCTYSKAQNQKKMYYNCSCIKEGLITADAEGDFIDARPGKCDAKCYKLPLFIAFIFSTLIFSGFSGVPIVLAMTRVVPDKLRSLALGVSYVILRIFGTIPGPSIFKMSGETSCILRDVNKCGHTGRCWIYNKTKMAFLLVGICFLCKLCTIIFTTIAFFIYKRRLNENTDFPDVTVKNPKVKKKEETDL

SEQ ID NO: 4337 - protein, 1058 aa, unidentified
MEDGTPKHIIQMTGFKMEEKEALVKLLLKLDCTFIKSEKYKNCTHLIAERLCKSEKFLAACAAGKWILTKDYIIHSAKSGRWLDETTYEWGYKIEKDSRYSPQMQSAPKRWREELKRTGAPGAFHRWKVVLLVRTDKRSDSLIRVLEAGKANVILPKSSPSGITHVIASNARIKAEKEKDNFKAPFYPIQYLGDFLLEKEIQNDEDSQTNSVWTEHSNEETNKDFRKDAGFLEMKGALRETMYRTQKEMQNHEDVNVGSILIQHHKKEKFSGSSKDLKFVKMRNTFGSHTYENQKEIKKKDEDIQRSYTLRRKRKKGKESNCKKGVEHEKIKSTLRRHIYNRDQKEMKNSIFAEYAKESKAMAIKTDVDVVEIKNTLRKHIYRAQAVRYNCIRIDKQPVYNVEVKNAEFPRGVLNLIESLIEGHFFKEAIEELSTLQAHYIPPVCVLHALLENVLQDNIDTFSGRYFHILSALLHLHPPWKSPAMSRYYLELFQCPTCMKGAWSLVEVLIRSCLFNESFCHQISENIGSKVLHLTLLKFFFNLIESEVQHLSQKLYDWSDSQNLKITGKAMLLEIFWSGSETSGLLTKPVNMLLEWTIYSHKEKFKSNDVFKHELAYLLAGILGAAIDYWIFLGLKMGRNVMRHMSDDLGSYVSLSCDDFSSQELEIFICSFSSSWLQMFVAEAVFKKLCLQSSGSVSSEPLSLQKMVYSYLPALGKTGVLGSGKIQVSKKIGQRPCFDSQRTLLMLNGTKQKQVEGLPELLDLNLAKCSSSLKKLKKKSEGELSCSKENCPSVVKKMNFHKTNLKGETALHRACINNQVEKLILLLSLPGIDINVKDNAGWTPLHEACNYGNTVCVQEILQRCPEVDLLTQVDGVTPLHDALSNGHVEIGKLLLQHGGPVLLQQRNAKGELPLDYVVSPQIKEELFAITKIEDTVENFHAQAEKHFHYQQLEFGSFLLSRMLLNFCSIFDLSSEFILASKGLTHLNELLMACKSHKETTSVHTDWLLDLYAGNIKTLQKLPHILKELPENLKVCPGVHTEALMITLEMMCRSVMEFS

SEQ ID NO: 4338 - protein, 1173 aa, unidentified
MTRRCMPARPGFPSSPAPGSSPPRCHLRPGSTAHAAAGKRTESPGDRKQSIIDFFKPASKQDRHMLDSPQKSNIKYGGSRLSITGTEQFERKLSSPKESKPKRVPPEKSPIIEAFMKGVKEHHEDHGIHESRRPCLSLASKYLAKGTNIYVPSSYHLPKEMKSLKKKHRSPERRKSLFIHENNEKNDRDRGKTNADSKKQTTVAEADIFNNSSRSLSSRSSLSRHHPEESPLGAKFQLSLASYCRERELKRLRKEQMEQRINSENSFSEASSLSLKSSIERKYKPRQEQRKQNDIIPGKNNLSNVENGHLSRKRSSSDSWEPTSAGSKQNKFPEKRKRNSVDSDLKSTRESMIPKARESFLEKRPDGPHQKEKFIKHIALKTPGDVLRLEDISKEPSDETDGSSAGLAPSNSGNSGHHSTRNSDQIQVAGTKETKMQKPHLPLSQEKSAIKKASNLQKNKTASSTTKEKETKLPLLSRVPSAGSSLVPLNAKNCALPVSKKDKERSSSKECSGHSTESTKHKEHKAKTNKADSNVSSGKISGGPLRSEYGTPTKSPPAALEVVPCIPSPAAPSDKAPSEGESSGNSNAGSSALKRKLRGDFDSDEESLGYNLDSDEEEETLKSLEEIMALNFNQTPAATGKPPALSKGLRSQSSDYTGHVHPGTYTNTLERLVKEMEDTQRLDELQKQLQEDIRQGRGIKSPIRIGEEDSTDDEDGLLEEHKEFLKKFSVTIDAIPDHHPGEEIFNFLNSGKIFNQYTLDLRDSGFIGQSAVEKLILKSGKTDQIFLTTQGFLTSAYHYVQCPVPVLKWLFRMMSVHTDCIVSVQILSTLMEITIRNDTFSDSPVWPWIPSLSDVAAVFFNMGIDFRSLFPLENLQPDFNEDYLVSETQTTSRGKESEDSSYKPIFSTLPETNILNVVKFLGLCTSIHPEGYQDREIMLLILMLFKMSLEKQLKQIPLVDFQSLLINLMKNIRDWNTKVPELCLGINELSSHPHNLLWLVQLVPNWTSRGRQLRQCLSLVIISKLLDEKHEDVPNASNLQVSVLHRYLVQMKPSDLLKKMVLKKKAEQPDGIIDDSLHLELEKQAYYLTYILLHLVGEVSCSHSFSSGQRKHFVLLCGALEKHVKCDIREDARLFYRTKVKDLVARIHGKWQEIIQNCRPTQGQLHDFWVPDS

SEQ ID NO: 4339 - protein, 588 aa, unidentified
MDLARKEFLRGNGLAAGKMNISIDLDTNYAELVLNVGRVTLGENNRKKMKDCQLRKQQNENVSRAVCALLNSGGGVIKAEVENKGYSYKKDGIGLDLENSFSNMLPFVPNFLDFMQNGNYFHIFVKSWSLETSGPQIATLSSSLYKRDVTSAKVMNASAALEFLKDMEKTGGRAYLRPEFPAKRACVDVQEESNMEALAADFFNRTELGYKEKLTFTESTHVEIKNFSTEKLLQRITEILPQYVSAFANTDGGYLFVGLNEDKEVIGFKAEKSYLTKLEEVTKNSIGKLPVHHFCVEKGTINYLCKFLGVYDKGRLCGYVYALRVERFCCAVFAKKPDSWHVKDNRVKQLTEKEWIQFMVDSEPVCEELPSPASTSSPVSQSYPLREYINFKIQPLRYHLPGLSEKITCAPKTFCRNLFSQHEGLKQLICEEMGSVNKGSLIFSRSWSLDLGLQENHKVLCDALLISQDKPPVLYTFHMVQDEEFKDYSTQTAQTLKQKLAKIGGYTKKVCVMTKIFYLSPEGKTSCQYDLNSQVIYPESYYWTTAQTMKDLEKALSNILPKENQIFLFVCLFRFCLFVCWFVCFFLR

SEQ ID NO: 4340 - protein, 1529 aa, unidentified
MRGVGWQMLSLSLGLVLAILNKVAPQACPAQCSCSGSTVDCHGLALRSVPRNIPRNTERLDLNGNNITRITKTDFAGLRHLRVLQLMENKISTIERGAFQDLKELERLRLNRNHLQLFPELLFLGTAKLYRLDLSENQIQAIPRKAFRGAVDIKNLQLDYNQISCIEDGAFRALRDLEVLTLNNNNITRLSVASFNHMPKLRTFRLHSNNLYCDCHLAWLSDWLRQRPRVGLYTQCMGPSHLRGHNVAEVQKREFVCSGHQSFMAPSCSVLHCPAACTCSNNIVDCRGKGLTEIPTNLPETITEIRLEQNTIKVIPPGAFSPYKKLRRIDLSNNQISELAPDAFQGLRSLNSLVLYGNKITELPKSLFEGLFSLQLLLLNANKINCLRVDAFQDLHNLNLLSLYDNKLQTIAKGTFSPLRAIQTMHLAQNPFICDCHLKWLADYLHTNPIETSGARCTSPRRLANKRIGQIKSKKFRCSAKEQYFIPGTEDYRSKLSGDCFADLACPEKCRCEGTTVDCSNQKLNKIPEHIPQYTAELRLNNNEFTVLEATGIFKKLPQLRKINFSNNKITDIEEGAFEGASGVNEILLTSNRLENVQHKMFKGLESLKTLMLRSNRITCVGNDSFIGLSSVRLLSLYDNQITTVAPGAFDTLHSLSTLNLLANPFNCNCYLAWLGEWLRKKRIVTGNPRCQKPYFLKEIPIQDVAIQDFTCDDGNDDNSCSPLSRCPTECTCLDTVVRCSNKGLKVLPKGIPRDVTELYLDGNQFTLVPKELSNYKHLTLIDLSNNRISTLSNQSFSNMTQLLTLILSYNRLRCIPPRTFDGLKSLRLLSLHGNDISVVPEGAFNDLSALSHLAIGANPLYCDCNMQWLSDWVKSEYKEPGIARCAGPGEMADKLLLTTPSKKFTCQGPVDVNILAKCNPCLSNPCKNDGTCNSDPVDFYRCTCPYGFKGQDCDVPIHACISNPCKHGGTCHLKEGEEDGFWCICADGFEGENCEVNVDDCEDNDCENNSTCVDGINNYTCLCPPEYTGELCEEKLDFCAQDLNPCQHDSKCILTPKGFKCDCTPGYVGEHCDIDFDDCQDNKCKNGAHCTDAVNGYTCICPEGYSGLFCEFSPPMVLPRTSPCDNFDCQNGAQCIVRINEPICQCLPGYQGEKCEKLVSVNFINKESYLQIPSAKVRPQTNITLQIATDEDSGILLYKGDKDHIAVELYRGRVRASYDTGSHPASAIYSVETINDGNFHIVELLALDQSLSLSVDGGNPKIITNLSKQSTLNFDSPLYVGGMPGKSNVASLRQAPGQNGTSFHGCIRNLYINSELQDFQKVPMQTGILPGCEPCHKKVCAHGTCQPSSQAGFTCECQEGWMGPLCDQRTNDPCLGNKCVHGTCLPINAFSYSCKCLEGHGGVLCDEEEDLFNPCQAIKCKHGKCRLSGLGQPYCECSSGYTGDSCDREISCRGERIRDYYQKQQGYAACQTTKKVSRLECRGGCAGGQCCGPLRSKRRKYSFECTDGSSFVDEVEKVVKCGCTRCVS

SEQ ID NO: 4341 - protein, 696 aa, unidentified
MLLWILLLETSLCFAAGNVTGDVCKEKICSCNEIEGDLHVDCEKKGFTSLQRFTAPTSQFYHLFLHGNSLTRLFPNEFANFYNAVSLHMENNGLHEIVPGAFLGLQLVKRLHINNNKIKSFRKQTFLGLDDLEYLQADFNLLRDIDPGAFQDLNKLEVLILNDNLISTLPANVFQYVPITHLDLRGNRLKTLPYEEVLEQIPGIAEILLEDNPWDCTCDLLSLKEWLENIPKNALIGRVVCEAPTRLQGKDLNETTEQDLCPLKNRVDSSLPAPPAQEETFAPGPLPTPFKTNGQEDHATPGSAPNGGTKIPGNWQIKIRPTAAIATGSSRNKPLANSLPCPGGCSCDHIPGSGLKMNCNNRNVSSLADLKPKLSNVQELFLRDNKIHSIRKSHFVDYKNLILLDLGNNNIATVENNTFKNLLDLRWLYMDSNYLDTLSREKFAGLQNLEYLNVEYNAIQLILPGTFNAMPKLRILILNNNLLRSLPVDVFAGVSLSKLSLHNNYFMYLPVAGVLDQLTSIIQIDLHGNPWECSCTIVPFKQWAERLGSEVLMSDLKCETPVNFFRKDFMLLSNDEICPQLYARISPTLTSHSKNSTGLAETGTHSNSYLDTSRVSISVLVPGLLLVFVTSAFTVVGMLVFILRNRKRSKRRDANSSASEINSLQTVCDSSYWHNGPYNADGAHRVYDCGSHSLSD

SEQ ID NO: 4342 - protein, 845 aa, unidentified
MLSGVWFLSVLTVAGILQTESRKTAKDICKIRCLCEEKENVLNINCENKGFTTVSLLQPPQYRIYQLFLNGNLLTRLYPNEFVNYSNAVTLHLGNNGLQEIRTGAFSGLKTLKRLHLNNNKLEILREDTFLGLESLEYLQADYNYISAIEAGAFSKLNKLKVLILNDNLLLSLPSNVFRFVLLTHLDLRGNRLKVMPFAGVLEHIGGIMEIQLEENPWNCTCDLLPLKAWLDTITVFVGEIVCETPFRLHGKDVTQLTRQDLCPRKSASDSSQRGSHADTHVQRLSPTMNPALNPTRAPKASRPPKMRNRPTPRVTVSKDRQSFGPIMVYQTKSPVPLTCPSSCVCTSQSSDNGLNVNCQERKFTNISDLQPKPTSPKKLYLTGNYLQTVYKNDLLEYSSLDLLHLGNNRIAVIQEGAFTNLTSLRRLYLNGNYLEVLYPSMFDGLQSLQYLYLEYNVIKEIKPLTFDALINLQLLFLNNNLLRSLPDNIFGGTALTRLNLRNNHFSHLPVKGVLDQLPAFIQIDLQENPWDCTCDIMGLKDWTEHANSPVIINEVTCESPAKHAGEILKFLGREAICPDSPNLSDGTVLSMNHNTDTPRSLSVSPSSYPELHTEVPLSVLILGLLVVFILSVCFGAGLFVFVLKRRKGVPSVPRNTNNLDVSSFQLQYGSYNTETHDKTDGHVYNYIPPPVGQMCQNPIYMQKEGDPVAYYRNLQEFSYSNLEEKKEEPATPAYTISATELLEKQATPREPELLYQNIAERVKELPSAGLVHYNFCTLPKRQFAPSYESRRQNQDRINKTVLYGTPRKCFVGQSKPNHPLLQAKPQSEPDYLEVLEKQTAISQL

SEQ ID NO: 4343 - protein, 977 aa, unidentified
MKPSIAEMLHRGRMLWIILLSTIALGWTTPIPLIEDSEEIDEPCFDPCYCEVKESLFHIHCDSKGFTNISQITEFWSRPFKLYLQRNSMRKLYTNSFLHLNNAVSINLGNNALQDIQTGAFNGLKILKRLYLHENKLDVFRNDTFLGLESLEYLQADYNVIKRIESGAFRNLSKLRVLILNDNLIPMLPTNLFKAVSLTHLDLRGNRLKVLFYRGMLDHIGRSLMELQLEENPWNCTCEIVQLKSWLERIPYTALVGDITCETPFHFHGKDLREIRKTELCPLLSDSEVEASLGIPHSSSSKENAWPTKPSSMLSSVHFTASSVEYKSSNKQPKPTKQPRTPRPPSTSQALYPGPNQPPIAPYQTRPPIPIICPTGCTCNLHINDLGLTVNCKERGFNNISELLPRPLNAKKLYLSSNLIQKIYRSDFWNFSSLDLLHLGNNRISYVQDGAFINLPNLKSLFLNGNDIEKLTPGMFRGLQSLHYLYFEFNVIREIQPAAFSLMPNLKLLFLNNNLLRTLPTDAFAGTSLARLNLRKNYFLYLPVAGVLEHLNAIVQIDLNENPWDCTCDLVPFKQWIETISSVSVVGDVLCRSPENLTHRDVRTIELEVLCPEMLHVAPAGESPAQPGDSHLIGAPTSASPYEFSPPGGPVPLSVLILSLLVLFFSAVFVAAGLFAYVLRRRRKKLPFRSKRQEGVDLTGIQMQCHRLFEDGGGGGGGSGGGGRPTLSSPEKAPPVGHVYEYIPHPVTQMCNNPIYKPREEEEVAVSSAQEAGSAERGGPGTQPPGMGEALLGSEQFAETPKENHSNYRTLLEKEKEWALAVSSSQLNTIVTVNHHHPHHPAVGGVSGVVGGTGGDLAGFRHHEKNGGVVLFPPGGGCGSGSMLLDRERPQPAPCTVGFVDCLYGTVPKLKELHVHPPGMQYPDLQQDARLKETLLFSAGKGFTDHQTQKSDYLELRAKLQTKPDYLEVLEKTTYRF

SEQ ID NO: 4344 - protein, 837 aa, unidentified
MFLWLFLILSALISSTNADSDISVEICNVCSCVSVENVLYVNCEKVSVYRPNQLKPPWSNFYHLNFQNNFLNILYPNTFLNFSHAVSLHLGNNKLQNIEGGAFLGLSALKQLHLNNNELKILRADTFLGIENLEYLQADYNLIKYIERGAFNKLHKLKVLILNDNLISFLPDNIFRFASLTHLDIRGNRIQKLPYIGVLEHIGRVVELQLEDNPWNCSCDLLPLKAWLENMPYNIYIGEAICETPSDLYGRLLKETNKQELCPMGTGSDFDVRILPPSQLENGYTTPNGHTTQTSLHRLVTKPPKTTNPSKISGIVAGKALSNRNLSQIVSYQTRVPPLTPCPAPCFCKTHPSDLGLSVNCQEKNIQSMSELIPKPLNAKKLHVNGNSIKDVDVSDFTDFEGLDLLHLGSNQITVIKGDVFHNLTNLRRLYLNGNQIERLYPEIFSGLHNLQYLYLEYNLIKEISAGTFDSMPNLQLLYLNNNLLKSLPVYIFSGAPLARLNLRNNKFMYLPVSGVLDQLQSLTQIDLEGNPWDCTCDLVALKLWVEKLSDGIVVKELKCETPVQFANIELKSLKNEILCPKLLNKPSAPFTSPAPAITFTTPLGPIRSPPGGPVPLSILILSILVVLILTVFVAFCLLVFVLRRNKKPTVKHEGLGNPDCGSMQLQLRKHDHKTNKKDGLSTEAFIPQTIEQMSKSHTCGLKESETGFMFSDPPGQKVVMRNVADKEKDLLHVDTRKRLSTIDELDELFPSRDSNVFIQNFLESKKEYNSIGVSGFEIRYPEKQPDKKSKKSLIGGNHSKIVVEQRKSEYFELKAKLQSSPDYLQVLEEQTALNKI

SEQ ID NO: 4345 - protein, 958 aa, unidentified
MHTCCPPVTLEQDLHRKMHSWMLQTLAFAVTSLVLSCAETIDYYGEICDNACPCEEKDGILTVSCENRGIISLSEISPPRFPIYHLLLSGNLLNRLYPNEFVNYTGASILHLGSNVIQDIETGAFHGLRGLRRLHLNNNKLELLRDDTFLGLENLEYLQVDYNYISVIEPNAFGKLHLLQVLILNDNLLSSLPNNLFRFVPLTHLDLRGNRLKLLPYVGLLQHMDKVVELQLEENPWNCSCELISLKDWLDSISYSALVGDVVCETPFRLHGRDLDEVSKQELCPRRLISDYEMRPQTPLSTTGYLHTTPASVNSVATSSSAVYKPPLKPPKGTRQPNKPRVRPTSRQPSKDLGYSNYGPSIAYQTKSPVPLECPTACSCNLQISDLGLNVNCQERKIESIAELQPKPYNPKKMYLTENYIAVVRRTDFLEATGLDLLHLGNNRISMIQDRAFGDLTNLRRLYLNGNRIERLSPELFYGLQSLQYLFLQYNLIREIQSGTFDPVPNLQLLFLNNNLLQAMPSGVFSGLTLLRLNLRSNHFTSLPVSGVLDQLKSLIQIDLHDNPWDCTCDIVGMKLWVEQLKVGVLVDEVICKAPKKFAETDMRSIKSELLCPDYSDVVVSTPTPSSIQVPARTSAVTPAVRLNSTGAPASLGAGGGASSVPLSVLILSLLLVFIMSVFVAAGLFVLVMKRRKKNQSDHTSTNNSDVSSFNMQYSVYGGGGGTGGHPHAHVHHRGPALPKVKTPAGHVYEYIPHPLGHMCKNPIYRSREGNSVEDYKDLHELKVTYSSNHHLQQQQQPPPPPQQPQQQPPPQLQLQPGEEERRESHHLRSPAYSVSTIEPREDLLSPVQDADRFYRGILEPDKHCSTTPAGNSLPEYPKFPCSPAAYTFSPNYDLRRPHQYLHPGAGDSRLREPVLYSPPSAVFVEPNRNEYLELKAKLNVEPDYLEVLEKQTTFSQF

SEQ ID NO: 4346 - protein, 841 aa, unidentified
MKLWIHLFYSSLLACISLHSQTPVLSSRGSCDSLCNCEEKDGTMLINCEAKGIKMVSEISVPPSRPFQLSLLNNGLTMLHTNDFSGLTNAISIHLGFNNIADIEIGAFNGLGLLKQLHINHNSLEILKEDTFHGLENLEFLQADNNFITVIEPSAFSKLNRLKVLILNDNAIESLPPNIFRFVPLTHLDLRGNQLQTLPYVGFLEHIGRILDLQLEDNKWACNCDLLQLKTWLENMPPQSIIGDVVCNSPPFFKGSILSRLKKESICPTPPVYEEHEDPSGSLHLAATSSINDSRMSTKTTSILKLPTKAPGLIPYITKPSTQLPGPYCPIPCNCKVLSPSGLLIHCQERNIESLSDLRPPPQNPRKLILAGNIIHSLMKSDLVEYFTLEMLHLGNNRIEVLEEGSFMNLTRLQKLYLNGNHLTKLSKGMFLGLHNLEYLYLEYNAIKEILPGTFNPMPKLKVLYLNNNLLQVLPPHIFSGVPLTKVNLKTNQFTHLPVSNILDDLDLLTQIDLEDNPWDCSCDLVGLQQWIQKLSKNTVTDDILCTSPGHLDKKELKALNSEILCPGLVNNPSMPTQTSYLMVTTPATTTNTADTILRSLTDAVPLSVLILGLLIMFITIVFCAAGIVVLVLHRRRRYKKKQVDEQMRDNSPVHLQYSMYGHKTTHHTTERPSASLYEQHMVSPMVHVYRSPSFGPKHLEEEEERNEKEGSDAKHLQRSLLEQENHSPLTGSNMKYKTTNQSTEFLSFQDASSLYRNILEKERELQQLGITEYLRKNIAQLQPDMEAHYPGAHEELKLMETLMYSRPRKVLVEQTKNEYFELKANLHAEPDYLEVLEQQT

SEQ ID NO: 4347 - protein, 828 aa, unidentified
MPSALAIFTCRPNSHPFQERHVYLDEPIKIGRSVARCRPAQNNATFDCKVLSRNHALVWFDHKTGKFYLQDTKSSNGTFINSQRLSRGSEESPPCEILSGDIIQFGVDVTENTRKVTHGCIVSTIKLFLPDGMEARLRSDVIHAPLPSPVDKVAANTPSMYSQELFQLSQYLQEALHREQMLEQKLATLQRLLAITQEASDTSWQALIDEDRLLSRLEVMGNQLQACSKNQTEDSLRKELIALQEDKHNYETTAKESLRRVLQEKIEVVRKLSEVERSLSNTEDECTHLKEMNERTQEELRELANKYNGAVNEIKDLSDKLKVAEGKQEEIQQKGQAEKKELQHKIDEMEEKEQELQAKIEALQADNDFTNERLTALQVRLEHLQEKTLKECSSLEHLLSKSGGDCTFIHQFIECQKKLIVEGHLTKAVEETKLSKENQTRAKESDFSDTLSPSKEKSSDDTTDAQMDEQDLNEPLAKVSLLKDDLQGAQSEIEAKQEIQHLRKELIEAQELARTSKQKCFELQALLEEERKAYRNQVEESTKQIQVLQAQLQRLHIDTENLREEKDSEITSTRDELLSARDEILLLHQAAAKVASERDTDIASLQEELKKVRAELERWRKAASEYEKEITSLQNSFQLRCQQCEDQQREEATRLQGELEKLRKEWNALETECHSLKRENVLLSSELQRQEKELHNSQKQSLELTSDLSILQMSRKELENQVGSLKEQHLRDSADLKTLLSKAENQAKDVQKEYEKTQTVLSELKLKFEMTEQEKQSITDELKQCKNNLKLLREKGNNKPWPWMPMLAALVAVTAIVLYVPGLARASP

SEQ ID NO: 4348 - protein, 31 aa, unidentified
MGINTRELFLNFTIVLITVILMWLLVRSYQY

SEQ ID NO: 4349 - protein, 467 aa, unidentified
MSSILPFTPPVVKRLLGWKKSAGGSGGAGGGEQNGQEEKWCEKAVKSLVKKLKKTGRLDELEKAITTQNCNTKCVTIPSTCSEIWGLSTPNTIDQWDTTGLYSFSEQTRSLDGRLQVSHRKGLPHVIYCRLWRWPDLHSHHELKAIENCEYAFNLKKDEVCVNPYHYQRVETPVLPPVLVPRHTEILTELPPLDDYTHSIPENTNFPAGIEPQSNYIPETPPPGYISEDGETSDQQLNQSMDTGSPAELSPTTLSPVNHSLDLQPVTYSEPAFWCSIAYYELNQRVGETFHASQPSLTVDGFTDPSNSERFCLGLLSNVNRNATVEMTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSVRCSSMS

SEQ ID NO: 4350 - protein, 97 aa, unidentified
MTSLLTTPSPREELMTTPILQPTEALSPEDGASTALIAVVITVVFLTLLSVVILIFFYLYKNKGSYVTYEPTEGEPSAIVQMESDLAKGSEKEEYFI

SEQ ID NO: 4351 - protein, 343 aa, unidentified
MALTPTNLNNKMSLQMKMDCQEQQLTKKNNGFFQKLNVTEGAMQDLLKEIIKVDHILDRSDDEDDISSENPQTDFLHKGMLELEAEHDQDLSKQDKQETDVDEDPQASTSLQFSKKNLLELCLKGMFLKLNYWNTKIGLQVKELGADYIDGTEKIDNIIKKINVTENTVKSLLKDMLTLKGQIEKLEDRGLDLDQGTSTEVNTCNEVYELKKKVIERLEDLCKNVELLSAKLRMYQMEAEDTDSHSSEEIDTEEMEALLPQAPASFLVQKSPPRNTAWKRALRIFIMFDVLTVTGLLCYILFFGATFLFERVLLRMLGCRTTWDLREMREPFLNLEVEALLPS

SEQ ID NO: 4352 - protein, 225 aa, unidentified
MAQSDFLYPENPKRREEVNRLHQQLLDCLSDSFDVTNKLTEVLNMHLGCRLASIEMKRDGTIKENCDLIIQAIMKIQKELQKVDEALKDKLEPTLYRKLQDIKEKETDKIAIVQKVISVILGEATSAASAVAVKLVGSNVTTGIINKLVTVLAQIGASLLGSIGVAVLGLGIDMIVRAILGAVEKTQLQAAIKSYEKHLVEFKSASEKYNHAITEVINTVKHQMK

SEQ ID NO: 4353 - protein, 59 aa, unidentified
MRQLKGKPKKETSKDKKERKQAMQEARQQITTVVLPTLAVVVLLIVVFVYVATRPTITE

SEQ ID NO: 4354 - protein, 107 aa, unidentified
MASGAARWLVLAPVRSGALRSGPSLRKDGDVSAAWSGSGRSLVPSRSVIVTRSGAILPKPVKMSFGLLRVFSIVIPFLYVGTLISKNFAALLEEHDIFVPEDDDDDD

SEQ ID NO: 4355 - protein, 1016 aa, unidentified
MSQGPPTGESSEPEAKVLHTKRLYRAVVEAVHRLDLILCNKTAYQEVFKPENISLRNKLRELCVKLMFLHPVDYGRKAEELLWRKVYYEVIQLIKTNKKHIHSRSTLECAYRTHLVAGIGFYQHLLLYIQSHYQLELQCCIDWTHVTDPLIGCKKPVSASGKEMDWAQMACHRCLVYLGDLSRYQNELAGVDTELLAERFYYQALSVAPQIGMPFNQLGTLAGSKYYNVEAMYCYLRCIQSEVSFEGAYGNLKRLYDKAAKMYHQLKKCETRKLSPGKKRCKDIKRLLVNFMYLQSLLQPKSSSVDSELTSLCQSVLEDFNLCLFYLPSSPNLSLASEDEEEYESGYAFLPDLLIFQMVIICLMCVHSLERAGSKQYSAAIAFTLALFSHLVNHVNIRLQAELEEGENPVPAFQSDGTDEPESKEPVEKEEEPDPEPPPVTPQVGEGRKSRKFSRLSCLRRRRHPPKVGDDSDLSEGFESDSSHDSARASEGSDSGSDKSLEGGGTAFDAETDSEMNSQESRSDLEDMEEEEGTRSPTLEPPRGRSEAPDSLNGPLGPSEASIASNLQAMSTQMFQTKRCFRLAPTFSNLLLQPTTNPHTSASHRPCVNGDVDKPSEPASEEGSESEGSESSGRSCRNERSIQEKLQVLMAEGLLPAVKVFLDWLRTNPDLIIVCAQSSQSLWNRLSVLLNLLPAAGELQESGLALCPEVQDLLEGCELPDLPSSLLLPEDMALRNLPPLRAAHRRFNFDTDRPLLSTLEESVVRICCIRSFGHFIARLQGSILQFNPEVGIFVSIAQSEQESLLQQAQAQFRMAQEEARRNRLMRDMAQLRLQLEVSQLEGSLQQPKAQSAMSPYLVPDTQALCHHLPVIRQLATSGRFIVIIPRTVIDGLDLLKKEHPGARDGIRYLEAEFKKGNRYIRCQKEVGKSFERHKLKRQDADAWTLYKILDSCKQLTLAQGAGEEDPSGMVTIITGLPLDNPSVLSGPMQAALQAAAHASVDIKNVLDFYKQWKEIG

SEQ ID NO: 4356 - protein, 991 aa, unidentified
MAGPVSLRDLLMGASAWMGSESPGGSPTEGGGSAAGGPEPPWREDEICVVGIFGKTALRLNSEKFSLVNTVCDRQVFPLFRHQDPGDPGPGIRTEAGAVGEAGGAEDPGAAAGGSVRGSGAVAEGNRTEAGSQDYSLLQAYYSQESKVLYLLLTSICDNSQLLRACRALQSGEAGGGLSLPHAEAHEFWKHQEKLQCLSLLYLFSVCHILLLVHPTCSFDITYDRVFRALDGLRQKVLPLLKTAIKDCPVGKDWKLNCRPCPPRLLFLFQLNGALKVEPPRNQDPAHPDKPKKHSPKRRLQHALEDQIYRIFRKSRVLTNQSINCLFTVPANQAFVYIVPGSQEEDPVGMLLDQLRSHCTVKDPESLLVPAPLSGPRRYQVMRQHSRQQLSFHIDSSSSSSSGQLVDFTLREFLWQHVELVLSKKGFDDSVGRNPQPSHFELPTYQKWISAASKLYEVAIDGKEEDLGSPTGELTSKILSSIKVLEGFLDIDTKFSENRCQKALPMAHSAYQSNLPHNYTMTVHKNQLAQALRVYSQHARGPAFHKYAMQLHEDCYKFWSNGHQLCEERSLTDQHCVHKFHSLPKSGEKPEADRNPPVLYHNSRARSTGACNCGRKQAPRDDPFDIKAANYDFYQLLEEKCCGKLDHINFPVFEPSTPDPAPAKNESSPAPPDSDADKLKEKEPQTQGESTSLSLALSLGQSTDSLGTYPADPQAGGDNPEVHGQVEVKTEKRPNFVDRQASTVEYLPGMLHSNCPKGLLPKFSSWSLVKLGPAKSYNFHTGLDQQGFIPGTNYLMPWDIVIRTRAEDEGDLDTNSWPAPNKAIPGKRSAVVMGRGRRRDDIARAFVGFEYEDSRGRRFMCSGPDKVMKVMGSGPKESALKALNSDMPLYILSSSQGRGLKPHYAQLMRLFVVVPDAPLQIILMPQVQPGPPPCPVFYPEKQEITLPPDGLWVLRFPYAYVTERGPCFPPKENVQLMSYKVLRGVLKAVTQ

SEQ ID NO: 4357 - protein, 520 aa, unidentified
MSESGHSQPGLYGIERRRRWKEPGSGGPQNLSGPGGRERDYIAPWERERRDASEETSTSVMQKTPIILSKPPAERSKQPPPPTAPAAPPAPAPLEKPIVLMKPREEGKGPVAVTGASTPEGTAPPPPAAPAPPKGEKEGQRPTQPVYQIQNRGMGTAAPAAMDPVVGQAKLLPPERMKHSIKLVDDQMNWCDSAIEYLLDQTDVLVVGVLGLQGTGKSMVMSLLSANTPEEDQRTYVFRAQSAEMKERGGNQTSGIDFFITQERIVFLDTQPILSPSILDHLINNDRKLPPEYNLPHTYVEMQSLQIAAFLFTVCHVVIVVQDWFTDLSLYRFLQTAEMVKPSTPSPSHESSSSSGSDEGTEYYPHLVFLQNKARREDFCPRKLRQMHLMIDQLMAHSHLRYKGTLSMLQCNVFPGLPPDFLDSEVNLFLVPFMDSEAESENPPRAGPGSSPLFSLLPGYRGHPSFQSLVSKLRSQVMSMARPQLSHTILTEKNWFHYAARIWDGVRKSSALAEYSRLLA

SEQ ID NO: 4358 - protein, 78 aa, unidentified
MQPQESHVHYSRWEDGSRDGVSLGAVSSTEEASRCRRISQRLCTGKLGIAMKVLGGVALFWIIFILGYLTGYYVHKCK

SEQ ID NO: 4359 - protein, 83 aa, unidentified
MEALGSGHYVGGSIRSMAAAALSGLAVRLSRPQGTRGSYGAFCKTLTRTLLTFFDLAWRLRKNFFYFYILASVILNVHLQVYI

SEQ ID NO: 4360 - protein, 58 aa, unidentified
MNWKVLEHVPLLLYILAAKTLILCLTFAGVKMYQRKRLEAKQQKLEAERKKQSEKKDN

SEQ ID NO: 4361 - protein, 92 aa, unidentified
MWPVFWTVVRTYAPYVTFPVAFVVGAVGYHLEWFIRGKDPQPVEEEKSISERREDRKLDELLGKDHTQVVSLKDKLEFAPKAVLNRNRPEKN

SEQ ID NO: 4362 - protein, 91 aa, unidentified
MWHSVGLTLLVFVATLLIVLLLMVCGWYFVWHLFLSKFKFLRELVGDTGSQEGDHEPSGSETEEDTSSSPHRIRSARQRRAPADEGHRPLT

SEQ ID NO: 4363 - protein, 99 aa, unidentified
MAEGGFDPCECVCSHEHAMRRLINLLRQSQSYCTDTECLQELPGPSGDNGISVTMILVAWMVIALILFLLRPPNLRGSSLPGKPTSPHNGQDPPAPPVD

SEQ ID NO: 4364 - protein, 118 aa, unidentified
MQSLRPEQTRGLLEPERTKTLLPRESRAWEKPPHPACTKDWEAVEVGASSHDSDEKDLSSQETGLSQEWSSVEEDDESEGSQGFVEWSKAPQQTTIVLVVCVLFLFLVLTGMPMMFHI

SEQ ID NO: 4365 - protein, 95 aa, unidentified
MASSHWNETTTSVYQYLGFQVQKIYPFHDNWNTACFVILLLFIFTVVSLVVLAFLYEVLDCCCCVKNKTVKDLKSEPNPLRSMMDNIRKRETEVV

SEQ ID NO: 4366 - protein, 107 aa, unidentified
MAGGYGVMGDDGSIDYTVHEAWNEATNVYLIVILVSFGLFMYAKRNKRRIMRIFSVPPTEETLSEPNFYDTISKIRLRQQLEMYSISRKYDYQQPQNQADSVQLSLE

SEQ ID NO: 4367 - protein, 85 aa, unidentified
MEAGERIDASQLPHRVLETRGHAISILFGFWTSFICDTYIVLAWISKIKGSPDVSASSDEPYARIQQSRRQCHAEEDQSQVPEAG

SEQ ID NO: 4368 - protein, 67 aa, unidentified
MSRNLRTALIFGGFISLIGAAFYPIYFRPLMRLEEYKKEQAINRAGIVQEDVQPPGLKVWSDPFGRK

SEQ ID NO: 4369 - protein, 101 aa, unidentified
MDQYVSTAPPRFPIAQLGTFKQDSAGMGRIFKGNLLQKKALTTFENEHHIRFFTLLVLFHVMVLLRNHSRIQGVSEDWKRANSIFRNFLRLKSSRNTAEAE

SEQ ID NO: 4370 - protein, 83 aa, unidentified
MAVSTEELEATVQEVLGRLKSHQFFQSTWDTVAFIVFLTFMGTVLLLLLLVVAHCCCCSSPGPRRESPRKERPKGVDNLALEP

SEQ ID NO: 4371 - protein, 130 aa, unidentified
METLGALLVLEFLLLSPVEAQQATEHRLKPWLVGLAAVVGFLFIVYLVLLANRLWCSKARAEDEEETTFRMESNLYQDQSEDKREKKEAKEKEEKRKKEKKTAKEGESNLGLDLEEKEPGDHERAKSTVM

SEQ ID NO: 4372 - protein, 60 aa, unidentified
MDAVSQVPMEVVLPKHILDIWVIVLIILATIVIMTSLLLCPATAVIIYRMRTHPILSGAV

SEQ ID NO: 4373 - protein, 70 aa, unidentified
MFTRAQVRRILQRVPGKQRFGIYRFLPFFFVLGGTMEWIMIKVRVGQETFYDVYRRKASERQYQRRLEDE

SEQ ID NO: 4374 - protein, 77 aa, unidentified
MAATDFVQEMRAVGERLLLKLQRLPQAEPVEIVAFSVIILFTATVLLLLLIACSCCCTHCCCPERRGRKVQVQPTPP

SEQ ID NO: 4375 - protein, 62 aa, unidentified
MDQLVFKETIWNDAFWQNPWDQGGLAVIILFITAVLLLILFAIVFGLLTSTENTQCEAGEEE

SEQ ID NO: 4376 - protein, 75 aa, unidentified
MIGDILLFGTLLMNAGAVLNFKLKKKDTQGFGEESREPSTGDNIREFLLSLRYFRIFIALWNIFMMFCMIVLFGS

SEQ ID NO: 4377 - protein, 97 aa, unidentified
MSSAPEPPTFKKEPPKEKEFQSPGLRGVRTTTLFRAVNPELFIKPNKPVMAFGLVTLSLCVAYIGYLHAIQENKKDLYEAIDSEGHSYMRRKTSKWD

SEQ ID NO: 4378 - protein, 99 aa, unidentified
MEPQKLLIIGFLLCSLTCLLLETVASSPLPLSALGIQEKTGSKPRSGGNHRSWLNNFRDYLWQLIKSALPPAAIVAFLLTSALMGILCCFTILVVDPVH

SEQ ID NO: 4379 - protein, 107 aa, unidentified
MLSKGRSPRRKQVQTQRKAALVLSVTPMVPVGSVWLAMSSVLSAFMRELPGWFLFFGVFLPVTLLLLLLIAYFRIKLIEVNEELSQNCDRQHNPKDGSSLYQRMKWT

SEQ ID NO: 4380 - protein, 787 aa, unidentified
MAAARPARGPELPLLGLLLLLLLGDPGRGAASSGNATGPGPRSAGGSARRSAAVTGPPPPLSHCGRAAPCEPLRYNVCLGSVLPYGATSTLLAGDSDSQEEAHGKLVLWSGLRNAPRCWAVIQPLLCAVYMPKCENDRVELPSRTLCQATRGPCAIVERERGWPDFLRCTPDRFPEGCTNEVQNIKFNSSGQCEVPLVRTDNPKSWYEDVEGCGIQCQNPLFTEAEHQDMHSYIAAFGAVTGLCTLFTLATFVADWRNSNRYPAVILFYVNACFFVGSIGWLAQFMDGARREIVCRADGTMRLGEPTSNETLSCVIIFVIVYYALMAGVVWFVVLTYAWHTSFKALGTTYQPLSGKTSYFHLLTWSLPFVLTVAILAVAQVDGDSVSGICFVGYKNYRYRAGFVLAPIGLVLIVGGYFLIRGVMTLFSIKSNHPGLLSEKAASKINETMLRLGIFGFLAFGFVLITFSCHFYDFFNQAEWERSFRDYVLCQANVTIGLPTKQPIPDCEIKNRPSLLVEKINLFAMFGTGIAMSTWVWTKATLLIWRRTWCRLTGQSDDEPKRIKKSKMIAKAFSKRHELLQNPGQELSFSMHTVSHDGPVAGLAFDLNEPSADVSSAWAQHVTKMVARRGAILPQDISVTPVATPVPPEEQANLWLVEAEISPELQKRLGRKKKRRKRKKEVCPLAPPPELHPPAPAPSTIPRLPQLPRQKCLVAAGAWGAGDSCRQGAWTLVSNPFCPEPSPPQDPFLPSAPAPVAWAHGRRQGLGPIHSRTNLMDTELMDADSDF

SEQ ID NO: 4381 - protein, 446 aa, unidentified
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTDDAAAPALETQPQGDEEDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQPRKQG

SEQ ID NO: 4382 - protein, 423 aa, unidentified
MKPNFSLRLRIFNLNCWGIPYLSKHRADRMRRLGDFLNQESFDLALLEEVWSEQDFQYLRQKLSPTYPAAHHFRSGIIGSGLCVFSKHPIQELTQHIYTLNGYPYMIHHGDWFSGKAVGLLVLHLSGMVLNAYVTHLHAEYNRQKDIYLAHRVAQAWELAQFIHHTSKKADVVLLCGDLNMHPEDLGCCLLKEWTGLHDAYLETRDFKGSEEGNTMVPKNCYVSQQELKPFPFGVRIDYVLYKAVSGFYISCKSFETTTGFDPHRGTPLSDHEALMATLFVRHSPPQQNPSSTHGPAERSPLMCVLKEAWTELGLGMAQARWWATFASYVIGLGLLLLALLCVLAAGGGAGEAAILLWTPSVGLVLWAGAFYLFHVQEVNGLYRAQAELQHVLGRAREAQDLGPEPQPALLLGQQEGDRTKEQ

SEQ ID NO: 4383 - protein, 655 aa, unidentified
MVLYTTPFPNSCLSALHCVSWALIFPCYWLVDRLAASFIPTTYEKRQRADDPCCLQLLCTALFTPIYLALLVASLPFAFLGFLFWSPLQSARRPYIYSRLEDKGLAGGAALLSEWKGTGPGKSFCFATANVCLLPDSLARVNNLFNTQARAKEIGQRIRNGAARPQIKIYIDSPTNTSISAASFSSLVSPQGGDGVARAVPGSIKRTASVEYKGDGGRHPGDEAANGPASGDPVDSSSPEDACIVRIGGEEGGRPPEADDPVPGGQARNGAGGGPRGQTPNHNQQDGDSGSLGSPSASRESLVKGRAGPDTSASGEPGANSKLLYKASVVKKAAARRRRHPDEAFDHEVSAFFPANLDFLCLQEVFDKRAATKLKEQLHGYFEYILYDVGVYGCQGCCSFKCLNSGLLFASRYPIMDVAYHCYPNKCNDDALASKGALFLKVQVGSTPQDQRIVGYIACTHLHAPQEDSAIRCGQLDLLQDWLADFRKSTSSSSAANPEELVAFDVVCGDFNFDNCSSDDKLEQQHSLFTHYRDPCRLGPGEEKPWAIGTLLDTNGLYDEDVCTPDNLQKVLESEEGRREYLAFPTSKSSGQKGRKELLKGNGRRIDYMLHAEEGLCPDWKAEVEEFSFITQLSGLTDHLPVAMRLMVSSGEEEA

SEQ ID NO: 4384 - protein, 866 aa, unidentified
MTTFGAVAEWRLPSLRRATLWIPQWFAKKAIFNSPLEAAMAFPHLQQPSFLLASLKADSINKPFAQQCQDLVKVIEDFPAKELHTIFPWLVESIFGSLDGVLVGWNLRCLQGRVNPVEYSIVMEFLDPGGPMMKLVYKLQAEDYKFDFPVSYLPGPVKASIQECILPDSPLYHNKVQFTPTGGLGLNLALNPFEYYIFFFALSLITQKPLPVSLHVRTSDCAYFILVDRYLSWFLPTEGSVPPPLSSSPGGTSPSPPPRTPAIPFASYGLHHTSLLKRHISHQTSVNADPASHEIWRSETLLQVFVEMWLHHYSLEMYQKMQSPHAKLEVLHYRLSVSSALYSPAQPSLQALHAYQESFTPTEEHVLVVRLLLKHLHAFANSLKPEQASPSAHSHATSPLEEFKRAAVPRFVQQKLYLFLQHCFGHWPLDASFRAVLEMWLSYLQPWRYAPDKQAPGSDSQPRCVSEKWAPFVQENLLMYTKLFVGFLNRALRTDLVSPKHALMVFRVAKVFAQPNLAEMIQKGEQLFLEPELVIPHRQHRLFTAPTFTGSFLSPWPPAVTDASFKVKSHVYSLEGQDCKYTPMFGPEARTLVLRLAQLITQAKHTAKSISDQCAESPAGHSFLSWLGFSSMDTNGSYTANDLDEMGQDSVRKTDEYLEKALEYLRQIFRLSEAQLRQFTLALGTTQDENGKKQLPDCIVGEDGLILTPLGRYQIINGLRRFEIEYQGDPELQPIRSYEIASLVRTLFRLSSAINHRFAGQMAALCSRDDFLGSFCRYHLTEPGLASRHLLSPVGRRQVAGHTRGPRLSLRFLGSYRTLVSLLLAFFVASLFCVGPLPCTLLLTLGYVLYASAMTLLTERGKLHQP

SEQ ID NO: 4385 - protein, 804 aa, unidentified
MDLPVDEWKSYLLQKWASLPTSVQVTISTAETLRDIFLHSSSLLQPEDELFLKRLSKGYLVGKDSDAPLFYREEGNKKFQEKDYTGAAVLYSKGVSHSRPNTEDMSLCHANRSAALFHLGQYETCLKDINRAQTHGYPERLQPKIMLRKAECLVALGRLQEASQTISDLERNFTATPALADVLPQTLQRNLHRLKMKMQEKDSLTESFPAALAKTLEDAALREENEQLSNASSSIGLCVDPLKGRCLVATKDILPGELLVQEDAFVSVLNPGELPPPHHGLDSKWDTRVTNGDLYCHRCLKHTLATVPCDGCSYAKYCSQECLQQAWELYHRTECPLGGLLLTLGVFCHIALRLTLLVGFEDVRKIITKLCDKISNKDICLPESNNQVKTLNYGLGESEKNGNIVETPIPGCDINGKYENNYNAVFNLLPHTENHSPEHKFLCALCVSALCRQLEAASLQAIPTERIVNSSQLKAAVTPELCPDVTIWGVAMLRHMLQLQCNAQAMTTIQHTGPKGSIVTDSRQVRLATGIFPVISLLNHSCSPNTSVSFISTVATIRASQRIRKGQEILHCYGPHKSRMGVAERQQKLRSQYFFDCACPACQTEAHRMAAGPRWEAFCCNSCGAPMQGDDVLRCGSRSCAESAVSRDHLVSRLQDLQQQVRVAQKLLRDGELERAVQRLSGCQRDAESFLWAEHAVVGEIADGLARACAALGDWQKSATHLQRSLYVVEVRHGPSSVEMGHELFKLAQIFFNGFAVPEALSTIQKAEEVLSLHCGPWDDEIQELQKMKSCLLDLPPTPVGPAL

SEQ ID NO: 4386 - protein, 211 aa, unidentified
MDNLSSEEIQQRAHQITDESLESTRRILGLAIESQDAGIKTITMLDEQKEQLNRIEEGLDQINKDMRETEKTLTELNKCCGLCVCPCNRTKNFESGKAYKTTWGDGGENSPCNVVSKQPGPVTNGQLQQPTTGAASGGYIKRITNDAREDEMEENLTQVGSILGNLKDMALNIGNEIDAQNPQIKRITDKADTNRDRIDIANARAKKLIDS

SEQ ID NO: 4387 - protein, 88 aa, unidentified
MSIMDHSPTTGVVTVIVILIAIAALGALILGCWCYLRLQRISQSEDEESIVGDGETKEPFLLVQYSAKGPCVERKAKLMTPNGPEVHG

SEQ ID NO: 4388 - protein, 494 aa, unidentified
MAMSLPGSRRTSAGSRRRTSPPVSVRDAYGTSSLSSSSNSGSYKGSDSSPTPRRSMKYTLCSDNHGIKPPTPEQYLTPLQQKEVCIRHLKARLKDTQDRLQDRDTEIDDLKTQLSRMQEDWIEEECHRVEAQLALKEARKEIKQLKQVIDTVKNNLIDKDKGLQKYFVDINIQNKKLETLLHSMEVAQNGMAKEDGTGESAGGSPARSLTRSSTYTKLSDPAVCGDRQPGDPSSGSAEDGADSGFAAADDTLSRTDALEASSLLSSGVDCGTEETSLHSSFGLGPRFPASNTYEKLLCGMEAGVQASCMQERAIQTDFVQYQPDLDTILEKVTQAQVCGTDPESGDRCPELDAHPSGPRDPNSAVVVTVGDELEAPEPITRGPTPQRPGANPNPGQSVSVVCPMEEEEEAAVAEKEPKSYWSRHYIVDLLAVVVPAVPTVAWLCRSQRRQGQPIYNISSLLRGCCTVALHSIRRISCRSLSQPSPSPAGGGSQL

SEQ ID NO: 4389 - protein, 357 aa, unidentified
MIEQQKRKGPELPLVPVKRQRHELLLGAGSGPGAGQQQATPGALLQAGPPRCSSLQAPIMLLSGHEGEVYCCKFHPNGSTLASAGFDRLILLWNVYGDCDNYATLKGHSGAVMELHYNTDGSMLFSASTDKTVAVWDSETGERVKRLKGHTSFVNSCYPARRGPQLVCTGSDDGTVKLWDIRKKAAIQTFQNTYQVLAVTFNDTSDQIISGGIDNDIKVWDLRQNKLTYTMRGHADSVTGLSLSSEGSYLLSNAMDNTVRVWDVRPFAPKERCVKIFQGNVHNFEKNLLRCSWSPDGSKIAAGSADRFVYVWDTTSRRILYKLPGHAGSINEVAFHPDEPIIISASSDKRLYMGEIQ

SEQ ID NO: 4390 - protein, 86 aa, unidentified
MSLPLNPKPFLNGLTGKPVMVKLKWGMEYKGYLVSVDGYMNMQLANTEEYIDGALSGHLGEVLIRCNNVLYIRGVEEEEEDGEMRE

SEQ ID NO: 4391 - protein, 968 aa, unidentified
MLTEASLSIWGWGSLGIVLFLITFGPFVIFYLTFYILCFVGGGLVVTLLFGKTNSEKYLEQCEHSFLPPTSPGVPKCLEEMKREARTIKIDRRLTGANIIDEPLQQVIQFSLRDYVQYWYYTLSDDESFLLEIRQTLQNALIQFATRSKEIDWQPYFTTRIVDDFGTHLRVFRKAQQKITEKDDQVKGTAEDLVDTFFEVEVEMEKEVCRDLVCTSPKDEEGFLRDLCEVLLYLLLPPGDFQNKIMRYFVREILARGILLPLINQLSDPDYINQYVIWMIRDSNCNYEAFMNIIKLSDNIGELEAVRDKAAEELQYLRSLDTAGDDINTIKNQINSLLFVKKVCDSRIQRLQSGKEINTVKLAANFGKLCTVPLDSILVDNVALQFFMDYMQQTGGQAHLFFWMTVEGYRVTAQQQLEVLLSRQRDGKHQTNQTKGLLRAAAVGIYEQYLSEKASPRVTVDDYLVAKLADTLNHEDPTPEIFDDIQRKVYELMLRDERFYPSFRQNALYVRMLAELDMLKDPSFRGSDDGDGESFNGSPTGSINLSLDDLSNVSSDDSVQLHAYISDTVYADYDPYAVAGVCNDHGKTYALYAITVHRRNLNSEEMWKTYRRYSDFHDFHMRITEQFESLSSILKLPGKKTFNNMDRDFLEKRKKDLNAYLQLLLAPEMMKASPALAHYVYDFLENKAYSKGKGDFARKMDTFVNPLRNSMRNVSNAVKSLPDSLAEGMTKMSDNMGKMSERLGQDIKQSFFKVPPLIPKTDSDPEHRRVSAQLDDNVDDNIPLRVMLLLMDEVFDLKERNQWLRRNIKNLLQQLIRATYGDTINRKIVDHVDWMTSPEQVADSVKRFRDAFWPNGILAEAVPCRDKSIRMRTRVAGKTKLLAIMPDELKHIIGAETTRKGILRVFEMFQHNQLNRRMVYVFLEGFLETLFPQYKFRELFNKLHSRSKQMQKYKQKLQTTQAPSLQKR

SEQ ID NO: 4392 - protein, 946 aa, unidentified
MVPWVRTMGQKLKQRLRLDVGREICRQYPLFCFLLLCLSAASLLLNRYIHILMIFWSFVAGVVTFYCSLGPDSLLPNIFFTIKYKPKQLGLQELFPQGHSCAVCGKVKCKRHRPSLLLENYQPWLDLKISSKVDASLSEVLELVLENFVYPWYRDVTDDESFVDELRITLRFFASVLIRRIHKVDIPSIITKKLLKAAMKHIEVIVKARQKVKNTEFLQQAALEEYGPELHVALRSRRDELHYLRKLTELLFPYILPPKATDCRSLTLLIREILSGSVFLPSLDFLADPDTVNHLLIIFIDDSPPEKATEPASPLVPFLQKFAEPRNKKPSVLKLELKQIREQQDLLFRFMNFLKQEGAVHVLQFCLTVEEFNDRILRPELSNDEMLSLHEELQKIYKTYCLDESIDKIRFDPFIVEEIQRIAEGPYIDVVKLQTMRCLFEAYEHVLSLLENVFTPMFCHSDEYFRQLLRGAESPTRNSKLNRGSLSLDDFRNTQKRGESFGISRIGSKIKGVFKSTTMEGAMLPNYGVAEGEDDFIEEGIVVMEDDSPVEAVSTPNTPRNLAAWKISIPYVDFFEDPSSERKEKKERIPVFCIDVERNDRRAVGHEPEHWSVYRRYLEFYVLESKLTEFHGAFPDAQLPSKRIIGPKNYEFLKSKREEFQEYLQKLLQHPELSNSQLLADFLSPNGGETQFLDKILPDVNLGKIIKSVPGKLMKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGTRILFKNTLEMYTDYYLQCKLEQLFQEHRLVSLITLLRDAIFCENTEPRSLQDKQKGAKQTFEEMMNYIPDLLVKCIGEETKYESIRLLFDGLQQPVLNKQLTYVLLDIVIQELFPELNKVQKEVTSVTSWM

SEQ ID NO: 4393 - protein, 992 aa, unidentified
MKTETVPPFQETPAGSSCHLNNLLSSRKLMAVGVLLGWLLVIHLLVNVWLLCLLSALLVVLGGWLGSSLAGVASGRLHLERFIPLATCPPCPEAERQLEREINRTIQMIIRDFVLSWYRSVSQEPAFEEEMEAAMKGLVQELRRRMSVMDSHAVAQSVLTLCGCHLQSYIQAKEATAGKNGPVEPSHLWEAYCRATAPHPAVHSPSAEVTYTRGVVNLLLQGLVPKPHLETRTGRHVVVELITCNVILPLISRLSDPDWIHLVLVGIFSKARDPAPCPASAPEQPSVPTSLPLIAEVEQLPEGRASPVAAPVFLSYSEPEGSAGPSPEVEEGHEAVEGDLGGMCEERKVGNNSSHFLQPNVRGPLFLCEDSELESPLSELGKETIMLMTPGSFLSDRIQDALCALESSQALEPKDGEASEGAEAEEGPGTETETGLPVSTLNSCPEIHIDTADKEIEQGDVTASVTALLEGPEKTCPSRPSCLEKDLTNDVSSLDPTLPPVLLSSSPPGPLSSATFSFEPLSSPDGPVIIQNLRITGTITAREHSGTGFHPYTLYTVKYETALDGENSSGLQQLAYHTVNRRYREFLNLQTRLEEKPDLRKFIKNVKGPKKLFPDLPLGNMDSDRVEARKSLLESFLKQLCAIPEIANSEEVQEFLALNTDARIAFVKKPFMVSRIDKMVVSAIVDTLKTAFPRSEPQSPTEELSEAETESKPQTEGKKASKSRLRFSSSKISPALSVTEAQDKILYCLQEGNVESETLSMSAMESFIEKQTKLLEMQPTKAPEKDPEQPPKGRVDSCVSDAAVPAQDPSNSDPGTETELADTALDLLLLLLTEQWKWLCTENMQKFLRLIFGTLVQRWLEVQVANLTSPQRWVQYLLLLQESIWPGGVLPKFPRPVRTQEQKLAAEKQALQSLMGVLPDLVVEILGVNKCRLSWGLVLESLQQPLINRHLIYCLGDIILEFLDLSASVEESAATTSASDTPGNSKRMGVSS

SEQ ID NO: 4394 - protein, 550 aa, unidentified
MVGEEKMSLRNRLSKSRENPEEDEDQRNPAKESLETPSNGRIDIKQLIAKKIKLTAEAEELKPFFMKEVGSHFDDFVTNLIEKSASLDNGGCALTTFSVLEGEKNNHRAKDLRAPPEQGKIFIARRSLLDELLEVDHIRTIYHMFIALLILFILSTLVVDYIDEGRLVLEFSLLSYAFGKFPTVVWTWWIMFLSTFSVPYFLFQHWATGYSKSSHPLIRSLFHGFLFMIFQIGVLGFGPTYVVLAYTLPPASRFIIIFEQIRFVMKAHSFVRENVPRVLNSAKEKSSTVPIPTVNQYLYFLFAPTLIYRDSYPRNPTVRWGYVAMKFAQVFGCFFYVYYIFERLCAPLFRNIKQEPFSARVLVLCVFNSILPGVLILFLTFFAFLHCWLNAFAEMLRFGDRMFYKDWWNSTSYSNYYRTWNVVVHDWLYYYAYKDFLWFFSKRFKSAAMLAVFAVSAVVHEYALAVCLSFFYPVLFVLFMFFGMAFNFIVNDSRKKPIWNVLMWTSLFLGNGVLLCFYSQEWYARQHCPLKNPTFLDYVRPRSWTCRYVF

SEQ ID NO: 4395 - protein, 522 aa, unidentified
MEPGGARLRLQRTEGLGGERERQPCGDGNTETHRAPDLVQWTRHMEAVKAQLLEQAQGQLRELLDRAMREAIQSYPSQDKPLPPPPPGSLSRTQEPSLGKQKVFIIRKSLLDELMEVQHFRTIYHMFIAGLCVFIISTLAIDFIDEGRLLLEFDLLIFSFGQLPLALVTWVPMFLSTLLAPYQALRLWARGTWTQATGLGCALLAAHAVVLCALPVHVAVEHQLPPASRCVLVFEQVRFLMKSYSFLREAVPGTLRARRGEGIQAPSFSSYLYFLFCPTLIYRETYPRTPYVRWNYVAKNFAQALGCVLYACFILGRLCVPVFANMSREPFSTRALVLSILHATLPGIFMLLLIFFAFLHCWLNAFAEMLRFGDRMFYRDWWNSTSFSNYYRTWNVVVHDWLYSYVYQDGLRLLGARARGVAMLGVFLVSAVAHEYIFCFVLGFFYPVMLILFLVIGGMLNFMMHDQRTGPAWNVLMWTMLFLGQGIQVSLYCQEWYARRHCPLPQATFWGLVTPRSWSCHT

SEQ ID NO: 4396 - protein, 947 aa, unidentified
MSQPPIGGAAPATAAASPAAAATEARLHPEGSSRKQQRAQSPARPRDSSLRQTIAATRSPVGAGTKLNSVRQQQLQQQQQQGNKTGSRTGPPASIRGGGGGAEKATPLAPKGAAPGAVQPVAGAEAAPAATLAALGGRRPGPPEEPPRELESVPSKLGEPPPLGEGGGGGGEGGGAGGGSGEREGGAPQPPPPRGWRGKGVRAQQRGGSGGEGASPSPSSSSAGKTPGTGSRNSGSGVAGGGSGGGGSYWKEGCLQSELIQFHLKKERAAAAAAAAQMHAKNGGGSSSRSSPVSGPPAVCETLAVASASPMAAAAEGPQQSAEGSASGGGMQAAAPPSSQPHPQQLQEQEEMQEEMEKLREENETLKNEIDELRTEMDEMRDTFFEEDACQLQEMRHELERANKNCRILQYRLRKAERKRLRYAQTGEIDGELLRSLEQDLKVAKDVSVRLHHELENVEEKRTTTEDENEKLRQQLIEVEIAKQALQNELEKMKELSLKRRGSKDLPKSEKKAQQTPTEEDNEDLKCQLQFVKEEAALMRKKMAKIDKEKDRFEHELQKYRSFYGDLDSPLPKGEAGGPPSTREAELKLRLRLVEEEANILGRKIVELEVENRGLKAELDDLRGDDFNGSANPLMREQSESLSELRQHLQLVEDETELLRRNVADLEEQNKRITAELNKYKYKSGGHDSARHHDNAKTEALQEELKAARLQINELSGKVMQLQYENRVLMSNMQRYDLASHLGIRGSPRDSDAESDAGKKESDDDSRPPHRKREGPIGGESDSEEVRNIRCLTPTRSFYPAPGPWPKSFSDRQQMKDIRSEAERLGKTIDRLIADTSTIITEARIYVANGDLFGLMDEEDDGSRIREHELLYRINAQMKAFRKELQTFIDRLEVPKSADDRGAEEPISVSQMFQPIILLILILVLFSSLSYTTIFKLVFLFTLFFVL

SEQ ID NO: 4397 - protein, 1168 aa, unidentified
MGKVGAGGGSQARLSALLAGAGLLILCAPGVCGGGSCCPSPHPSSAPRSASTPRGFSHQGRPGRAPATPLPLVVRPLFSVAPGDRALSLERARGTGASMAVAARSGRRRRSGADQEKAERGEGASRSPRGVLRDGGQQEPGTRERDPDKATRFRMEELRLTSTTFALTGDSAHNQAMVHWSGHNSSVILILTKLYDYNLGSITESSLWRSTDYGTTYEKLNDKVGLKTILSYLYVCPTNKRKIMLLTDPEIESSLLISSDEGATYQKYRLNFYIQSLLFHPKQEDWILAYSQDQKLYSSAEFGRRWQLIQEGVVPNRFYWSVMGSNKEPDLVHLEARTVDGHSHYLTCRMQNCTEANRNQPFPGYIDPDSLIVQDHYVFVQLTSGGRPHYYVSYRRNAFAQMKLPKYALPKDMHVISTDENQVFAAVQEWNQNDTYNLYISDTRGVYFTLALENVQSSRGPEGNIMIDLYEVAGIKGMFLANKKIDNQVKTFITYNKGRDWRLLQAPDTDLRGDPVHCLLPYCSLHLHLKVSENPYTSGIIASKDTAPSIIVASGNIGSELSDTDISMFVSSDAGNTWRQIFEEEHSVLYLDQGGVLVAMKHTSLPIRHLWLSFDEGRSWSKYSFTSIPLFVDGVLGEPGEETLIMTVFGHFSHRSEWQLVKVDYKSIFDRRCAEEDYRPWQLHSQGEACIMGAKRIYKKRKSERKCMQGKYAGAMESEPCVCTEADFDCDYGYERHSNGQCLPAFWFNPSSLSKDCSLGQSYLNSTGYRKVVSNNCTDGVREQYTAKPQKCPGKAPRGLRIVTADGKLTAEQGHNVTLMVQLEEGDVQRTLIQVDFGDGIAVSYVNLSSMEDGIKHVYQNVGIFRVTVQVDNSLGSDSAVLYLHVTCPLEHVHLSLPFVTTKNKEVNATAVLWPSQVGTLTYVWWYGNNTEPLITLEGSISFRFTSEGMNTITVQVSAGNAILQDTKTIAVYEEFRSLRLSFSPNLDDYNPDIPEWRRDIGRVIKKSLVEATGVPGQHILVAVLPGLPTTAELFVLPYQDPAGENKRSTDDLEQISELLIHTLNQNSVHFELKPGVRVLVHAAHLTAAPLVDLTPTHSGSAMLMLLSVVFVGLAVFVIYKFKRRVALPSPPSPSTQPGDSSLRLQRARHATPPSTPKRGSAGAQYAI

SEQ ID NO: 4398 - protein, 1159 aa, unidentified
MAHRGPSRASKGPGPTARAPSPGAPPPPRSPRSRPLLLLLLLLGACGAAGRSPEPGRLGPHAQLTRVPRSPPAGRAEPGGGEDRQARGTEPGAPGPSPGPAPGPGEDGAPAAGYRRWERAAPLAGVASRAQVSLISTSFVLKGDATHNQAMVHWTGENSSVILILTKYYHADMGKVLESSLWRSSDFGTSYTKLTLQPGVTTVIDNFYICPTNKRKVILVSSSLSDRDQSLFLSADEGATFQKQPIPFFVETLIFHPKEEDKVLAYTKESKLYVSSDLGKKWTLLQERVTKDHVFWSVSGVDADPDLVHVEAQDLGGDFRYVTCAIHNCSEKMLTAPFAGPIDHGSLTVQDDYIFFKATSANQTKYYVSYRRNEFVLMKLPKYALPKDLQIISTDESQVFVAVQEWYQMDTYNLYQSDPRGVRYALVLQDVRSSRQAEESVLIDILEVRGVKGVFLANQKIDGKVMTLITYNKGRDWDYLRPPSMDMNGKPTNCKPPDCHLHLHLRWADNPYVSGTVHTKDTAPGLIMGAGNLGSQLVEYKEEMYITSDCGHTWRQVFEEEHHILYLDHGGVIVAIKDTSIPLKILKFSVDEGLTWSTHNFTSTSVFVDGLLSEPGDETLVMTVFGHISFRSDWELVKVDFRPSFSRQCGEEDYSSWELSNLQGDRCIMGQQRSFRKRKSTSWCIKGRSFTSALTSRVCECRDSDFLCDYGFERSSSSESSTNKCSANFWFNPLSPPDDCALGQTYTSSLGYRKVVSNVCEGGVDMQQSQVQLQCPLTPPRGLQVSIQGEAVAVRPGEDVLFVVRQEQGDVLTTKYQVDLGDGFKAMYVNLTLTGEPIRHRYESPGIYRVSVRAENTAGHDEAVLFVQVNSPLQALYLEVVPVIGLNQEVNLTAVLLPLNPNLTVFYWWIGHSLQPLLSLDNSVTTRFSDTGDVRVTVQAACGNSVLQDSRVLRVLDQFQVMPLQFSKELDAYNPNTPEWREDVGLVVTRLLSKETSVPQELLVTVVKPGLPTLADLYVLLPPPRPTRKRSLSSDKRLAAIQQVLNAQKISFLLRGGVRVLVALRDTGTGAEQLGGGGGYWAVVVLFVIGLFAAGAFILYKFKRKRPGRTVYAQMHNEKEQEMTSPVSHSEDVQGAVQGNHSGVVLSINSREMHSYLVS

SEQ ID NO: 4399 - protein, 1222 aa, unidentified
MEAARTERPAGRPGAPLVRTGLLLLSTWVLAGAEITWDATGGPGRPAAPASRPPALSPLSPRAVASQWPEELASARRAAVLGRRAGPELLPQQGGGRGGEMQVEAGGTSPAGERRGRGIPAPAKLGGARRSRRAQPPITQERGDAWATAPADGSRGSRPLAKGSREEVKAPRAGGSAAEDLRLPSTSFALTGDSAHNQAMVHWSGHNSSVILILTKLYDFNLGSVTESSLWRSTDYGTTYEKLNDKVGLKTVLSYLYVNPTNKRKIMLLSDPEMESSILISSDEGATYQKYRLTFYIQSLLFHPKQEDWVLAYSLDQKLYSSMDFGRRWQLMHERITPNRFYWSVAGLDKEADLVHMEVRTTDGYAHYLTCRIQECAETTRSGPFARSIDISSLVVQDEYIFIQVTTSGRASYYVSYRREAFAQIKLPKYSLPKDMHIISTDENQVFAAVQEWNQNDTYNLYISDTRGIYFTLAMENIKSSRGLMGNIIIELYEVAGIKGIFLANKKVDDQVKTYITYNKGRDWRLLQAPDVDLRGSPVHCLLPFCSLHLHLQLSENPYSSGRISSKETAPGLVVATGNIGPELSYTDIGVFISSDGGNTWRQIFDEEYNVWFLDWGGALVAMKHTPLPVRHLWVSFDEGHSWDKYGFTSVPLFVDGALVEAGMETHIMTVFGHFSLRSEWQLVKVDYKSIFSRHCTKEDYQTWHLLNQGEPCVMGERKIFKKRKPGAQCALGRDHSGSVVSEPCVCANWDFECDYGYERHGESQCVPAFWYNPASPSKDCSLGQSYLNSTGYRRIVSNNCTDGLREKYTAKAQMCPGKAPRGLHVVTTDGRLVAEQGHNATFIILMEEGDLQRTNIQLDFGDGIAVSYANFSPIEDGIKHVYKSAGIFQVTAYAENNLGSDTAVLFLHVVCPVEHVHLRVPFVAIRNKEVNISAVVWPSQLGTLTYFWWFGNSTKPLITLDSSISFTFLAEGTDTITVQVAAGNALIQDTKEIAVHEYFQSQLLSFSPNLDYHNPDIPEWRKDIGNVIKRALVKVTSVPEDQILIAVFPGLPTSAELFILPPKNLTERRKGNEGDLEQIVETLFNALNQNLVQFELKPGVQVIVYVTQLTLAPLVDSSAGHSSSAMLMLLSVVFVGLAVFLIYKFKRKIPWINIYAQVQHDKEQEMIGSVSQSENAPKITLSDFTEPEELLDKELDTRVIGGIATIANSESTKEIPNCTSV

SEQ ID NO: 4400 - protein, 2214 aa, unidentified
MATRSSRRESRLPFLFTLVALLPPGALCEVWTQRLHGGSAPLPQDRGFLVVQGDPRELRLWARGDARGASRADEKPLRRKRSAALQPEPIKVYGQVSLNDSHNQMVVHWAGEKSNVIVALARDSLALARPKSSDVYVSYDYGKSFKKISDKLNFGLGNRSEAVIAQFYHSPADNKRYIFADAYAQYLWITFDFCNTLQGFSIPFRAADLLLHSKASNLLLGFDRSHPNKQLWKSDDFGQTWIMIQEHVKSFSWGIDPYDKPNTIYIERHEPSGYSTVFRSTDFFQSRENQEVILEEVRDFQLRDKYMFATKVVHLLGSEQQSSVQLWVSFGRKPMRAAQFVTRHPINEYYIADASEDQVFVCVSHSNNRTNLYISEAEGLKFSLSLENVLYYSPGGAGSDTLVRYFANEPFADFHRVEGLQGVYIATLINGSMNEENMRSVITFDKGGTWEFLQAPAFTGYGEKINCELSQGCSLHLAQRLSQLLNLQLRRMPILSKESAPGLIIATGSVGKNLASKTNVYISSSAGARWREALPGPHYYTWGDHGGIITAIAQGMETNELKYSTNEGETWKTFIFSEKPVFVYGLLTEPGEKSTVFTIFGSNKENVHSWLILQVNATDALGVPCTENDYKLWSPSDERGNECLLGHKTVFKRRTPHATCFNGEDFDRPVVVSNCSCTREDYECDFGFKMSEDLSLEVCVPDPEFSGKSYSPPVPCPVGSTYRRTRGYRKISGDTCSGGDVEARLEGELVPCPLAEENEFILYAVRKSIYRYDLASGATEQLPLTGLRAAVALDFDYEHNCLYWSDLALDVIQRLCLNGSTGQEVIINSGLETVEALAFEPLSQLLYWVDAGFKKIEVANPDGDFRLTIVNSSVLDRPRALVLVPQEGVMFWTDWGDLKPGIYRSNMDGSAAYHLVSEDVKWPNGISVDDQWIYWTDAYLECIERITFSGQQRSVILDNLPHPYAIAVFKNEIYWDDWSQLSIFRASKYSGSQMEILANQLTGLMDMKIFYKGKNTGSNACVPRPCSLLCLPKANNSRSCRCPEDVSSSVLPSGDLMCDCPQGYQLKNNTCVKQENTCLRNQYRCSNGNCINSIWWCDFDNDCGDMSDERNCPTTICDLDTQFRCQESGTCIPLSYKCDLEDDCGDNSDESHCEMHQCRSDEYNCSSGMCIRSSWVCDGDNDCRDWSDEANCTAIYHTCEASNFQCRNGHCIPQRWACDGDTDCQDGSDEDPVNCEKKCNGFRCPNGTCIPSSKHCDGLRDCSDGSDEQHCEPLCTHFMDFVCKNRQQCLFHSMVCDGIIQCRDGSDEDAAFAGCSQDPEFHKVCDEFGFQCQNGVCISLIWKCDGMDDCGDYSDEANCENPTEAPNCSRYFQFRCENGHCIPNRWKCDRENDCGDWSDEKDCGDSHILPFSTPGPSTCLPNYYRCSSGTCVMDTWVCDGYRDCADGSDEEACPLLANVTAASTPTQLGRCDRFEFECHQPKTCIPNWKRCDGHQDCQDGRDEANCPTHSTLTCMSREFQCEDGEACIVLSERCDGFLDCSDESDEKACSDELTVYKVQNLQWTADFSGDVTLTWMRPKKMPSASCVYNVYYRVVGESIWKTLETHSNKTNTVLKVLKPDTTYQVKVQVQCLSKAHNTNDFVTLRTPEGLPDAPRNLQLSLPREAEGVIVGHWAPPIHTHGLIREYIVEYSRSGSKMWASQRAASNFTEIKNLLVNTLYTVRVAAVTSRGIGNWSDSKSITTIKGKVIPPPDIHIDSYGENYLSFTLTMESDIKVNGYVVNLFWAFDTHKQERRTLNFRGSILSHKVGNLTAHTSYEISAWAKTDLGDSPLAFEHVMTRGVRPPAPSLKAKAINQTAVECTWTGPRNVVYGIFYATSFLDLYRNPKSLTTSLHNKTVIVSKDEQYLFLVRVVVPYQGPSSDYVVVKMIPDSRLPPRHLHVVHTGKTSVVIKWESPYDSPDQDLLYAVAVKDLIRKTDRSYKVKSRNSTVEYTLNKLEPGGKYHIIVQLGNMSKDSSIKITTVSLSAPDALKIITENDHVLLFWKSLALKEKHFNESRGYEIHMFDSAMNITAYLGNTTDNFFKISNLKMGHNYTFTVQARCLFGNQICGEPAILLYDELGSGADASATQAARSTDVAAVVVPILFLILLSLGVGFAILYTKHRRLQSSFTAFANSHYSSRLGSAIFSSGDDLGEDDEDAPMITGFSDDVPMVIA

SEQ ID NO: 4401 - protein, 831 aa, unidentified
MERPWGAADGLSRWPHGLGLLLLLQLLPPSTLSQDRLDAPPPPAAPLPRWSGPIGVSWGLRAAAAGGAFPRGGRWRRSAPGEDEECGRVRDFVAKLANNTHQHVFDDLRGSVSLSWVGDSTGVILVLTTFHVPLVIMTFGQSKLYRSEDYGKNFKDITDLINNTFIRTEFGMAIGPENSGKVVLTAEVSGGSRGGRIFRSSDFAKNFVQTDLPFHPLTQMMYSPQNSDYLLALSTENGLWVSKNFGGKWEEIHKAVCLAKWGSDNTIFFTTYANGSCKADLGALELWRTSDLGKSFKTIGVKIYSFGLGGRFLFASVMADKDTTRRIHVSTDQGDTWSMAQLPSVGQEQFYSILAANDDMVFMHVDEPGDTGFGTIFTSDDRGIVYSKSLDRHLYTTTGGETDFTNVTSLRGVYITSVLSEDNSIQTMITFDQGGRWTHLRKPENSECDATAKNKNECSLHIHASYSISQKLNVPMAPLSEPNAVGIVIAHGSVGDAISVMVPDVYISDDGGYSWTKMLEGPHYYTILDSGGIIVAIEHSSRPINVIKFSTDEGQCWQTYTFTRDPIYFTGLASEPGARSMNISIWGFTESFLTSQWVSYTIDFKDILERNCEEKDYTIWLAHSTDPEDYEDGCILGYKEQFLRLRKSSVCQNGRDYVVTKQPSICLCSLEDFLCDFGYYRPENDSKCVEQPELKGHDLEFCLYGREEHLTTNGYRKIPGDKCQGGVNPVREVKDLKKKCTSNFLSPEKQNSKSNSVPIILAIVGLMLVTVVAGVLIVKKYVCGGRFLVHRYSVLQQHAEANGVDGVDALDTASHTNKSGYHDDSDEDLLE

SEQ ID NO: 4402 - protein, 294 aa, unidentified
MSPRGTGCSAGLLMTVGWLLLAGLQSARGTNVTAAVQDAGLAHEGEGEEETENNDSETAENYAPPETEDVSNRNVVKEVEFGMCTVTCGIGVREVILTNGCPGGESKCVVRVEECRGPTDCGWGKPISESLESVRLACIHTSPLNRFKYMWKLLRQDQQSIILVNDSAILEVRKESHPLAFECDTLDNNEIVATIKFTVYTSSELQMRRSSLPATDAALIFVLTIGVIICVFIIFLLIFIIINWAAVKAFWGAKASTPEVQSEQSSVRYKDSTSLDQLPTEMPGEDDALSEWNE

SEQ ID NO: 4403 - protein, 215 aa, unidentified [sequence omitted]

SEQ ID NO: 4404 - protein, 437 aa, unidentified
MRRSSRPGSASSSRKHTPNFFSENSSMSITSEDSKGLRSAEPGPGEPEGRRARGPSCGEPALSAGVPGGTTWAGSSQQKPAPRSHNWQTACGAATVRGGASEPTGSPVVSEEPLDLLPTLDLRQEMPPPRVFKSFLSLLFQGLSVLLSLAGDVLVSMYREVCSIRFLFTAVSLLSLFLSAFWLGLLYLVSPLENEPKEMLTLSEYHERVRSQGQQLQQLQAELDKLHKEVSTVRAANSERVAKLVFQRLNEDFVRKPDYALSSVGASIDLQKTSHDYADRNTAYFWNRFSFWNYARPPTVILEPHVFPGNCWAFEGDQGQVVIQLPGRVQLSDITLQHPPPSVEHTGGANSAPRDFAVFGLQVYDETEVSLGKFTFDVEKSEIQTFHLQNDPPAAFPKVKIQILSNWGHPRFTCLYRVRAHGVRTSEGAEGSAQGPH

SEQ ID NO: 4405 - protein, 1321 aa, unidentified
MELEDGVVYQEEPGGSGAVMSERVSGLAGSIYREFERLIGRYDEEVVKELMPLVVAVLENLDSVFAQDQEHQVELELLRDDNEQLITQYEREKALRKHAEEKFIEFEDSQEQEKKDLQTRVESLESQTRQLELKAKNYADQISRLEEREAELKKEYNALHQRHTEMIHNYMEHLERTKLHQLSGSDQLESTAHSRIRKERPISLGIFPLPAGDGLLTPDAQKGGETPGSEQWKFQELSQPRSHTSLKVSNSPEPQKAVEQEDELSDVSQGGSKATTPASTANSDVATIPTDTPLKEENEGFVKVTDAPNKSEISKHIEVQVAQETRNVSTGSAENEEKSEVQAIIESTPELDMDKDLSGYKGSSTPTKGIENKAFDRNTESLFEELSSAGSGLIGDVDEGADLLGMGREVENLILENTQLLETKNALNIVKNDLIAKVDELTCEKDVLQGELEAVKQAKLKLEEKNRELEEELRKARAEAEDARQKAKDDDDSDIPTAQRKRFTRVEMARVLMERNQYKERLMELQEAVRWTEMIRASRENPAMQEKKRSSIWQFFSRLFSSSSNTTKKPEPPVNLKYNAPTSHVTPSVKKRSSTLSQLPGDKSKAFDFLSEETEASLASRREQKREQYRQVKAHVQKEDGRVQAFGWSLPQKYKQVTNGQGENKMKNLPVPVYLRPLDEKDTSMKLWCAVGVNLSGGKTRDGGSVVGASVFYKDVAGLDTEGSKQRSASQSSLDKLDQELKEQQKELKNQEELSSLVWICTSTHSATKVLIIDAVQPGNILDSFTVCNSHVLCIASVPGARETDYPAGEDLSESGQVDKASLCGSMTSNSSAETDSLLGGITVVGCSAEGVTGAATSPSTNGASPVMDKPPEMEAENSEVDENVPTAEEATEATEGNAGSAEDTVDISQTGVYTEHVFTDPLGVQIPEDLSPVYQSSNDSDAYKDQISVLPNEQDLVREEAQKMSSLLPTMWLGAQNGCLYVHSSVAQWRKCLHSIKLKDSILSIVHVKGIVLVALADGTLAIFHRGVDGQWDLSNYHLLDLGRPHHSIRCMTVVHDKVWCGYRNKIYVVQPKAMKIEKSFDAHPRKESQVRQLAWVGDGVWVSIRLDSTLRLYHAHTYQHLQDVDIEPYVSKMLGTGKLGFSFVRITALMVSCNRLWVGTGNGVIISIPLTETNKTSGVPGNRPGSVIRVYGDENSDKVTPGTFIPYCSMAHAQLCFHGHRDAVKFFVAVPGQVISPQSSSSGTDLTGDKAGPSAQEPGSQTPLKSMLVISGGEGYIDFRMGDEGGESELLGEDLPLEPSVTKAERSHLIVWQVMYGNE

SEQ ID NO: 4406 - protein, 509 aa, unidentified
MGVLKFKHIFFRSFVKSSGVSQIVFTFLLIPCCLTLNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLSATMFIVSILFLIISSVASL

SEQ ID NO: 4407 - protein, 616 aa, unidentified
MNSPGGRGKKKGSGGASNPVPPRPPPPCLAPAPPAAGPAPPPESPHKRNLYYFSYPLFVGFALLRLVAFHLGLLFVWLCQRFSRALMAAKRSSGAAPAPASASAPAPVPGGEAERVRVFHKQAFEYISIALRIDEDEKAGQKEQAVEWYKKGIEELEKGIAVIVTGQGEQCERARRLQAKMMTNLVMAKDRLQLLEKMQPVLPFSKSQTDVYNDSTNLACRNGHLQSESGAVPKRKDPLTHTSNSLPRSKTVMKTGSAGLSGHHRAPSYSGLSMVSGVKQGSGPAPTTHKGTPKTNRTNKPSTPTTATRKKKDLKNFRNVDSNLANLIMNEIVDNGTAVKFDDIAGQDLAKQALQEIVILPSLRPELFTGLRAPARGLLLFGPPGNGKTMLAKAVAAESNATFFNISAASLTSKYVGEGEKLVRALFAVARELQPSIIFIDEVDSLLCERREGEHDASRRLKTEFLIEFDGVQSAGDDRVLVMGATNRPQELDEAVLRRFIKRVYVSLPNEETRLLLLKNLLCKQGSPLTQKELAQLARMTDGYSGSDLTALAKDAALGPIRELKPEQVKNMSASEMRNIRLSDFTESLKKIKRSVSPQTLEAYIRWNKDFGDTTV

SEQ ID NO: 4408 - protein, 192 aa, unidentified
MKKVKKKRSEARRHRDSTSQHASSNSTSQQPSPESTPQQPSPESTPQQPSPESTPQHSSLETTSRQPAFQALPAPEIRRSSCCLLSPDANVKAAPQSRKAGPLIRAGPHSCSCATCPCSSACWRRLGLCHSRIFDVLLPRDWQMAPGRGLPNLLTFYRKSSRKPSSHRNACPPSPRNCGCGSGGSRSCLLHH

SEQ ID NO: 4409 - protein, 1347 aa, unidentified
MENLPFPLKLLSASSLNAPSSTPWVLDIFLTLVFALGFFFLLLPYLSYFRCDDPPSPSPGKRKCPVGRRRRPRGRMKNHSLRAGRECPRGLQETSDLLSQLQSLLGPHLDKGDFGQLSGPDPPGEVGERAPDGASQSSHEPMEDAAPILSPLASPDPQAKHPQDLASTPSPGPMTTSVSSLSASQPPEPSLPLEHPSPEPPALFPHPPHTPDPLACSPPPPKGFTAPPLRDSTLITPSHCDSVALPLGTVPQSLSPHEDLVASVPAISGLGGSNSHVSASSRWQETARTSCAFNSSVQQDHLSRHPPETYQMEAGSLFLLSSDGQNAVGIQVTETAKVNIWEEKENVGSFTDRMTPEKHLNSLRNLAKSLDAEQDTTNPKPFWNMGENSKQLPGPQKLSDPRLWQESFWKNYSQLFWGLPSLHSESLVANAWVTDRSYTLQSPPFLFNEMSNVCPIQRETTMSPLLFQAQPPSHLGPECQPFISSTPQFRPTPMAQAEAQAHLQSSFPVLSPAFPSLIKNTGVACPASQNKVQALSLPETQHPEWPLLRRQLEGRLALPSRVQKSQDVFSVSTPNLPQESLTSILPENFPVSPELRRQLEQHIKKWIIQHWGNLGRIQESLDLMQLRDESPGTSQAKGKPSPWQSSMSTGESSKEAQKVKFQLERDPCPHLGQILGETPQNLSRDMKSFPRKVLGVTSEESERNLRKPLRSDSGSDLLRCTERTHIENILKAHMGRNLGQTNEGLIPVRVRRSWLAVNQALPVSNTHVKTSNLAAPKSGKACVNTAQVLSFLEPCTQQGLGAHIVRFWAKHRWGLPLRVLKPIQCFKLEKVSSLSLTQLAGPSSATCESGAGSEVEVDMFLRKPPMASLRKQVLTKASDHMPESLLASSPAWKQFQRAPRGIPSWNDHGPLKPPPAGQEGRWPSKPLTYSLTGSTQQSRSLGAQSSKAGETREAVPQCRVPLETCMLANLQATSEDMHGFEAPGTSKSSLHPRVSVSQDPRKLCLMEEVVNEFEPGMATKSETQPQVCAAVVLLPDGQASVVPHASENLVSQVPQGHLQSMPAGNMRASQELHDLMAARRSKLVHEEPRNPNCQGSCKNQRPMFPPIHKSEKSRKPNLEKHEERLEGLRTPQLTPVRKTEDTHQDEGVQLLPSKKQPPSVSHFGGNIKQFFQWIFSKKKSKPAPVTAESQKTVKNRSCVYSSSAEAQGLMTAVGQMLDEKMSLCHARHASKVNQHKQKFQAPVCGFPCNHRHLFYSEHGRILSYAASSQQATLKSQGCPNRDRQIRNQQPLKSVRCNNEQWGLRHPQILHPKKAVSPVSPLQHWPKTSGASSHHHHCPRHCLLWEGI

SEQ ID NO: 4410 - protein, 1343 aa, unidentified
MENLPFPLKLLSASSLNAPSSTPWVLDIFLTLVFALGFFFLLLPYLSYFHCDDPPSPSPGKRKCPVGRRRRPRGRMKNHSLRAGRECPRGLEETSDLLSQLQSLLGPHLDKGDFGQLSGPDPPGEVGERAPDGASQSSHEPMEDAAPILSPLASPDPQAKHPQDLASTPSPGPMTTSVSSLSASQPPEPSLPLEHPSPEPPALFPHPPHTPDPLACSPPPPKGFTAPPLRDSTLITPSHCDSVALPLGTVPQSLSPHEDLVASVPAISGLGGSNSHVSASSRWQETARTSCAFNSSVQQDPLSRHPPETCQMEAGSLFLLSSDGQNVVGIQVTETAKVNIWEEKENVGSFTNQMTPEKHLNSLGNLAKSLDAEQDTTNPKPFWNMGENSKQLPGPQKCSDPRLLQESFWKNYSQLFWGLPSLHSESLVANAWVTDRSYTLQSPPFLFNEMSNVCPIQRETTMSPLLFQAQPLSHRQPFISSTPQFLPTPMAQAEAQAHLQSSFPVLSPAFPSLIKNTGVACPASQNKVQALSLPETQHPEWPLLRKQLEGRLALPSRVQKSQDVFSVSTPNLPQESLTSILPENFPVSPELRRQLEQHIKKWIIQHWGNLGRIQESLDLMQLRDESPGTSQAKGKPSPWQSSTSTGESSKEAQKVKFQLERDLCPHLGQILGETPQNLSRDMKSFPRKVLGVTSEESERNLRKPLRSDSGSDLLRCTERTHIENILKAHMGRNLGQTNEGLIPVRVRRSWLAVNQALPVSNTHVKTSNLAAPKSGKACVNTAQVLSFLEPCTQQGLGAHIVRFWAKHRWGLPLRVLKPIQCFKLEKVSSLSLTQLAGPSSATCESGAGSEVEVDMFLRKPPMASLRKQVLTKASDHMPESLLASSPAWKQFQRAPRGIPSWNDHGPLKPPPAGQEGRWPSKPLTYSLTGSTQQSRSLGAQSSKAGETREAVPQCRVPLETCMLANLQATSEDVHGFEAPGTSKSSLHPRVSVSQDPRKLCLMEEVVSEFEPGMATKSETQPQVCAAVVLLPDGQASVVPHASENLVSQVPQGHLQSMPTGNMRASQELHDLMAARRSKLVQEEPRNPNCQGSCKSQRPMFPPIHKSEKSRKPNLEKHEERLEGLRTPQLTPVRKTEDTHQDEGVQLLPSKKQPPSVSHFGENIKQFFQWIFSKKKSKPAPVTAESQKTVKNRSCVYSSSAEAQGLMTAVGQMLDKKMSLCHAHHASKVNQHKQKFQAPVCGFPCNHRHLFYSEHGRILSYAASSQQATLKSQGCPNRDRQIRNQQPLKSVRCNNEQWGLRHPQILHPKKAVSPVSPPQHWPKTSGASSHHHHCPRHCLLWEGI

SEQ ID NO: 4411 - protein, 1576 aa, unidentified
MENILCFLNSYTETGLSPDSHWLDIDPNFICLSGLGLFILYLFYVVLTLYSSPTEKNNDIQKHQGRAKRRRKGGTFKGFPDWKSFQREEEEERKLLSLLKSFGPPVSCSPRGQHHDTNHFRRLLCPDPVCRVCKRATADIQQLLSWESLKDAAPSVSPLASSASATESSFTLASTPSATPPEDLILSPRPKASPPPPLILSPDLITTLADLFSPSPLRDPLPPQPVSPLDSKFPIDHSPPQQLPFPLLPPHHIERVESSLQPEASLSLNTIFSFGSTLCQDISQAMNPIDSCARHHGPPIPSALPPEDCTVTQSKSSLTILKTFPEMLSLGGSGGSSTSAPTIKGIDHSHLASSEFTWWQPHAKDSFSSNFVPSDFMEELLTLHSSEAFLGGHSVANLIEPVNISFLSHDILALLERQVKKRGDFLMWKENGKKPGSFPKQLRPNYQLNSSRNMLTSIAVKHDLAESFPFWASKGKLEWQHIHQQPPHSKCFEDHLEQKYVQLFWGLPSLHSESLHPTVLVQRGHSSMFVFFNGITNTSISHESPVLPPPQPLSLPSTQPLPLPQTLPQGQSPHLTQVKSLAQPQSPFRALLPSPLFLIRICGVCFHRPQNEARSLLPSEINHLEWNVLQKVQESLWGLPSVVQKSQEDFCPPAPNPELVRKSFKVHVPISIIPGDFPLSSEVRKKLEQHIRRRLIQRRWGLPRRIHESLSLLRPQSKISELSVSERIHGPLNISLVEGQRCNVLKKSASSFPRSFHERSSNMLSMENVGNYQGYSQETVPKDHLLHGPETSSDKDLRSNSERDLETHMMHLSGNDSGVRLGQKQLENALTVRLSKKFEEINEGRMPGTVHSSWHSVKQTMSLPEKSHSQIKHRNLVTLVSEDHCVDTSQEISFLSSNKQKMLEAHIKTFRMRMLWGLPLKVLESIEIFKSKADLSTSFSHFDLPSSATFISQGDSKDGVSKSRSRSTFQGEKLGTTSSVPILDRPHPVSSPVVQEGQGTLRRQFSDTDHDLIETDSKDGASTSLRRGTTDFQSEKLDSTSSFPILGHSYLVTSPVNQEKQGTLRREFSDTDNDLTESVRTTEDGRQTFLPPPHSIVDEVSQKQTVLASRCSAELPIMQAGAGCESWDKRKSSFHNVDRLQGSRKTFPVTNALQSQTRNNLTTSKSGSCSLTNVKASTSNETEIFPPRISVPQDPKSSYLKNQMLSQLKLVQRKHSQPQSHFTDMSFALDNLSSKDLLTNSQGISSGDMGTSQVVHVHLEDSGIRVAQKQEPRVPTCVLQKCQVTNFPPAVNRVSPVRPKGGELDGGDAGLGTSQRRRKSLPVHNKTSGEVLGSKSSPTLKTQPPPENLFRKWMKTSLQWFNKPSISYEEQESSWEKGSSLSSCVQNIGRVIRAAFTGTTEAQKIRKDTREFLEEKLGHRHGIDITCPQEPLSFPVGLGKAQHNPEVHVRAEPVQGCPCNYRAPSCKVTRTKSCSQQAIFVGQNYPTRIRQIIDKDRQPQKVEAFKGKILCQSHPQSMPHRKPVPHPNPTCRRQVSLVCPAVPTSAKSPVFSDVPFLTGQKMLPKHLQGGKFPPTK

SEQ ID NO: 4412 - protein, 1445 aa, unidentified
MGNLVIPLGKGRAGRVESGQRIPPPAPRPSVECTGDDIALQMEKMLFPLKSPSATWLSPSSTPWMMDFILTSVCGLVLLFLLLLYVHSDPPSPPPGRKRSSREPQRERSGRSRSRKISALKACRILLRELEETRDLNYLLESHLRKLAGEGSSHLPLGGDPLGDVCKPVPAKAHQPHGKCMQDPSPASLSPPAPPAPLASTLSPGPMTFSEPFGPHSTLSASGPPEPLLPLKCPATQPHVVFPPSPQPHGPLASSPPPPDSSLAGLQCGSTTCPVPQSSPLHNQVLPPPTRVISGLGCSSDPIWDLYCWREAATTWGLSTYSHGKSQPRHLPDHTSEASFWGDPTPKHMEVGGCTFIHPDVQKLLETLIAKRALMKMWQEKERKRADHPHMTSLGKEWDITTLNPFWNVSTQPQQLPRPQQVSDATTVGNHLQQKRSQLFWDLPSLNSESLATTVWVSRNPSSQNAHSVPLDKASTSLPGEPEVEASSQLSQAPPQPHHMAQPQHFTPAWPQSQPPPLAEIQTQAHLSPPVPSLGCSSPPQIRGCGASYPTSQERTQSVIPTGKEYLEWPLKKRPKWKRVLPSLLKKSQAVLSQPTAHLPQERPASWSPKSAPILPGVVTSPELPEHWWQGRNAIHQEQSCGPPSRLQASGDLLQPDGEFPGRPQSQAEDTQQALLPSQPSDFAGKGRKDVQKTGFRSSGRFSDKGCLGSKLGPDPSRDQGSGRTSVKALDEDKEAEGDLRRSWKYQSVSSTPRDPDKEHLENKLQIHLARKVGEIKEGWIPMPVRRSWLMAKCAVPKSDTHRKPGKLASWRGGKAHVNTSQELSFLHPCTQQILEVHLVRFCVRHSWGTDLQSLEPINVWSGEAQAPPFPQSTFTPWASWVSRVESVPKVPIFLGKRPQNGPGDNRTTSKSVPTVSGPLAAPPPEQEGVQRPPRGSQSADTHGRSEAFPTGHKGRGCSQPPTCSLVGRTWQSRTVLESGKPKPRLEGSMGSEMAGNEAWLESESMSPGDPCSSRALQVLSIGSQWARAEDALQALKVGEKPPTWEVTLGASVRASSGSVQEDLRSTGALGTTGNPSASSVCVAQDPEQLHLKAQVVSEIALIVQVDSEEQLPGRAPGILLQDGATGLCLPGRHMDMLTAADRLPTQAPLSTSQSVSGKNMTASQGPCALLWKGGDSPGQQEPGSPKAKAPQKSQKTLGCADKGEAHRRPRTGEQGHRSKGPRTSEASGRSHPAQAREIGDKQERKYNQLQLEKGQTPPESHFQRKISHHPQGLHPRKGGTRWEDVLQKGKPGADAFQSWGSGPPRQFMDCMADKAWTISRVVGQILVDKLGLQWGRGPSEVNRHKGDFRAQENVPSCCHRGHCHQERSREMRALACSPKATPKGHHCPVKNRGIRDRDSSWAPPPREPVSPAGPHHHRPRMASTSGGPHPQLQELMSAQRCLAS

SEQ ID NO: 4413 - protein, 254 aa, unidentified
MPIKPVGWICGQVLKNFSGRIEGIQKAIMDLVDEFKDEFPTILRLSQSNQKREPAQKTSKIRMAIALAKINRATLIRGLNSISRSSKSVAKLLHPQLACRLLELRDISGRLLREVNAPRQPLYNIQVRKGSLFEIISFPAKTALTSIIYASYAALIYLAVCVNAVLKKVKNIFQEEESIRQNREESENCRKAFSEPVLSEPMFAEGEIKAKPYRSLPEKPDISDYPKLLANKQSNNIQVLHSVFDQSAEMNEQI

SEQ ID NO: 4414 - protein, 169 aa, unidentified
MARGGDTGCTGPSETSASGAAAIALPGLEGPATDAQCQTLPLTVLKSRSPSPRSLPPALSCPPPQPAMLEHLSSLPTQMDYKGQKLAEQMFQGIILFSAIVGFIYGYVAEQFGWTVYIVMAGFAFSCLLTLPPWPIYRRHPLKWLPVQESSTDDKKPGERKIKRHAKNN

SEQ ID NO: 4415 - protein, 226 aa, unidentified
MAAAAVQGGRSGGSGGCSGAGGASNCGTGSGRSGLLDKWKIDDKPVKIDKWDGSAVKNSLDDSAKKVLLEKYKYVENFGLIDGRLTICTISCFFAIVALIWDYMHPFPESKPVLALCVISYFVMMGILTIYTSYKEKSIFLVAHRKDPTGMDPDDIWQLSSSLKRFDDKYTLKLTFISGRTKQQREAEFTKSIAKFFDHSGTLVMDAYEPEISRLHDSLAIERKIK

SEQ ID NO: 4416 - protein, 309 aa, unidentified
MAMVERPRPEWASYHNCNSNSCQDLGNSVLLLLGLIICINISINIVTLLWSRFRGVLYQVFHDTICEKEAPKSSLLRKQTQPPKKQSSPAVHLRCTMDPVMMTVSPPPAHRHRRRGSPTRCAHCPVAWAPDTDDEKPHQYPAICSYHWDVPEDWEGFQHTQGTWVPWSQDAPESPPQTIRFQPTVEERPLKTGIWSELGLRAYVYPVNPPPPSPEAPSHKNGGEGAVPEAEAAQYQPVPAPTLGPAVIPEFSRHRSSGRIVYDARDMRRRLRELTREVEALSGCYPLASGSSTAEETSKNWVYRSLTGR

SEQ ID NO: 4417 - protein, 2443 aa, unidentified
MAAEEGVASAASAGGSWGTAAMGRVLPMLLVPVPAEAMGQLGSRAQLRTQPEALGSLTAAGSLQVLSLTPGSRGGGRCCLEGPFWHFLWEDSRNSSTPTEKPKLLALGENYELLIYEFNLKDGRCDATILYSCSREALQKLIDDQDISISLLSLRILSFHNNTSLLFINKCVILHIIFPERDAAIRVLNCFTLPLPAQAVDMIIDTQLCRGILFVLSSLGWIYIFDVVDGTYVAHVDLALHKEDMCNEQQQEPAKISSFTSLKVSQDLDVAVIVSSSNSAVALNLNLYFRQHPGHLLCERILEDLPIQGPKGVDEDDPVNSAYNMKLAKFSFQIDRSWKAQLSSLNETIKNSKLEVSCCAPWFQDILHLESPESGNHSTSVQSWAFIPQDIMHGQYNVLQKDHAKTSDPGRSWKIMHISEQEEPIELKCVSVTGFTALFTWEVERMGYTITLWDLETQGMQCFSLGTKCIPVDSSGDQQLCFVLTENGLSLILFGLTQEEFLNRLMIHGSASTVDTLCHLNGWGRCSIPIHALEAGIENRQLDTVNFFLKSKENLFNPSSKSSVSDQFDHLSSHLYLRNVEELIPALDLLCSAIRESYSEPQSKHFSEQLLNLTLSFLNNQIKELFIHTEELDEHLQKGVNILTSYINELRTFMIKFPWKLTDAIDEYDVHENVPKVKESNIWKKLSFEEVIASAILNNKIPEAQTFFRIDSHSAQKLEELIGIGLNLVFDNLKKNNIKEASELLKNMGFDVKGQLLKICFYTTNKNIRDFLVEILKEKNYFSEKEKRTIDFVHQVEKLYLGHFQENMQIQSFPRYWIKEQDFFKHKSVLDSFLKYDCKDEFNKQDHRIVLNWALWWDQLTQESILLPRISPEEYKSYSPEALWRYLTARHDWLNIILWIGEFQTQHSYASLQQNKWPLLTVDVINQNTSCNNYMRNEILDKLARNGVFLASELEDFECFLLRLSRIGGVIQDTLPVQNYKTKEGWDFHSQFILYCLEHSLQHLLYVYLDCYKLSPENCPFLEKKELHEAHPWFEFLVQCRQVASNLTDPKLIFQASLANAQILIPTNQASVSSMLLEGHTLLALATTMYSPGGVSQVVQNEENENCLKKVDPQLLKMALTPYPKLKTALFPQCTPPSVLPSDITIYHLIQSLSPFDPSRLFGWQSANTLAIGDAWSHLPHFSSPDLVNKYAIVERLNFAYYLHNGRPSFAFGTFLVQELIKSKTPKQLIQQVGNEAYVIGLSSFHIPSIGAACVCFLELLGLDSLKLRVDMKVANIILSYKCRNEDAQYSFIRESVAEKLSKLADGEKTTTEELLVLLEEGTWNSIQQQEIKRLSSESSSQWALVVQFCRLHNMKLSISYLRECAKANDWLQFIIHSQLHNYHPAEVKSLIQYFSPVIQDHLRLAFENLPSVPTSKMDSDQVCNKCPQELQGSKQEMTDLFEILLQCSEEPDSWHWLLVEAVKQQAPILSVLASCLQGASAISCLCVWIITSVEDNVATEAMGHIQDSTEDHTWNLEDLSVIWRTLLTRQKSKTLIRGFQLFFKDSPLLLVMEMYELCMFFRNYKEAEAKLLEFQKSLETLNTAATKVHPVIPAMWLEDQVCFLLKLMLQQCKTQYELGKLLQLFVEREHLFSDGPDVKKLCILCQILKDTSIAINHTIITSYSIENLQHECRSILERLQTDGQFALARRVAELAELPVDNLVIKEITQEMQTLKHIEQWSLKQARIDFWKKCHENFKKNSISSKAASSFFSTQAHVACEHPTGWSSMEERHLLLTLAGHWLAQEDVVPLDKLEELEKQIWLCRITQHTLGRNQEETEPRFSRQISTSGELSFDSLASEFSFSKLAALNTSKYLELNSLPSKETCENRLDWKEQESLNFLIGRLLDDGCVHEASRVCRYFHFYNPDVALVLHCRALASGEASMEDLHPEIHALLQSAELLEEEAPDIPLRRVHSTSSLDSQKFVTVPSSNEVVTNLEVLTSKCLHGKNYCRQVLCLYDLAKELGCSYTDVAAQDGEAMLRKILASQQPDRCKRAQAFISTQGLKPDTVAELVAEEVTRELLTSSQGTGHKQMFNPTEESQTFLQLTTLCQDRTLVGMKLLDKISSVPHGELSCTTELLILAHHCFTLTCHMEGIIRVLQAAHMLTDNHLAPSEEYGLVVRLLTGIGRYNEMTYIFDLLHKKHYFEVLMRKKLDPSGTLKTALLDYIKRCRPGDSEKHNMIALCFSMCREIGENHEAAARIQLKLIESQPWEDSLKDGHQLKQLLLKALTLMLDAAESYAKDSCVRQAQHCQRLTKLITLQIHFLNTGQNTMLINLGRHKLMDCILALPRFYQASIVAEAYDFVPDWAEILYQQVILKGDFNYLEEFKQQRLLKSSIFEEISKKYKQHQPTDMVMENLKKLLTYCEDVYLYYKLAYEHKFYEIVNVLLKDPQTGCCLKDMLAG

SEQ ID NO: 4418 - protein, 795 aa, unidentified
MAVLLLLLRALRRGPGPGPRPLWGPGPAWSPGFPARPGRGRPYMASRPPGDLAEAGGRALQSLQLRLLTPTFEGINGLLLKQHLVQNPVRLWQLLGGTFYFNTSRLKQKNKEKDKSKGKAPEEDEEERRRRERDDQMYRERLRTLLVIAVVMSLLNALSTSGGSISWNDFVHEMLAKGEVQRVQVVPESDVVEVYLHPGAVVFGRPRLALMYRMQVANIDKFEEKLRAAEDELNIEAKDRIPVSYKRTGFFGNALYSVGMTAVGLAILWYVFRLAGMTGREGGFSAFNQLKMARFTIVDGKMGKGVSFKDVAGMHEAKLEVREFVDYLKSPERFLQLGAKVPKGALLLGPPGCGKTLLAKAVATEAQVPFLAMAGPEFVEVIGGLGAARVRSLFKEARARAPCIVYIDEIDAVGKKRSTTMSGFSNTEEEQTLNQLLVEMDGMGTTDHVIVLASTNRADILDGALMRPGRLDRHVFIDLPTLQERREIFEQHLKSLKLTQSSTFYSQRLAELTPGFSGADIANICNEAALHAAREGHTSVHTLNFEYAVERVLAGTAKKSKILSKEEQKVVAFHESGHALVGWMLEHTEAVMKVSITPRTNAALGFAQMLPRDQHLFTKEQLFERMCMALGGRASEALSFNEVTSGAQDDLRKVTRIAYSMVKQFGMAPGIGPISFPEAQEGLMGIGRRPFSQGLQQMMDHEARLLVAKAYRHTEKVLQDNLDKLQALANALLEKEVINYEDIEALIGPPPHGPKKMIAPQRWIDAQREKQDLGEEETEETQQPPLGGEEPTWPK

SEQ ID NO: 4419 - protein, 270 aa, unidentified
MLQACKMEGFPLVPPPSEDLVPYDTDLYQRQTHEYYPYLSSDGESHSDHYWDFHPHHVHSEFESFAENNFTELQSVQPPQLQQLYRHMELEQMHVLDTPMVPPHPSLGHQVSYLPRMCLQYPSLSPAQPSSDEEEGERQSPPLEVSDGEADGLEPGPGLLPGETGSKKKIRLYQFLLDLLRSGDMKDSIWWVDKDKGTFQFSSKHKEALAHRWGIQKGNRKKMTYQKMARALRNYGKTGEVKKVKKKLTYQFSGEVLGRGGLAERRHPPH

SEQ ID NO: 4420 - protein, 258 aa, unidentified
MKTPFGKAAAGQRSRTGAGHGSVSVTMIKRKAAHKKHRSRPTSQPRGNIVGCRIQHGWKDGDEPLTQWKGTVLDQVPVNPSLYLIKYDGFDCVYGLELHRDERVSSLEVLPNRVASSRISDTHLAEIMVGKAVEHIFETEEGSKNEWRGMVLAQAPVMNTWFYITYEKDPVLYMYQLLDDYKDGDLRILQDSNDSPLAEREPGEVIDSLVGKQVEYAKDDGSKRTGMVIHQVEAKPSVYFIKFDDDFHIYVYDLVKTS

SEQ ID NO: 4421 - protein, 529 aa, unidentified
MAPARTMARARLAPAGIPAVALWLLCTLGLQGTQAGPPPAPPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRGVQGGPLRGSSGAQATFPQGPSMERRHPVCSGTCQPTQFRCSNGCCIDSFLECDDTPNCPDASDEAACEKYTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLVYNHTTRPL

SEQ ID NO: 4422 - protein, 252 aa, unidentified
MAQLCGLRRSRAFLALLGSLLLSGVLAADRERSIHDFCLVSKVVGRCRASMPRWWYNVTDGSCQLFVYGGCDGNSNNYLTKEECLKKCATVTENATGDLATSRNAADSSVPSAPRRQDSEDHSSDMFNYEEYCTANAVTGPCRASFPRWYFDVERNSCNNFIYGGCRGNKNSYRSEEACMLRCFRQQENPPLPLGSKVVVLAGLFVMVLILFLGASMVYLIRVARRNQERALRTVWSSGDDKEQLVKNTYVL

SEQ ID NO: 4423 - protein, 400 aa, unidentified
MATLLLLLGVLVVSPDALGSTTAVQTPTSGEPLVSTSEPLSSKMYTTSITSDPKADSTGDQTSALPPSTSINEGSPLWTSIGASTGSPLPEPTTYQEVSIKMSSVPQETPHATSHPAVPITANSLGSHTVTGGTITTNSPETSSRTSGAPVTTAASSLETSRGTSGPPLTMATVSLETSKGTSGPPVTMATDSLETSTGTTGPPVTMTTGSLEPSSGASGPQVSSVKLSTMMSPTTSTNASTVPFRNPDENSRGMLPVAVLVALLAVIVLVALLLLWRRRQKRRTGALVLSRGGKRNGVVDAWAGPAQVPEEGAVTVTVGGSGGDKGSGFPDGEGSSRRPTLTTFFGRRKSRQGSLAMEELKSGSGPSLKGEEEPLVASEDGAVDAPAPDEPEGGDGAAP

SEQ ID NO: 4424 - protein, 528 aa, unidentified
MAGSDTAPFLSQADDPDDGPVPGTPGLPGSTGNPKSEEPEVPDQEGLQRITGLSPGRSALIVAVLCYINLLNYMDRFTVAGVLPDIEQFFNIGDSSSGLIQTVFISSYMVLAPVFGYLGDRYNRKYLMCGGIAFWSLVTLGSSFIPGEHFWLLLLTRGLVGVGEASYSTIAPTLIADLFVADQRSRMLSIFYFAIPVGSGLGYIAGSKVKDMAGDWHWALRVTPGLGVVAVLLLFLVVREPPRGAVERHSDLPPLNPTSWWADLRALARNPSFVLSSLGFTAVAFVTGSLALWAPAFLLRSRVVLGETPPCLPGDSCSSSDSLIFGLITCLTGVLGVGLGVEISRRLRHSNPRADPLVCATGLLGSAPFLFLSLACARGSIVATYIFIFIGETLLSMNWAIVADILLYVVIPTRRSTAEAFQIVLSHLLGDAGSPYLIGLISDRLRRNWPPSFLSEFRALQFSLMLCAFVGALGGAAFLGTAIFIEADRRRAQLHVQGLLHEAGSTDDRIVVPQRGRSTRVPVASVLI

SEQ ID NO: 4425 - protein, 549 aa, unidentified
MMCLECASAAAGGAEEEEADAERRRRRRGAQRGAGGSGCCGARGAGGAGVSAAGDEVQTLSGSVRRAPTGPPGTPGTPGCAATAKGPGAQQPKPASLGRGRGAAAAILSLGNVLNYLDRYTVAGVLLDIQQHFGVKDRGAGLLQSVFICSFMVAAPIFGYLGDRFNRKVILSCGIFFWSAVTFSSSFIPQQYFWLLVLSRGLVGIGEASYSTIAPTIIGDLFTKNTRTLMLSVFYFAIPLGSGLGYITGSSVKQAAGDWHWALRVSPVLGMITGTLILILVPATKRGHADQLGDQLKARTSWLRDMKALIRNRSYVFSSLATSAVSFATGALGMWIPLYLHRAQVVQKTAETCNSPPCGAKDSLIFGAITCFTGFLGVVTGAGATRWCRLKTQRADPLVCAVGMLGSAIFICLIFVAAKSSIVGAYICIFVGETLLFSNWAITADILMYVVIPTRRATAVALQSFTSHLLGDAGSPYLIGFISDLIRQSTKDSPLWEFLSLGYALMLCPFVVVLGGMFFLATALFFVSDRARAEQQVNQLAMPPASVKV

SEQ ID NO: 4426 - protein, 512 aa, unidentified
MAGGMSAECPEPGPGGLQGQSPGPGRQCPPPITPTSWSLPPWRAYVAAAVLCYINLLNYMNWFIIAGVLLDIQEVFQISDNHAGLLQTVFVSCLLLSAPVFGYLGDRHSRKATMSFGILLWSGAGLSSSFISPRYSWLFFLSRGIVGTGSASYSTIAPTVLGDLFVRDQRTRVLAVFYIFIPVGSGLGYVLGSAVTMLTGNWRWALRVMPCLEAVALILLILLVPDPPRGAAETQGEGAVGGFRSSWCEDVRYLGKNWSFVWSTLGVTAMAFVTGALGFWAPKFLLEARVVHGLQPPCFQEPCSNPDSLIFGALTIMTGVIGVILGAEAARRYKKVIPGAEPLICASSLLATAPCLYLALVLAPTTLLASYVFLGLGELLLSCNWAVVADILLSVVVPRCRGTAEALQITVGHILGDAGSPYLTGLISSVLRARRPDSYLQRFRSLQQSFLCCAFVIALGGGCFLLTALYLERDETRAWQPVTGTPDSNDVDSNDLERQGLLSGAGASTEEP

SEQ ID NO: 4427 - protein, 520 aa, unidentified
MGPQRRLSPAGAALLWGFLLQLTAAQEAILHASGNGTTKDYCMLYNPYWTALPSTLENATSISLMNLTSTPLCNLSDIPPVGIKSKAVVVPWGSCHFLEKARIAQKGGAEAMLVVNNSVLFPPSGNRSEFPDVKILIAFISYKDFRDMNQTLGDNITVKMYSPSWPNFDYTMVVIFVIAVFTVALGGYWSGLVELENLKAVTTEDREMRKKKEEYLTFSPLTVVIFVVICCVMMVLLYFFYKWLVYVMIAIFCIASAMSLYNCLAALIHKIPYGQCTIACRGKNMEVRLIFLSGLCIAVAVVWAVFRNEDRWAWILQDILGIAFCLNLIKTLKLPNFKSCVILLGLLLLYDVFFVFITPFITKNGESIMVELAAGPFGNNEKLPVVIRVPKLIYFSVMSVCLMPVSILGFGDIIVPGLLIAYCRRFDVQTGSSYIYYVSSTVAYAIGMILTFVVLVLMKKGQPALLYLVPCTLITASVVAWRRKEMKKFWKGNSYQMMDHLDCATNEENPVISGEQIVQQ

SEQ ID NO: 4428 - protein, 684 aa, unidentified
MACLGFLLPVGFLLLISTVAGGKYGVAHVVSENWSKDYCILFSSDYITLPRDLHHAPLLPLYDGTKAPWCPGEDSPHQAQLRSPSQRPLRQTTAMVMRGNCSFHTKGWLAQGQGAHGLLIVSRVSDQQCSDTTLAPQDPRQPLADLTIPVAMLHYADMLDILSHTRGEAVVRVAMYAPPEPIIDYNMLVIFILAVGTVAAGGYWAGLTEANRLQRRRARRGGGSGGHHQLQEAAAAEGAQKEDNEDIPVDFTPAMTGVVVTLSCSLMLLLYFFYDHFVYVTIGIFGLGAGIGLYSCLSPLVCRLSLRQYQRPPHSLWASLPLPLLLLASLCATVIIFWVAYRNEDRWAWLLQDTLGISYCLFVLHRVRLPTLKNCSSFLLALLAFDVFFVFVTPFFTKTGESIMAQVALGPAESSSHERLPMVLKVPRLRVSALTLCSQPFSILGFGDIVVPGFLVAYCCRFDVQVCSRQIYFVACTVAYAVGLLVTFMAMVLMQMGQPALLYLVSSTLLTSLAVAACRQELSLFWTGQGRAKMCGLGCAPSAGSRQKQEGAADAHTASTLERGTSRGAGDLDSNPGEDTTEIVTISENEATNPEDRSDSSEGWSDAHLDPNELPFIPPGASEELMPLMPMAMLIPLMPLMPPPSELGHVHAQAQAHETGLPWAGLHKRKGLKVRKSMSTQAPL

SEQ ID NO: 4429 - protein, 384 aa, unidentified
MAEQTYSWAYSLVDSSQVSTFLISILLIVYGSFRSLNMDFENQDKEKDSNSSSGSFNGNSTNNSIQTIDSTQALFLPIGASVSLLVMFFFFDSVQVVFTICTAVLATIAFAFLLLPMCQYLTRPCSPQNKISFGCCGRFTAAELLSFSLSVMLVLIWVLTGHWLLMDALAMGLCVAMIAFVRLPSLKVSCLLLSGLLIYDVFWVFFSAYIFNSNVMVKVATQPADNPLDVLSRKLHLGPNVGRDVPRLSLPGKLVFPSSTGSHFSMLGIGDIVMPGLLLCFVLRYDNYKKQASGDSCGAPGPANISGRMQKVSYFHCTLIGYFVGLLTATVASRIHRAAQPALLYLVPFTLLPLLTMAYLKGDLRRMWSEPFHSKSSSSRFLEV

SEQ ID NO: 4430 - protein, 444 aa, unidentified
MSEETATSDNDNSYARVRAVVMTRDDSSGGWLPLGGSGLSSVTVFKVPHQEENGCADFFIRGERLRDKMVVLECMLKKDLIYNKVTPTFHHWKIDDKKFGLTFQSPADARAFDRGIRRAIEDISQGCPESKNEAEGADDLQANEEDSSSSLVKDHLFQQETVVTSEPYRSSNIRPSPFEDLNARRVYMQSQANQITFGQPGLDIQSRSMEYVQRQISKECGSLKSQNRVPLKSIRHVSFQDEDEIVRINPRDILIRRYADYRHPDMWKNDLERDDADSSIQFSKPDSKKSDYLYSCGDETKLSSPKDSVVFKTQPSSLKIKKSKRRKEDGERSRCVYCQERFNHEENVRGKCQDAPDPIKRCIYQVSCMLCAESMLYHCMSDSEGDFSDPCSCDTSDDKFCLRWLALVALSFIVPCMCCYVPLRMCHRCGEACGCCGGKHKAAG

SEQ ID NO: 4431 - protein, 418 aa, unidentified
MTEETHPDDDSYIVRVKAVVMTRDDSSGGWFPQEGGGISRVGVCKVMHPEGNGRSGFLIHGERQKDKLVVLECYVRKDLVYTKANPTFHHWKVDNRKFGLTFQSPADARAFDRGVRKAIEDLIEGSTTSSSTIHNEAELGDDDVFTTATDSSSNSSQKREQPTRTISSPTSCEHRRIYTLGHLHDSYPTDHYHLDQPMPRPYRQVSFPDDDEEIVRINPREKIWMTGYEDYRHAPVRGKYPDPSEDADSSYVRFAKGEVPKHDYNYPYVDSSDFGLGEDPKGRGGSVIKTQPSRGKSRRRKEDGERSRCVYCRDMFNHEENRRGHCQDAPDSVRTCIRRVSCMWCADSMLYHCMSDPEGDYTDPCSCDTSDEKFCLRWMALIALSFLAPCMCCYLPLRACYHCGVMCRCCGGKHKAAA

SEQ ID NO: 4432 - protein, 410 aa, unidentified
MVRVRAVVMARDDSSGGWLPVGGGGLSQVSVCRVRGARPEGGARQGHYVIHGERLRDQKTTLECTLKPGLVYNKVNPIFHHWSLGDCKFGLTFQSPAEADEFQKSLLAALAALGRGSLTPSSSSSSSSPSQDTAETPCPLTSHVDSDSSSSHSRQETPPSAAAAPIITMESASGFGPTTPPQRRRSSAQSYPPLLPFTGIPEPSEPLAGAGGLGWGGRGYEDYRRSGPPAPLALSTCVVRFAKTGALRGAALGPPAALPAPLTEAAPPAPPARPPPGPGPSSAPAKASPEAEEAARCVHCRALFRRRADGRGGRCAEAPDPGRLLVRRLSCLWCAESLLYHCLSDAEGDFSDPCACEPGHPRPAARWAALAALSLAVPCLCCYAPLRACHWVAARCGCAGCGGRHEEAAR

SEQ ID NO: 4433 - protein, 319 aa, unidentified
MDPQNQHGSGSSLVVIQQPSLDSRQRLDYEREIQPTAILSLDQIKAIRGSNEYTEGPSVVKRPAPRTAPRQEKHERTHEIIPINVNNNYEHRHTSHLGHAVLPSNARGPILSRSTSTGSAASSGSNSSASSEQGLLGRSPPTRPVPGHRSERAIRTQPKQLIVDDLKGSLKEDLTQHKFICEQCGKCKCGECTAPRTLPSCLACNRQCLCSAESMVEYGTCMCLVKGIFYHCSNDDEGDSYSDNPCSCSQSHCCSRYLCMGAMSLFLPCLLCYPPAKGCLKLCRRCYDWIHRPGCRCKNSNTVYCKLESCPSRGQGKPS

SEQ ID NO: 4434 - protein, 315 aa, unidentified
MEARAQSGNGSQPLLQTPRDGGRQRGEPDPRDALTQQVHVLSLDQIRAIRNTNEYTEGPTVVPRPGLKPAPRPSTQHKHERLHGLPEHRQPPRLQHSQVHSSARAPLSRSISTVSSGSRSSTRTSTSSSSSEQRLLGSSFSSGPVADGIIRVQPKSELKPGELKPLSKEDLGLHAYRCEDCGKCKCKECTYPRPLPSDWICDKQCLCSAQNVIDYGTCVCCVKGLFYHCSNDDEDNCADNPCSCSQSHCCTRWSAMGVMSLFLPCLWCYLPAKGCLKLCQGCYDRVNRPGCRCKNSNTVCCKVPTVPPRNFEKPT

SEQ ID NO: 4435 - protein, 288 aa, unidentified
MDAAVTDDFQQILPIEQLRSTHASNDYVERPPAPCKQALSSPSLIVQTHKSDWSLATMPTSLPRSLSQCHQLQPLPQHLSQSSIASSMSHSTTASDQRLLASITPSPSGQSIIRTQPGAGVHPKADGALKGEAEQSAGHPSEHLFICEECGRCKCVPCTAARPLPSCWLCNQRCLCSAESLLDYGTCLCCVKGLFYHCSTDDEDNCADEPCSCGPSSCFVRWAAMSLISLFLPCLCCYLPTRGCLHLCQQGYDSLRRPGCRCKRHTNTVCRKISSGSAPFPKAQEKSV

SEQ ID NO: 4436 - protein, 299 aa, unidentified
MEPPIPQSAPLTPNSVMVQPLLDSRMSHSRLQHPLTILPIDQVKTSHVENDYIDNPSLALTTGPKRTRGGAPELAPTPARCDQDVTHHWISFSGRPSSVSSSSSTSSDQRLLDHMAPPPVADQASPRAVRIQPKVVHCQPLDLKGPAVPPELDKHFLLCEACGKCKCKECASPRTLPSCWVCNQECLCSAQTLVNYGTCMCLVQGIFYHCTNEDDEGSCADHPCSCSRSNCCARWSFMGALSVVLPCLLCYLPATGCVKLAQRGYDRLRRPGCRCKHTNSVICKAASGDAKTSRPDKPF

SEQ ID NO: 4437 - protein, 473 aa, unidentified
MATATEQWVLVEMVQALYEAPAYHLILEGILILWIIRLLFSKTYKLQERSDLTVKEKEELIEEWQPEPLVPPVPKDHPALNYNIVSGPPSHKTVVNGKECINFASFNFLGLLDNPRVKAAALASLKKYGVGTCGPRGFYGTFDVHLDLEDRLAKFMKTEEAIIYSYGFATIASAIPAYSKRGDIVFVDRAACFAIQKGLQASRSDIKLFKHNDMADLERLLKEQEIEDQKNPRKARVTRRFIVVEGLYMNTGTICPLPELVKLKYKYKARIFLEESLSFGVLGEHGRGVTEHYGINIDDIDLISANMENALASIGGFCCGRSFVIDHQRLSGQGYCFSASLPPLLAAAAIEALNIMEENPGIFAVLKEKCGQIHKALQGISGLKVVGESLSPAFHLQLEESTGSREQDVRLLQEIVDQCMNRSIALTQARYLEKEEKCLPPPSIRVVVTVEQTEEELERAASTIKEVAQAVLL

SEQ ID NO: 4438 - protein, 562 aa, unidentified
MRPEPGGCCCRRTVRANGCVANGEVRNGYVRSSAAAAAAAAAGQIHHVTQNGGLYKRPFNEAFEETPMLVAVLTYVGYGVLTLFGYLRDFLRYWRIEKCHHATEREEQKDFVSLYQDFENFYTRNLYMRIRDNWNRPICSVPGARVDIMERQSHDYNWSFKYTGNIIKGVINMGSYNYLGFARNTGSCQEAAAKVLEEYGAGVCSTRQEIGNLDKHEELEELVARFLGVEAAMAYGMGFATNSMNIPALVGKGCLILSDELNHASLVLGARLSGATIRIFKHNNMQSLEKLLKDAIVYGQPRTRRPWKKILILVEGIYSMEGSIVRLPEVIALKKKYKAYLYLDEAHSIGALGPTGRGVVEYFGLDPEDVDVMMGTFTKSFGASGGYIGGKKELIDYLRTHSHSAVYATSLSPPVVEQIITSMKCIMGQDGTSLGKECVQQLAENTRYFRRRLKEMGFIIYGNEDSPVVPLMLYMPAKIGAFGREMLKRNIGVVVVGFPATPIIESRARFCLSAAHTKEILDTALKEIDEVGDLLQLKYSRHRLVPLLDRPFDETTYEETED

SEQ ID NO: 4439 - protein, 552 aa, unidentified
MANPGGGAVCNGKLHNHKKQSNGSQSRNCTKNGIVKEAQQNGKPHFYDKLIVESFEEAPLHVMVFTYMGYGIGTLFGYLRDFLRNWGIEKCNAAVERKEQKDFVPLYQDFENFYTRNLYMRIRDNWNRPICSAPGPLFDLMERVSDDYNWTFRFTGRVIKDVINMGSYNFLGLAAKYDESMRTIKDVLEVYGTGVASTRHEMGTLDKHKELEDLVAKFLNVEAAMVFGMGFATNSMNIPALVGKGCLILSDELNHTSLVLGARLSGATIRIFKHNNTQSLEKLLRDAVIYGQPRTRRAWKKILILVEGVYSMEGSIVHLPQIIALKKKYKAYLYIDEAHSIGAVGPTGRGVTEFFGLDPHEVDVLMGTFTKSFGASGGYIAGRKDLVDYLRVHSHSAVYASSMSPPIAEQIIRSLKLIMGLDGTTQGLQRVQQLAKNTRYFRQRLQEMGFIIYGNENASVVPLLLYMPGKVAAFARHMLEKKIGVVVVGFPATPLAEARARFCVSAAHTREMLDTVLEALDEMGDLLQLKYSRHKKSARPELYDETSFELED

SEQ ID NO: 4440 - protein, 71 aa, unidentified
MAGMALARAWKQMSWFYYQYLLVTALYMLEPWERTVFNSMLVSIVGMALYTGYVFMPQHIMAILHYFEIVQ

SEQ ID NO: 4441 - protein, 76 aa, unidentified
MDLRRVKEYFSWLYYQYQIISCCAVLEPWERSMFNTILLTIIAMVVYTAYVFIPIHIRLAWEFFSKICGYHSTISN

SEQ ID NO: 4442 - protein, 574 aa, unidentified
MWTFLGIATFTYFYKKFGDFITLANREVLLCVLVFLSLGLVLSYRCRHRNGGLLGRQQSGSQFALFSDILSGLPFIGFFWAKSPPESENKEQLEARRRRKGTNISETSLIGTAACTSTSSQNDPEVIIVGAGVLGSALAAVLSRDGRKVTVIERDLKEPDRIVGEFLQPGGYHVLKDLGLGDTVEGLDAQVVNGYMIHDQESKSEVQIPYPLSENNQVQSGRAFHHGRFIMSLRKAAMAEPNAKFIEGVVLQLLEEDDVVMGVQYKDKETGDIKELHAPLTVVADGLFSKFRKSLVSNKVSVSSHFVGFLMKNAPQFKANHAELILANPSPVLIYQISSSETRVLVDIRGEMPRNLREYMVEKIYPQIPDHLKEPFLEATDNSHLRSMPASFLPPSSVKKRGVLLLGDAYNMRHPLTGGGMTVAFKDIKLWRKLLKGIPDLYDDAAIFEAKKSFYWARKTSHSFVVNILAQALYELFSATDDSLHQLRKACFLYFKLGGECVAGPVGLLSVLSPNPLVLIGHFFAVAIYAVYFCFKSEPWITKPRALLSSGAVLYKACSVIFPLIYSEMKYMVH

SEQ ID NO: 4443 - protein, 259 aa, unidentified
MATATGVAEERLLAALAYLQCAVGCAVFARNRQTNSVYGRHALPSHRLRVPARAAWVVQELPSLALPLYQYASESAPRLRSAPNCILLAMFLVHYGHRCLIYPFLMRGGKPMPLLACTMAIMFCTCNGYLQSRYLSHCAVYADDWVTDPRFLIGFGLWLTGMLINIHSDHILRNLRKPGDTGYKIPRGGLFEYVTAANYFGEIMEWCGYALASWSVQGAAFAFFTFCFLSGRAKEHHEWYLRKFEEYPKFRKIIIPFLF

SEQ ID NO: 4444 - protein, 318 aa, unidentified
MAPWAEAEHSALNPLRAVWLTLTAAFLLTLLLQLLPPGLLPGCAIFQDLIRYGKTKCGEPSRPAACRAFDVPKRYFSHFYIISVLWNGFLLWCLTQSLFLGAPFPSWLHGLLRILGAAQFQGGELALSAFLVLVFLWLHSLRRLFECLYVSVFSNVMIHVVQYCFGLVYYVLVGLTVLSQVPMDGRNAYITGKNLLMQARWFHILGMMMFIWSSAHQYKCHVILGNLRKNKAGVVIHCNHRIPFGDWFEYVSSPNYLAELMIYVSMAVTFGFHNLTWWLVVTNVFFNQALSAFLSHQFYKSKFVSYPKHRKAFLPFLF

SEQ ID NO: 4445 - protein, 1147 aa, unidentified
MDEPPFSEAALEQALGEPCDLDAALLTDIEDMLQLINNQDSDFPGLFDPPYAGSGAGGTDPASPDTSSPGSLSPPPATLSSSLEAFLSGPQAAPSPLSPPQPAPTPLKMYPSMPAFSPGPGIKEESVPLSILQTPTPQPLPGALLPQSFPAPAPPQFSSTPVLGYPSPPGGFSTGSPPGNTQQPLPGLPLASPPGVPPVSLHTQVQSVVPQQLLTVTAAPTAAPVTTTVTSQIQQVPVLLQPHFIKADSLLLTAMKTDGATVKAAGLSPLVSGTTVQTGPLPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKAKPEQRPSLHSRGMLDRSRLALCTLVFLCLSCNPLASLLGARGLPSPSDTTSVYHSPGRNVLGTESRDGPGWAQWLLPPVVWLLNGLLVLVSLVLLFVYGEPVTRPHSGPAVYFWRHRKQADLDLARGDFAQAAQQLWLALRALGRPLPTSHLDLACSLLWNLIRHLLQRLWVGRWLAGRAGGLQQDCALRVDASASARDAALVYHKLHQLHTMGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGVDPVAKWWASLTAVVIHWLRRDEEAAERLCPLVEHLPRVLQESERPLPRAALHSFKAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGGAVAELEPRPTRREHAEALLLASCYLPPGFLSAPGQRVGMLAEAARTLEKLGDRRLLHDCQQMLMRLGGGTTVTSS

SEQ ID NO: 4446 - protein, 1141 aa, unidentified
MDDSGELGGLETMETLTELGDELTLGDIDEMLQFVSNQVGEFPDLFSEQLCSSFPGSGGSGSSSGSSGSSSSSSNGRGSSSGAVDPSVQRSFTQVTLPSFSPSAASPQAPTLQVKVSPTSVPTTPRATPILQPRPQPQPQPQTQLQQQTVMITPTFSTTPQTRIIQQPLIYQNAATSFQVLQPQVQSLVTSSQVQPVTIQQQVQTVQAQRVLTQTANGTLQTLAPATVQTVAAPQVQQVPVLVQPQIIKTDSLVLTTLKTDGSPVMAAVQNPALTALTTPIQTAALQVPTLVGSSGTILTTMPVMMGQEKVPIKQVPGGVKQLEPPKEGERRTTHNIIEKRYRSSINDKIIELKDLVMGTDAKMHKSGVLRKAIDYIKYLQQVNHKLRQENMVLKLANQKNKLLKGIDLGSLVDNEVDLKIEDFNQNVLLMSPPASDSGSQAGFSPYSIDSEPGSPLLDDAKVKDEPDSPPVALGMVDRSRILLCVLTFLCLSFNPLTSLLQWGGAHDSDQHPHSGSGRSVLSFESGSGGWFDWMMPTLLLWLVNGVIVLSVFVKLLVHGEPVIRPHSRSSVTFWRHRKQADLDLARGDFAAAAGNLQTCLAVLGRALPTSRLDLACSLSWNVIRYSLQKLRLVRWLLKKVFQCRRATPATEAGFEDEAKTSARDAALAYHRLHQLHITGKLPAGSACSDVHMALCAVNLAECAEEKIPPSTLVEIHLTAAMGLKTRCGGKLGFLASYFLSRAQSLCGPEHSAVPDSLRWLCHPLGQKFFMERSWSVKSAAKESLYCAQRNPADPIAQVHQAFCKNLLERAIESLVKPQAKKKAGDQEEESCEFSSALEYLKLLHSFVDSVGVMSPPLSRSSVLKSALGPDIICRWWTSAITVAISWLQGDDAAVRSHFTKVERIPKALEVTESPLVKAIFHACRAMHASLPGKADGQQSSFCHCERASGHLWSSLNVSGATSDPALNHVVQLLTCDLLLSLRTALWQKQASASQAVGETYHASGAELAGFQRDLGSLRRLAHSFRPAYRKVFLHEATVRLMAGASPTRTHQLLEHSLRRRTTQSTKHGEVDAWPGQRERATAILLACRHLPLSFLSSPGQRAVLLAEAARTLEKVGDRRSCNDCQQMIVKLGGGTAIAAS

SEQ ID NO: 4447 - protein, 271 aa, unidentified
MASADSRRVADGGGAGGTFQPYLDTLRQELQQTDPTLLSVVVAVLAVLLTLVFWKLIRSRRSSQRAVLLVGLCDSGKTLLFVRLLTGLYRDTQTSITDSCAVYRVNNNRGNSLTLIDLPGHESLRLQFLERFKSSARAIVFVVDSAAFQREVKDVAEFLYQVLIDSMGLKNTPSFLIACNKQDIAMAKSAKLIQQQLEKELNTLRVTRSAAPSTLDSSSTAPAQLGKKGKEFEFSQLPLKVEFLECSAKGGRGDVGSADIQDLEKWLAKIA

SEQ ID NO: 4448 - protein, 361 aa, unidentified
MYGKGKSNSSAVPSDSQAREKLALYVYEYLLHVGAQKSAQTFLSEIRWEKNITLGEPPGFLHSWWCVFWDLYCAAPERRETCEHSSEAKAFHDYSAAAAPSPVLGNIPPGDGMPVGPVPPGFFQPFMSPRYPGGPRPPLRIPNQALGGVPGSQPLLPSGMDPTRQQGHPNMGGPMQRMTPPRGMVPLGPQNYGGAMRPPLNALGGPGMPGMNMGPGGGRPWPNPTNANSIPYSSASPGNYVGPPGGGGPPGTPIMPSPADSTNSGDNMYTLMNAVPPGPNRPNFPMGPGSDGPMGGLGGMESHHMNGSLGSGDMDSISKNSPNNMSLSNQPGTPRDDGEMGGNFLNPFQSESYSPSMTMSV

SEQ ID NO: 4449 - protein, 244 aa, unidentified
MGDLFSLFWEVDPPPIPVNCAIPNQDYECWKDDSCGTIGSFLLWYFVIVFVLMFFSRASVWMSEDKKDEGSGTSTSVRKASKETSCKRQSKDSAWDPSQTMKKPKQNQLTPVTNSEVALVNAYPEQRRARRQSQFNEVNQNQHDSDTTEYGSEESNSEASSWKESESEHHPSPDSIKRRKMAQRQRNLGSYQMSERHCLHCKALRTNEWLAHHSRQKPSVTPPMKRDSQEESSISDINKKFSKF

SEQ ID NO: 4450 - protein, 243 aa, unidentified
MGKNKQPRGQQRQGGPPAADAAGPDDMEPKKGTGAPKECGEEEPRTCCGCRFPLLLALLQLALGIAVTVVGFLMASISSSLLVRDTPFWAGIIVCLVAYLGLFMLCVSYQVDERTCIQFSMKLLYFLLSALGLTVCVLAVAFAAHHYSQLTQFTCETTLDSCQCKLPSSEPLSRTFVYRDVTDCTSVTGTFKLFLLIQMILNLVCGLVCLLACFVMWKHRYQVFYVGVRICSLTASEGPQQKI

SEQ ID NO: 4451 - protein, 286 aa, unidentified
MRLLPRLLLLLLLVFPATVLFRGGPRGLLAVAQDLTEDEETVEDSIIEDEDDEAEVEEDEPTDLVEDKEEEDVSGEPEASPSADTTILFVKGEDFPANNIVKFLVGFTNKGTEDFIVESLDASFRYPQDYQFYIQNFTALPLNTVVPPQRQATFEYSFIPAEPMGGRPFGLVINLNYKDLNGNVFQDAVFNQTVTVIEREDGLDGETIFMYMFLAGLGLLVIVGLHQLLESRKRKRPIQKVEMGTSSQNDVDMSWIPQETLNQINKASPRRLPRKRAQKRSVGSDE

SEQ ID NO: 4452 - protein, 183 aa, unidentified
MRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKAGYFNFTSATITYLAQEDGPVVIGSTSAPGQGGILAQREFDRRFSPHFLDWAAFGVMTLPSIGIPLLLWYSSKRKYDTPKTKKN

SEQ ID NO: 4453 - protein, 185 aa, unidentified
MAPKGSSKQQSEEDLLLQDFSRNLSAKSSALFFGNAFIVSAIPIWLYWRIWHMDLIQSAVLYSVMTLVSTYLVAFAYKNVKFVLKHKVAQKREDAVSKEVTRKLSEADNRKMSRKEKDERILWKKNEVADYEATTFSIFYNNTLFLVVVIVASFFILKNFNPTVNYILSISASSGLIALLSTGSK

SEQ ID NO: 4454 - protein, 173 aa, unidentified
MAAMASLGALALLLLSSLSRCSAEACLEPQITPSYYTTSDAVISTETVFIVEISLTCKNRVQNMALYADVGGKQFPVTRGQDVGRYQVSWSLDHKSAHAGTYEVRFFDEESYSLLRKAQRNNEDISIIPPLFTVSVDHRGTWNGPWVSTEVLAAAIGLVIYYLAFSAKSHIQA

SEQ ID NO: 4455 - protein, 391 aa, unidentified
MFPNGTASSPSSSPSPSPGSCGEGGGSRGPGAGAADGMEEPGRNASQNGTLSEGQGSAILISFIYSVVCLVGLCGNSMVIYVILRYAKMKTATNIYILNLAIADELLMLSVPFLVTSTLLRHWPFGALLCRLVLSVDAVNMFTSIYCLTVLSVDRYVAVVHPIKAARYRRPTVAKVVNLGVWVLSLLVILPIVVFSRTAANSDGTVACNMLMPEPAQRWLVGFVLYTFLMGFLLPVGAICLCYVLIIAKMRMVALKAGWQQRKRSERKITLMVMMVVMVFVICWMPFYVVQLVNVFAEQDDATVSQLSVILGYANSCANPILYGFLSDNFKRSFQRILCLSWMDNAAEEPVDYYATALKSRAYSVEDFQPENLESGGVFRNGTCTSRITTL

SEQ ID NO: 4456 - protein, 369 aa, unidentified
MDMADEPLNGSHTWLSIPFDLNGSVVSTNTSNQTEPYYDLTSNAVLTFIYFVVCIIGLCGNTLVIYVILRYAKMKTITNIYILNLAIADELFMLGLPFLAMQVALVHWPFGKAICRVVMTVDGINQFTSIFCLTVMSIDRYLAVVHPIKSAKWRRPRTAKMITMAVWGVSLLVILPIMIYAGLRSNQWGRSSCTINWPGESGAWYTGFIIYTFILGFLVPLTIICLCYLFIIIKVKSSGIRVGSSKRKKSEKKVTRMVSIVVAVFIFCWLPFYIFNVSSVSMAISPTPALKGMFDFVVVLTYANSCANPILYAFLSDNFKKSFQNVLCLVKVSGTDDGERSDSKQDKSRLNETTETQRTLLNGDLQTSI

SEQ ID NO: 4457 - protein, 388 aa, unidentified
MSAPSTLPPGGEEGLGTAWPSAANASSAPAEAEEAVAGPGDARAAGMVAIQCIYALVCLVGLVGNALVIFVILRYAKMKTATNIYLLNLAVADELFMLSVPFVASSAALRHWPFGSVLCRAVLSVDGLNMFTSVFCLTVLSVDRYVAVVHPLRAATYRRPSVAKLINLGVWLASLLVTLPIAIFADTRPARGGQAVACNLQWPHPAWSAVFVVYTFLLGFLLPVLAIGLCYLLIVGKMRAVALRAGWQQRRRSEKKITRLVLMVVVVFVLCWMPFYVVQLLNLFVTSLDATVNHVSLILSYANSCANPILYGFLSDNFRRFFQRVLCLRCCLLEGAGGAEEEPLDYYATALKSKGGAGCMCPPLPCQQEALQPEPGRKRIPLTRTTTF

SEQ ID NO: 4458 - protein, 364 aa, unidentified
MEPLFPASTPSWNASSPGAASGGGDNRTLVGPAPSAGARAVLVPVLYLLVCAAGLGGNTLVIYVVLRFAKMKTVTNIYILNLAVADVLYMLGLPFLATQNAASFWPFGPVLCRLVMTLDGVNQFTSVFCLTVMSVDRYLAVVHPLSSARWRRPRVAKLASAAAWVLSLCMSLPLLVFADVQEGGTCNASWPEPVGLWGAVFIIYTAVLGFFAPLLVICLCYLLIVVKVRAAGVRVGCVRRRSERKVTRMVLVVVLVFAGCWLPFFTVNIVNLAVALPQEPASAGLYFFVVILSYANSCANPVLYGFLSDNFRQSFQKVLCLRKGSGAKDADATEPRPDRIRQQQEATPPAHRAAANGLMQTSKL

SEQ ID NO: 4459 - protein, 855 aa, unidentified [sequence omitted]

SEQ ID NO: 4460 - protein, 350 aa, unidentified
MKCSLRVWFLSVAFLLVFIMSLLFTYSHHSMATLPYLDSGALDGTHRVKLVPGYAGLQRLSKERLSGKSCACRRCMGDAGASDWFDSHFDGNISPVWTRENMDLPPDVQRWWMMLQPQFKSHNTNEVLEKLFQIVPGENPYRFRDPHQCRRCAVVGNSGNLRGSGYGQDVDGHNFIMRMNQAPTVGFEQDVGSRTTHHFMYPESAKNLPANVSFVLVPFKVLDLLWIASALSTGQIRFTYAPVKSFLRVDKEKVQIYNPAFFKYIHDRWTEHHGRYPSTGMLVLFFALHVCDEVNVYGFGADSRGNWHHYWENNRYAGEFRKTGVHDADFEAHIIDMLAKASKIEVYRGN

SEQ ID NO: 4461 - protein, 375 aa, unidentified
MGLLVFVRNLLLALCLFLVLGFLYYSAWKLHLLQWEEDSNSVVLSFDSAGQTLGSEYDRLGFLLNLDSKLPAELATKYANFSEGACKPGYASALMTAIFPRFSKPAPMFLDDSFRKWARIREFVPPFGIKGQDNLIKAILSVTKEYRLTPALDSLRCRRCIIVGNGGVLANKSLGSRIDDYDIVVRLNSAPVKGFEKDVGSKTTLRITYPEGAMQRPEQYERDSLFVLAGFKWQDFKWLKYIVYKERVSASDGFWKSVATRVPKEPPEIRILNPYFIQEAAFTLIGLPFNNGLMGRGNIPTLGSVAVTMALHGCDEVAVAGFGYDMSTPNAPLHYYETVRMAAIKESWTHNIQREKEFLRKLVKARVITDLSSGI

SEQ ID NO: 4462 - protein, 333 aa, unidentified
MVSKSRWKLLAMLALVLVVMVWYSISREDRYIELFYFPIPEKKEPCLQGEAESKASKLFGNYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALAIKRMLEMGAIKNLTSF

SEQ ID NO: 4463 - protein, 418 aa, unidentified
MRTKAAGCAERRPLQPRTEAAAAPAGRAMPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 4464 - protein, 331 aa, unidentified
MRGYLVAIFLSAVFLYYVLHCILWGTNVYWVAPVEMKRRNKIQPCLSKPAFASLLRFHQFHPFLCAADFRKIASLYGSDKFDLPYGMRTSAEYFRLALSKLQSCDLFDEFDNIPCKKCVVVGNGGVLKNKTLGEKIDSYDVIIRMNNGPVLGHEEEVGRRTTFRLFYPESVFSDPIHNDPNTTVILTAFKPHDLRWLLELLMGDKINTNGFWKKPALNLIYKPYQIRILDPFIIRTAAYELLHFPKVFPKNQKPKHPTTGIIAITLAFYICHEVHLAGFKYNFSDLKSPLHYYGNATMSLMNKNAYHNVTAEQLFLKDIIEKNLVINLTQD

SEQ ID NO: 4465 - protein, 529 aa, unidentified
MKPHLKQWRQRMLFGIFAWGLLFLLIFIYFTDSNPAEPVPSSLSFLETRRLLPVQGKQRAIMGAAHEPSPPGGLDARQALPRAHPAGSFHAGPGDLQKWAQSQDGFEHKEFFSSQVGRKSQSAFYPEDDDYFFAAGQPGWHSHTQGTLGFPSPGEPGPREGAFPAAQVQRRRVKKRHRRQRRSHVLEEGDDGDRLYSSMSRAFLYRLWKGNVSSKMLNPRLQKAMKDYLTANKHGVRFRGKREAGLSRAQLLCQLRSRARVRTLDGTEAPFSALGWRRLVPAVPLSQLHPRGLRSCAVVMSAGAILNSSLGEEIDSHDAVLRFNSAPTRGYEKDVGNKTTIRIINSQILTNPSHHFIDSSLYKDVILVAWDPAPYSANLNLWYKKPDYNLFTPYIQHRQRNPNQPFYILHPKFIWQLWDIIQENTKEKIQPNPPSSGFIGILIMMSMCREVHVYEYIPSVRQTELCHYHELYYDAACTLGAYHPLLYEKLLVQRLNMGTQGDLHRKGKVVLPGFQAVHCPAPSPVIPHS

SEQ ID NO: 4466 - protein, 600 aa, unidentified
MRSCLWRCRHLSQGVQWSLLLAVLVFFLFALPSFIKEPQTKPSRHQRTENIKERSLQSLAKPKSQAPTRARRTTIYAEPVPENNALNTQTQPKAHTTGDRGKEANQAPPEEQDKVPHTAQRAAWKSPEKEKTMVNTLSPRGQDAGMASGRTEAQSWKSQDTKTTQGNGGQTRKLTASRTVSEKHQGKAATTAKTLIPKSQHRMLAPTGAVSTRTRQKGVTTAVIPPKEKKPQATPPPAPFQSPTTQRNQRLKAANFKSEPRWDFEEKYSFEIGGLQTTCPDSVKIKASKSLWLQKLFLPNLTLFLDSRHFNQSEWDRLEHFAPPFGFMELNYSLVQKVVTRFPPVPQQQLLLASLPAGSLRCITCAVVGNGGILNNSHMGQEIDSHDYVFRLSGALIKGYEQDVGTRTSFYGFTAFSLTQSLLILGNRGFKNVPLGKDVRYLHFLEGTRDYEWLEALLMNQTVMSKNLFWFRHRPQEAFREALHMDRYLLLHPDFLRYMKNRFLRSKTLDGAHWRIYRPTTGALLLLTALQLCDQVSAYGFITEGHERFSDHYYDTSWKRLIFYINHDFKLEREVWKRLHDEGIIRLYQRPGPGTAKAKN

SEQ ID NO: 4467 - protein, 305 aa, unidentified
MACILKRKSVIAVSFIAAFLFLLVVRLVNEVNFPLLLNCFGQPGTKWIPFSYTYRRPLRTHYGYINVKTQEPLQLDCDLCAIVSNSGQMVGQKVGNEIDRSSCIWRMNNAPTKGYEEDVGRMTMIRVVSHTSVPLLLKNPDYFFKEANTTIYVIWGPFRNMRKDGNGIVYNMLKKTVGIYPNAQIYVTTEKRMSYCDGVFKKETGKDRVQSGSYLSTGWFTFLLAMDACYGIHVYGMINDTYCKTEGYRKVPYHYYEQGRDECDEYFLHEHAPYGGHRFITEKKVFAKWAKKHRIIFTHPNWTLS

SEQ ID NO: 4468 - protein, 302 aa, unidentified
MKAPGRLVLIILCSVVFSAVYILLCCWAGLPLCLATCLDHHFPTGSRPTVPGPLHFSGYSSVPDGKPLVREPCRSCAVVSSSGQMLGSGLGAEIDSAECVFRMNQAPTVGFEADVGQRSTLRVVSHTSVPLLLRNYSHYFQKARDTLYMVWGQGRHMDRVLGGRTYRTLLQLTRMYPGLQVYTFTERMMAYCDQIFQDETGKNRRQSGSFLSTGWFTMILALELCEEIVVYGMVSDSYCREKSHPSVPYHYFEKGRLDECQMYLAHEQAPRSAHRFITEKAVFSRWAKKRPIVFAHPSWRTE

SEQ ID NO: 4469 - protein, 333 aa, unidentified
MACSRPPSQCEPTSLPPGPPAGRRHLPLSRRRREMSSNKEQRSAVFVILFALITILILYSSNSANEVFHYGSLRGRSRRPVNLKKWSITDGYVPILGNKTLPSRCHQCVIVSSSSHLLGTKLGPEIERAECTIRMNDAPTTGYSADVGNKTTYRVVAHSSVFRVLRRPQEFVNRTPETVFIFWGPPSKMQKPQGSLVRVIQRAGLVFPNMEAYAVSPGRMRQFDDLFRGETGKDREKSHSWLSTGWFTMVIAVELCDHVHVYGMVPPNYCSQRPRLQRMPYHYYEPKGPDECVTYIQNEHSRKGNHHRFITEKRVFSSWAQLYGITFSHPSWT

SEQ ID NO: 4470 - protein, 585 aa, unidentified
MAEAATGFLEQLKSCIVWSWTYLWTVWFFIVLFLVYILRVPLKINDNLSTVSMFLNTLTPKFYVALTGTSSLISGLILIFEWWYFRKYGTSFIEQVSVSHLRPLLGGVDNNSSNNSNSSNGDSDSNRQSVSECKVWRNPLNLFRGAEYNRYTWVTGREPLTYYDMNLSAQDHQTFFTCDSDHLRPADAIMQKAWRERNPQARISAAHEALEINEIRSRVEVPLIASSTIWEIKLLPKCATAYILLAEEEATTIAEAEKLFKQALKAGDGCYRRSQQLQHHGSQYEAQHRRDTNVLVYIKRRLAMCARRLGRTREAVKMMRDLMKEFPLLSMFNIHENLLEALLELQAYADVQAVLAKYDDISLPKSATICYTAALLKARAVSDKFSPEAASRRGLSTAEMNAVEAIHRAVEFNPHVPKYLLEMKSLILPPEHILKRGDSEAIAYAFFHLAHWKRVEGALNLLHCTWEGTFRMIPYPLEKGHLFYPYPICTETADRELLPSFHEVSVYPKKELPFFILFTAGLCSFTAMLALLTHQFPELMGVFAKAMIDIFCSAEFRDWNCKSIFMRVEDELEIPPAPQSQHFQN

SEQ ID NO: 4471 - protein, 575 aa, unidentified
MADRGGVGEAAAVGASPASVPGLNPTLGWRERLRAGLAGTGASLWFVAGLGLLYALRIPLRLCENLAAVTVFLNSLTPKFYVALTGTSSLISGLIFIFEWWYFHKHGTSFIEQVSVSHLQPLMGGTESSISEPGSPSRNRENETSRQNLSECKVWRNPLNLFRGAEYRRYTWVTGKEPLTYYDMNLSAQDHQTFFTCDTDFLRPSDTVMQKAWRERNPPARIKAAYQALELNNDCATAYVLLAEEEATTIVDAERLFKQALKAGETIYRQSQQCQHQSPQHEAQLRRDTNVLVYIKRRLAMCARKLGRIREAVKIMRDLMKEFPPLTMLNIHENLLESLLELQAYPDVQAVLAKYDDISLPKSAAICYTAALLKTRTVSEKFSPETASRRGLSTAEINAVEAIHRAVEFNPHVPKYLLEMKSLILPPEHILKRGDSEAIAYAFFHLQHWKRIEGALNLLQCTWEGTFRMIPYPLEKGHLFYPYPSCTETADRELLPTFHHVSVYPKKELPLFIHFTAGFCSSTAMIAILTHQFPEIMGIFAKAVLGLWCPQPWASSGFEENTQDLKSEDLGLSSG

SEQ ID NO: 4472 - protein, 356 aa, unidentified
MSPCGRARRQTSRGAMAVLAWKFPRTRLPMGASALCVVVLCWLYIFPVYRLPNEKEIVQGVLQQGTAWRRNQTAARAFRKQMEDCCDPAHLFAMTKMNSPMGKSMWYDGEFLYSFTIDNSTYSLFPQATPFQLPLKKCAVVGNGGILKKSGCGRQIDEANFVMRCNLPPLSSEYTKDVGSKSQLVTANPSIIRQRFQNLLWSRKTFVDNMKIYNHSYIYMPAFSMKTGTEPSLRVYYTLSDVGANQTVLFANPNFLRSIGKFWKSRGIHAKRLSTGLFLVSAALGLCEEVAIYGFWPFSVNMHEQPISHHYYDNVLPFSGFHAMPEEFLQLWYLHKIGALRMQLDPCEDTSLQPTS

SEQ ID NO: 4473 - protein, 380 aa, unidentified
MRNCKMARVASVLGLVMLSVALLILSLISYVSLKKENIFTTPKYASPGAPRMYMFHAGFRSQFALKFLDPSFVPITNSLTQELQEKPSKWKFNRTAFLHQRQEILQHVDVIKNFSLTKNSVRIGQLMHYDYSSHKYVFSISNNFRSLLPDVSPIMNKHYNICAVVGNSGILTGSQCGQEIDKSDFVFRCNFAPTEAFQRDVGRKTNLTTFNPSILEKYYNNLLTIQDRNNFFLSLKKLDGAILWIPAFFFHTSATVTRTLVDFFVEHRGQLKVQLAWPGNIMQHVNRYWKNKHLSPKRLSTGILMYTLASAICEEIHLYGFWPFGFDPNTREDLPYHYYDKKGTKFTTKWQESHQLPAEFQLLYRMHGEGLTKLTLSHCA

SEQ ID NO: 4474 - protein, 376 aa, unidentified
MRYADPSANRDLLGSRTLLFIFICAFALVTLLQQILYGRNYIKRYFEFYEGPFEYNSTRCLELRHEILEVKVLSMVKQSELFDRWKSLQMCKWAMNISEANQFKSTLSRCCNAPAFLFTTQKNTPLGTKLKYEVDTSGIYHINQEIFRMFPKDMPYYRSQFKKCAVVGNGGILKNSRCGREINSADFVFRCNLPPISEKYTMDVGVKTDVVTVNPSIITERFHKLEKWRRPFYRVLQVYENASVLLPAFYNTRNTDVSIRVKYVLDDFESPQAVYYFHPQYLVNVSRYWLSLGVRAKRISTGLILVTAALELCEEVHLFGFWAFPMNPSGLYITHHYYDNVKPRPGFHAMPSEIFNFLHLHSRGILRVHTGTCSCC

SEQ ID NO: 4475 - protein, 2570 aa, unidentified
MAGPRGLLPLCLLAFCLAGFSFVRGQVLFKGCDVKTTFVTHVPCTSCAAIKKQTCPSGWLRELPDQITQDCRYEVQLGGSMVSMSGCRRKCRKQVVQKACCPGYWGSRCHECPGGAETPCNGHGTCLDGMDRNGTCVCQENFRGSACQECQDPNRFGPDCQSVCSCVHGVCNHGPRGDGSCLCFAGYTGPHCDQELPVCQELRCPQNTQCSAEAPSCRCLPGYTQQGSECRAPNPCWPSPCSLLAQCSVSPKGQAQCHCPENYHGDGMVCLPKDPCTDNLGGCPSNSTLCVYQKPGQAFCTCRPGLVSINSNASAGCFAFCSPFSCDRSATCQVTADGKTSCVCRESEVGDGRACYGHLLHEVQKATQTGRVFLQLRVAVAMMDQGCREILTTAGPFTVLVPSVSSFSSRTMNASLAQQLCRQHIIAGQHILEDTRTQQTRRWWTLAGQEITVTFNQFTKYSYKYKDQPQQTFNIYKANNIAANGVFHVVTGLRWQAPSGTPGDPKRTIGQILASTEAFSRFETILENCGLPSILDGPGPFTVFAPSNEAVDSLRDGRLIYLFTAGLSKLQELVRYHIYNHGQLTVEKLISKGRILTMANQVLAVNISEEGRILLGPEGVPLQRVDVMAANGVIHMLDGILLPPTILPILPKHCSEEQHKIVAGSCVDCQALNTSTCPPNSVKLDIFPKECVYIHDPTGLNVLKKGCASYCNQTIMEQGCCKGFFGPDCTQCPGGFSNPCYGKGNCSDGIQGNGACLCFPDYKGIACHICSNPNKHGEQCQEDCGCVHGLCDNRPGSGGVCQQGTCAPGFSGRFCNESMGDCGPTGLAQHCHLHARCVSQEGVARCRCLDGFEGDGFSCTPSNPCSHPDRGGCSENAECVPGSLGTHHCTCHKGWSGDGRVCVAIDECELDMRGGCHTDALCSYVGPGQSRCTCKLGFAGDGYQCSPIDPCRAGNGGCHGLATCRAVGGGQRVCTCPPGFGGDGFSCYGDIFRELEANAHFSIFYQWLKSAGITLPADRRVTALVPSEAAVRQLSPEDRAFWLQPRTLPNLVRAHFLQGALFEEELARLGGQEVATLNPTTRWEIRNISGRVWVQNASVDVADLLATNGVLHILSQVLLPPRGDVPGGQGLLQQLDLVPAFSLFRELLQHHGLVPQIEAATAYTIFVPTNRSLEAQGNSSHLDADTVRHHVVLGEALSMETLRKGGHRNSLLGPAHWIVFYNHSGQPEVNHVPLEGPMLEAPGRSLIGLSGVLTVGSSRCLHSHAEALREKCVNCTRRFRCTQGFQLQDTPRKSCVYRSGFSFSRGCSYTCAKKIQVPDCCPGFFGTLCEPCPGGLGGVCSGHGQCQDRFLGSGECHCHEGFHGTACEVCELGRYGPNCTGVCDCAHGLCQEGLQGDGSCVCNVGWQGLRCDQKITSPQCPRKCDPNANCVQDSAGASTCACAAGYSGNGIFCSEVDPCAHGHGGCSPHANCTKVAPGQRTCTCQDGYMGDGELCQEINSCLIHHGGCHIHAECIPTGPQQVSCSCREGYSGDGIRTCELLDPCSKNNGGCSPYATCKSTGDGQRTCTCDTAHTVGDGLTCRARVGLELLRDKHASFFSLRLLEYKELKGDGPFTIFVPHADLMSNLSQDELARIRAHRQLVFRYHVVGCRRLRSEDLLEQGYATALSGHPLRFSEREGSIYLNDFARVVSSDHEAVNGILHFIDRVLLPPEALHWEPDDAPIPRRNVTAAAQGFGYKIFSGLLKVAGLLPLLREASHRPFTMLWPTDAAFRALPPDRQAWLYHEDHRDKLAAILRGHMIRNVEALASDLPNLGPLRTMHGTPISFSCSRTRAGELMVGEDDARIVQRHLPFEGGLAYGIDQLLEPPGLGARCDHFETRPLRLNTCSICGLEPPCPEGSQEQGSPEACWRFYPKFWTSPPLHSLGLRSVWVHPSLWGRPQGLGRGCHRNCVTTTWKPSCCPGHYGSECQACPGGPSSPCSDRGVCMDGMSGSGQCLCRSGFAGTACELCAPGAFGPHCQACRCTVHGRCDEGLGGSGSCFCDEGWTGPRCEVQLELQPVCTPPCAPEAVCRAGNSCECSLGYEGDGRVCTVADLCQDGHGGCSEHANCSQVGTMVTCTCLPDYEGDGWSCRARNPCTDGHRGGCSEHANCLSTGLNTRRCECHAGYVGDGLQCLEESEPPVDRCLGQPPPCHSDAMCTDLHFQEKRAGVFHLQATSGPYGLNFSEAEAACEAQGAVLASFPQLSAAQQLGFHLCLMGWLANGSTAHPVVFPVADCGNGRVGIVSLGARKNLSERWDAYCFRVQDVACRCRNGFVGDGISTCNGKLLDVLAATANFSTFYGMLLGYANATQRGLDFLDFLDDELTYKTLFVPVNEGFVDNMTLSGPDLELHASNATLLSANASQGKLLPAHSGLSLIISDAGPDNSSWAPVAPGTVVVSRIIVWDIMAFNGIIHALASPLLAPPQPQAVLAPEAPPVAAGVGAVLAAGALLGLVAGALYLRARGKPMGFGFSAFQAEDDADDDFSPWQEGTNPTLVSVPNPVFGSDTFCEPFDDSLLEEDFPDTQRILTVK

SEQ ID NO: 4476 - protein, 2551 aa, unidentified
MMLQHLVIFCLGLVVQNFCSPAETTGQARRCDRKSLLTIRTECRSCALNLGVKCPDGYTMITSGSVGVRDCRYTFEVRTYSLSLPGCRHICRKDYLQPRCCPGRWGPDCIECPGGAGSPCNGRGSCAEGMEGNGTCSCQEGFGGTACETCADDNLFGPSCSSVCNCVHGVCNSGLDGDGTCECYSAYTGPKCDKPIPECAALLCPENSRCSPSTEDENKLECKCLPNYRGDGKYCDPINPCLRKICHPHAHCTYLGPNRHSCTCQEGYRGDGQVCLPVDPCQINFGNCPTKSTVCKYDGPGQSHCECKEHYQNFVPGVGCSMTDICKSDNPCHRNANCTTVAPGRTECICQKGYVGDGLTCYGNIMERLRELNTEPRGKWQGRLTSFISLLDKAYAWPLSKLGPFTVLLPTDKGLKGFNVNELLVDNKAAQYFVKLHIIAGQMNIEYMNNTDMFYTLTGKSGEIFNSDKDNQIKLKLHGGKKKVKIIQGDIIASNGLLHILDRAMDKLEPTFESNNEQTIMTMLQPRYSKFRSLLEETNLGHALDEDGVGGPYTIFVPNNEALNNMKDGTLDYLLSPEGSRKLLELVRYHIVPFTQLEVATLISTPHIRSMANQLIQFNTTDNGQILANDVAMEEIEITAKNGRIYTLTGVLIPPSIVPILPHRCDETKREMKLGTCVSCSLVYWSRCPANSEPTALFTHRCVYSGRFGSLKSGCARYCNATVKIPKCCKGFYGPDCNQCPGGFSNPCSGNGQCADSLGGNGTCICEEGFQGSQCQFCSDPNKYGPRCNKKCLCVHGTCNNRIDSDGACLTGTCRDGSAGRLCDKQTSACGPYVQFCHIHATCEYSNGTASCICKAGYEGDGTLCSEMDPCTGLTPGGCSRNAECIKTGTGTHTCVCQQGWTGNGRDCSEINNCLLPSAGGCHDNASCLYVGPGQNECECKKGFRGNGIDCEPITSCLEQTGKCHPLASCQSTSSGVWSCVCQEGYEGDGFLCYGNAAVELSFLSEAAIFNRWINNASLQPTLSATSNLTVLVPSQQATEDMDQDEKSFWLSQSNIPALIKYHMLLGTYRVADLQTLSSSDMLATSLQGNFLHLAKVDGNITIEGASIVDGDNAATNGVIHIINKVLVPQRRLTGSLPNLLMRLEQMPDYSIFRGYIIQYNLANAIEAADAYTVFAPNNNAIENYIREKKVLSLEEDVLRYHVVLEEKLLKNDLHNGMHRETMLGFSYFLSFFLHNDQLYVNEAPINYTNVATDKGVIHGLGKVLEIQKNRCDNNDTTIIRGRCRTCSSELTCPFGTKSLGNEKRRCIYTSYFMGRRTLFIGCQPKCVRTVITRECCAGFFGPQCQPCPGNAQNVCFGNGICLDGVNGTGVCECGEGFSGTACETCTEGKYGIHCDQACSCVHGRCNQGPLGDGSCDCDVGWRGVHCDNATTEDNCNGTCHTSANCLTNSDGTASCKCAAGFQGNGTICTAINACEISNGGCSAKADCKRTTPGRRVCTCKAGYTGDGIVCLEINPCLENHGGCDKNAECTQTGPNQAACNCLPAYTGDGKVCTLINVCLTKNGGCSEFAICNHTGQVERTCTCKPNYIGDGFTCRGSIYQELPKNPKTSQYFFQLQEHFVKDLVGPGPFTVFAPLSAAFDEEARVKDWDKYGLMPQVLRYHVVACHQLLLENLKLISNATSLQGEPIVISVSQSTVYINNKAKIISSDIISTNGIVHIIDKLLSPKNLLITPKDNSGRILQNLTTLATNNGYIKFSNLIQDSGLLSVITDPIHTPVTLFWPTDQALHALPAEQQDFLFNQDNKDKLKEYLKFHVIRDAKVLAVDLPTSTAWKTLQGSELSVKCGAGRDIGDLFLNGQTCRIVQRELLFDLGVAYGIDCLLIDPTLGGRCDTFTTFDASGECGSCVNTPSCPRWSKPKGVKQKCLYNLPFKRNLEGCRERCSLVIQIPRCCKGYFGRDCQACPGGPDAPCNNRGVCLDQYSATGECKCNTGFNGTACEMCWPGRFGPDCLPCGCSDHGQCDDGITGSGQCLCETGWTGPSCDTQAVLPAVCTPPCSAHATCKENNTCECNLDYEGDGITCTVVDFCKQDNGGCAKVARCSQKGTKVSCSCQKGYKGDGHSCTEIDPCADGLNGGCHEHATCKMTGPGKHKCECKSHYVGDGLNCEPEQLPIDRCLQDNGQCHADAKCVDLHFQDTTVGVFHLRSPLGQYKLTFDKAREACANEAATMATYNQLSYAQKAKYHLCSAGWLETGRVAYPTAFASQNCGSGVVGIVDYGPRPNKSEMWDVFCYRMKDVNCTCKVGYVGDGFSCSGNLLQVLMSFPSLTNFLTEVLAYSNSSARGRAFLEHLTDLSIRGTLFVPQNSGLGENETLSGRDIEHHLANVSMFFYNDLVNGTTLQTRLGSKLLITASQDPLQPTETRFVDGRAILQWDIFASNGIIHVISRPLKAPPAPVTLTHTGLGAGIFFAIILVTGAVALAAYSYFRINRRTIGFQHFESEEDINVAALGKQQPENISNPLYESTTSAPPEPSYDPFTDSEERQLEGNDPLRTL

SEQ ID NO: 4477 - protein, 445 aa, unidentified
MSKLPRELTRDLERSLPAVASLGSSLSHSQSLSSHLLPPPEKRRAISDVRRTFCLFVTFDLLFISLLWIIELNTNTGIRKNLEQEIIQYNFKTSFFDIFVLAFFRFSGLLLGYAVLRLRHWWVIAVTTLVSSAFLIVKVILSELLSKGAFGYLLPIVSFVLAWLETWFLDFKVLPQEAEEERWYLAAQVAVARGPLLFSGALSEGQFYSPPESFAGSDNESDEEVAGKKSFSAQEREYIRQGKEATAVVDQILAQEENWKFEKNNEYGDTVYTIEVPFHGKTFILKTFLPCPAELVYQEVILQPERMVLWNKTVTACQILQRVEDNTLISYDVSAGAAGGVVSPRDFVNVRRIERRRDRYLSSGIATSHSAKPPTHKYVRGENGPGGFIVLKSASNPRVCTFVWILNTDLKGRLPRYLIHQSLAATMFEFAFHLRQRISELGARA

SEQ ID NO: 4478 - protein, 234 aa, unidentified
MNHLPEDMENALTGSQSSHASLRNIHSINPTQLMARIESYEGREKKGISDVRRTFCLFVTFDLLFVTLLWIIELNVNGGIENTLEKEVMQYDYYSSYFDIFLLAVFRFKVLILAYAVCRLRHWWAIALTTAVTSAFLLAKVILSKLFSQGAFGYVLPIISFILAWIETWFLDFKVLPQEAEEENRLLIVQDASERAALIPGGLSDGQFYSPPESEAGSEEAEEKQDSEKPLLEL

SEQ ID NO: 4479 - protein, 339 aa, unidentified
MESRKDITNQEELWKMKPRRNLEEDDYLHKDTGETSMLKRPVLLHLHQTAHADEFDCPSELQHTQELFPQWHLPIKIAAIIASLTFLYTLLREVIHPLATSHQQYFYKIPILVINKVLPMVSITLLALVYLPGVIAAIVQLHNGTKYKKFPHWLDKWMLTRKQFGLLSFFFAVLHAIYSLSYPMRRSYRYKLLNWAYQQVQQNKEDAWIEHDVWRMEIYVSLGIVGLAILALLAVTSIPSVSDSLTWREFHYIQSKLGIVSLLLGTIHALIFAWNKWIDIKQFVWYTPPTFMIAVFLPIVVLIFKSILFLPCLRKKILKIRHGWEDVTKINKTEICSQL

SEQ ID NO: 4480 - protein, 245 aa, unidentified
MESRKDITNQEEIWKMKPRRNLEDNDYLQTAHADEFDCPSELQHAQELFPQWHLPIKIAAVMASLTFLYTLLREVIHPLATSHQQYFYKIPILVINKVLPMVSITLLALVYLPGVIAAIVQVHNGTKYKKFPHWLDKWMLTRKQFGLLSLFFAVLHAIYTLSYAMRRSYRYKLLNWAYQQVQQNKEDAWIEHDVWRMEIYVSLGIVGLAILALLAVTSIPSVSDSLTWREFHYIQVHGRINFLTL

SEQ ID NO: 4481 - protein, 490 aa, unidentified
MESISMMGSPKSLSETFLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTLWRGPVVVAISLATFFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSERYLFLNMAYQQVHANIENSWNEEEVWRIEMYISFGIMSLGLLSLLAVTSIPSVSNALNWREFSFIQSTLGYVALLISTFHVLIYGWKRAFEEEYYRFYTPPNFVLALVLPSIVILGKIILFLPCISRKLKRIKKGWEKSQFLEEGMGGTIPHVSPERVTVM

SEQ ID NO: 4482 - protein, 488 aa, unidentified
MPEEMDKPLISLHLVDSDSSLAKVPDEAPKVGILGSGDFARSLATRLVGSGFKVVVGSRNPKRTARLFPSAAQVTFQEEAVSSPEVIFVAVFREHYSSLCSLSDQLAGKILVDVSNPTEQEHLQHRESNAEYLASLFPTCTVVKAFNVISAWTLQAGPRDGNRQVPICGDQPEAKRAVSEMALAMGFMPVDMGSLASAWEVEAMPLRLLPAWKVPTLLALGLFVCFYAYNFVRDVLQPYVQESQNKFFKLPVSVVNTTLPCVAYVLLSLVYLPGVLAAALQLRRGTKYQRFPDWLDHWLQHRKQIGLLSFFCAALHALYSFCLPLRRAHRYDLVNLAVKQVLANKSHLWVEEEVWRMEIYLSLGVLALGTLSLLAVTSLPSIANSLNWREFSFVQSSLGFVALVLSTLHTLTYGWTRAFEESRYKFYLPPTFTLTLLVPCVVILAKALFLLPCISRRLARIRRGWERESTIKFTLPTDHALAEKTSHV

SEQ ID NO: 4483 - protein, 459 aa, unidentified
MEKTCIDALPLTMNSSEKQETVCIFGTGDFGRSLGLKMLQCGYSVVFGSRNPQKTTLLPSGAEVLSYSEAAKKSGIIIIAIHREHYDFLTELTEVLNGKILVDISNNLKINQYPESNAEYLAHLVPGAHVVKAFNTISAWALQSGALDASRQVFVCGNDSKAKQRVMDIVRNLGLTPMDQGSLMAAKEIEKYPLQLFPMWRFPFYLSAVLCVFLFFYCVIRDVIYPYVYEKKDNTFRMAISIPNRIFPITALTLLALVYLPGVIAAILQLYRGTKYRRFPDWLDHWMLCRKQLGLVALGFAFLHVLYTLVIPIRYYVRWRLGNLTVTQAILKKENPFSTSSAWLSDSYVALGILGFFLFVLLGITSLPSVSNAVNWREFRFVQSKLGYLTLILCTAHTLVYGGKRFLSPSNLRWYLPAAYVLGLIIPCTVLVIKFVLIMPCVDNTLTRIRQGWERNSKH

SEQ ID NO: 4484 - protein, 685 aa, unidentified
MDVCVRLALWLLWGLLLHQGQSLSHSHSEKATGTSSGANSEESTAAEFCRIDKPLCHSEDEKLSFEAVRNIHKLMDDDANGDVDVEESDEFLREDLNYHDPTVKHSTFHGEDKLISVEDLWKAWKSSEVYNWTVDEVVQWLITYVELPQYEETFRKLQLSGHAMPRLAVTNTTMTGTVLKMTDRSHRQKLQLKALDTVLFGPPLLTRHNHLKDFMLVVSIVIGVGGCWFAYIQNRYSKEHMKKMMKDLEGLHRAEQSLHDLQERLHKAQEEHRTVEVEKVHLEKKLRDEINLAKQEAQRLKELREGTENERSRQKYAEEELEQVREALRKAEKELESHSSWYAPEALQKWLQLTHEVEVQYYNIKKQNAEKQLLVAKEGAEKIKKKRNTLFGTFHVAHSSSLDDVDHKILTAKQALSEVTAALRERLHRWQQIEILCGFQIVNNPGIHSLVAALNIDPSWMGSTRPNPAHFIMTDDVDDMDEEIVSPLSMQSPSLQSSVRQRLTEPQHGLGSQRDLTHSDSESSLHMSDRQRVAPKPPQMSRAADEALNAMTSNGSHRLIEGVHPGSLVEKLPDSPALAKKALLALNHGLDKAHSLMELSPSAPPGGSPHLDSSRSHSPSSPDPDTPSPVGDSRALQASRNTRIPHLAGKKAVAEEDNGSIGEETDSSPGRKKFPLKIFKKPLKK

SEQ ID NO: 4485 - protein, 746 aa, unidentified
MLVLGLLVAGAADGCELVPRHLRGRRATGSAATAASSPAAAAGDSPALMTDPCMSLSPPCFTEEDRFSLEALQTIHKQMDDDKDGGIEVEESDEFIREDMKYKDATNKHSHLHREDKHITIEDLWKRWKTSEVHNWTLEDTLQWLIEFVELPQYEKNFRDNNVKGTTLPRIAVHEPSFMISQLKISDRSHRQKLQLKALDVVLFGPLTRPPHNWMKDFILTVSIVIGVGGCWFAYTQNKTSKEHVAKMMKDLESLQTAEQSLMDLQERLEKAQEENRNVAVEKQNLERKMMDEINYAKEEACRLRELREGAECELSRRQYAEQELEQVRMALKKAEKEFELRSSWSVPDALQKWLQLTHEVEVQYYNIKRQNAEMQLAIAKDEAEKIKKKRSTVFGTLHVAHSSSLDEVDHKILEAKKALSELTTCLRERLFRWQQIEKICGFQIAHNSGLPSLTSSLYSDHSWVVMPRVSIPPYPIAGGVDDLDEDTPPIVSQFPGTMAKPPGSLARSSSLCRSRRSIVPSSPQPQRAQLAPHAPHPSHPRHPHHPQHTPHSLPSPDPDILSVSSCPALYRNEEEEEAIYFSAEKQWEVPDTASECDSLNSSIGRKQSPPLSLEIYQTLSPRKISRDEVSLEDSSRGDSPVTVDVSWGSPDCVGLTETKSMIFSPASKVYNGILEKSCSMNQLSSGIPVPKPRHTSCSSAGNDSKPVQEAPSVARISSIPHDLCHNGEKSKKPSKIKSLFKKKSK

SEQ ID NO: 4486 - protein, 414 aa, unidentified
MIPLEKPGSGGSSPGATSGSGRAGRGLSGPCRPPPPPQARGLLTEIRAVVRTEPFQDGYSLCPGRELGRGKFAVVRKCIKKDSGKEFAAKFMRKRRKGQDCRMEIIHEIAVLELAQDNPWVINLHEVYETASEMILVLEYAAGGEIFDQCVADREEAFKEKDVQRLMRQILEGVHFLHTRDVVHLDLKPQNILLTSESPLGDIKIVDFGLSRILKNSEELREIMGTPEYVAPEILSYDPISMATDMWSIGVLTYVMLTGISPFLGNDKQETFLNISQMNLSYSEEEFDVLSESAVDFIRTLLVKKPEDRATAEECLKHPWLTQSSIQEPSFRMEKALEEANALQEGHSVPEINSDTDKSETKESIVTEELIVVTSYTLGQCRQSEKEKMEQKAISKRFKFEEPLLQEIPGEFIY

SEQ ID NO: 4487 - protein, 372 aa, unidentified
MSRRRFDCRSISGLLTTTPQIPIKMENFNNFYILTSKELGRGKFAVVRQCISKSTGQEYAAKFLKKRRRGQDCRAEILHEIAVLELAKSCPRVINLHEVYENTSEIILILEYAAGGEIFSLCLPELAEMVSENDVIRLIKQILEGVYYLHQNNIVHLDLKPQNILLSSIYPLGDIKIVDFGMSRKIGHACELREIMGTPEYLAPEILNYDPITTATDMWNIGIIAYMLLTHTSPFVGEDNQETYLNISQVNVDYSEETFSSVSQLATDFIQSLLVKNPEKRPTAEICLSHSWLQQWDFENLFHPEETSSSSQTQDHSVRSSEDKTSKSSCNGTCGDREDKENIPEDSSMVSKRFRFDDSLPNPHELVSDLLC

SEQ ID NO: 4488 - protein, 1315 aa, unidentified
MEKYHVLEMIGEGSFGRVYKGRRKYSAQVVALKFIPKLGRSEKELRNLQREIEIMRGLRHPNIVHMLDSFETDKEVVVVTDYAEGELFQILEDDGKLPEDQVQAIAAQLVSALYYLHSHRILHRDMKPQNILLAKGGGIKLCDFGFARAMSTNTMVLTSIKGTPLYMSPELVEERPYDHTADLWSVGCILYELAVGTPPFYATSIFQLVSLILKDPVRWPSTISPCFKNFLQGLLTKDPRQRLSWPDLLYHPFIAGHVTIITEPAGPDLGTPFTSRLPPELQVLKDEQAHRLAPKGNQSRILTQAYKRMAEEAMQKKHQNTGPALEQEDKTSKVAPGTAPLPRLGATPQESSLLAGILASELKSSWAKSGTGEVPSAPRENRTTPDCERAFPEERPEVLGQRSTDVVDLENEEPDSDNEWQHLLETTEPVPIQLKAPLTLLCNPDFCQRIQSQLHEAGGQILKGILEGASHILPAFRVLSSLLSSCSDSVALYSFCREAGLPGLLLSLLRHSQESNSLQQQSWYGTFLQDLMAVIQAYFACTFNLERSQTSDSLQVFQEAANLFLDLLGKLLAQPDDSEQTLRRDSLMCFTVLCEAMDGNSRAISKAFYSSLLTTQQVVLDGLLHGLTVPQLPVHTPQGAPQVSQPLREQSEDIPGAISSALAAICTAPVGLPDCWDAKEQVCWHLANQLTEDSSQLRPSLISGLQHPILCLHLLKVLYSCCLVSEGLCRLLGQEPLALESLFMLIQGKVKVVDWEESTEVTLYFLSLLVFRLQNLPCGMEKLGSDVATLFTHSHVVSLVSAAACLLGQLGQQGVTFDLQPMEWMAAATHALSAPAEVRLTPPGSCGFYDGLLILLLQLLTEQGKASLIRDMSSSEMWTVLWHRFSMVLRLPEEASAQEGELSLSSPPSPEPDWTLISPQGMAALLSLAMATFTQEPQLCLSCLSQHGSILMSILKHLLCPSFLNQLRQAPHGSEFLPVVVLSVCQLLCFPFALDMDADLLIGVLADLRDSEVAAHLLQVCCYHLPLMQVELPISLLTRLALMDPTSLNQFVNTVSASPRTIVSFLSVALLSDQPLLTSDLLSLLAHTARVLSPSHLSFIQELLAGSDESYRPLRSLLGHPENSVRAHTYRLLGHLLQHSMALRGALQSQSGLLSLLLLGLGDKDPVVRCSASFAVGNAAYQAGPLGPALAAAVPSMTQLLGDPQAGIRRNVASALGNLGPEGLGEELLQCEVPQRLLEMACGDPQPNVKEAALIALRSLQQEPGIHQVLVSLGASEKLSLLSLGNQSLPHSSPRPASAKHCRKLIHLLRPAHSM

SEQ ID NO: 4489 - protein, 435 aa, unidentified
MKRRASDRGAGETSARAKALGSGISGNNAKRAGPFILGPRLGNSPVPSIVQCLARKDGTDDFYQLKILTLEERGDQGIESQEERQGKMLLHTEYSLLSLLHTQDGVVHHHGLFQDRTCEIVEDTESSRMVKKMKKRICLVLDCLCAHDFSDKTADLINLQHYVIKEKRLSERETVVIFYDVVRVVEALHQKNIVHRDLKLGNMVLNKRTHRITITNFCLGKHLVSEGDLLKDQRGSPAYISPDVLSGRPYRGKPSDMWALGVVLFTMLYGQFPFYDSIPQELFRKIKAAEYTIPEDGRVSENTVCLIRKLLVLDPQQRLAAADVLEALSAIIASWQSLSSLSGPLQVVPDIDDQMSNADSSQEAKVTEECSQYEFENYMRQQLLLAEEKSSIHDARSWVPKRQFGSAPPVRRLGHDAQPMTSLDTAILAQRYLRK

SEQ ID NO: 4490 - protein, 680 aa, unidentified
MLGPGSNRRRPTQGERGPGSPGEPMEKYQVLYQLNPGALGVNLVVEEMETKVKHVIKQVECMDDHYASQALEELMPLLKLRHAHISVYQELFITWNGEISSLYLCLVMEFNELSFQEVIEDKRKAKKIIDSEWMQNVLGQVLDALEYLHHLDIIHRNLKPSNIILISSDHCKLQDLSSNVLMTDKAKWNIRAEEDPFRKSWMAPEALNFSFSQKSDIWSLGCIILDMTSCSFMDGTEAMHLRKSLRQSPGSLKAVLKTMEEKQIPDVETFRNLLPLMLQIDPSDRITIKDVVHITFLRGSFKSSCVSLTLHRQMVPASITDMLLEGNVASILEVMQKFSGWPEVQLRAMKRLLKMPADQLGLPWPPELVEVVVTTMELHDRVLDVQLCACSLLLHLLGQALVHHPEAKAPCNQAITSTLLSALQSHPEEEPLLVMVYSLLAITTTQESESLSEELQNAGLLEHILEHLNSSLESRDVCASGLGLLWALLLDGIIVNKAPLEKVPDLISQVLATYPADGEMAEASCGVFWLLSLLGCIKEQQFEQVVALLLQSIRLCQDRALLVNNAYRGLASLVKVSELAAFKVVVQEEGGSGLSLIKETYQLHRDDPEVVENVGMLLVHLASYEEILPELVSSSMKALLQEIKERFTSSLVSDSSAFSKPGLPPGGSPQLGCTTSGGLE

SEQ ID NO: 4491 - protein, 288 aa, unidentified [sequence omitted]

SEQ ID NO: 4492 - protein, 398 aa, unidentified
MLGRSGYRALPLGDFDRFQQSSFGFLGSQKGCLSPERGGVGTGADVPQSWPSCLCHGLISFLGFLLLLVTFPISGWFALKIVPTYERMIVFRLGRIRTPQGPGMVLLLPFIDSFQRVDLRTRAFNVPPCKLASKDGAVLSVGADVQFRIWDPVLSVMTVKDLNTATRMTAQNAMTKALLKRPLREIQMEKLKISDQLLLEINDVTRAWGLEVDRVELAVEAVLQPPQDSPAGPNLDSTLQQLALHFLGGSMNSMAGGAPSPGPADTVEMVSEVEPPAPQVGARSSPKQPLAEGLLTALQPFLSEALVSQVGACYQFNVVLPSGTQSAYFLDLTTGRGRVGHGVPDGIPDVVVEMAEADLRALLCRELRPLGAYMSGRLKVKGDLAMAMKLEAVLRALK

SEQ ID NO: 4493 - protein, 291 aa, unidentified
MDSRVSSPEKQDKENFVGVNNKRLGVCGWILFSLSFLLVIITFPISIWMCLKIIKEYERAVVFRLGRIQADKAKGPGLILVLPCIDVFVKVDLRTVTCNIPPQEILTRDSVTTQVDGVVYYRIYSAVSAVANVNDVHQATFLLAQTTLRNVLGTQTLSQILAGREEIAHSIQTLLDDATELWGIRVARVEIKDVRIPVQLQRSMAAEAEATREARAKVLAAEGEMNASKSLKSASMVLAESPIALQLRYLQTLSTVATEKNSTIVFPLPMNILEGIGGVSYDNHKKLPNKA

SEQ ID NO: 4494 - protein, 905 aa, unidentified
MTTLDHVIATHQSEWVSFNEEPPFPAHSQGGTEEHLPGLSSSPDQSESSSGENHVVDGGSQDHSHSEQDDSSEKMGLISEAASPPGSPEQPPPDLASAISNWVQFEDDTPWASTSPPHQETAETALPLTMPCWTCPSFDSLGRCPLTSESSWTTHSEDTSSPSFGCSYTDLQLINAEEQTSGQASGADSTDNSSSLQEDEEVEMEAISWQASSPAMNGHPAPPVTSARFPSWVTFDDNEVSCPLPPVTSPLKPNTPPSASVIPDVPYNSMGSFKKRDRPKSTLMNFSKVQKLDISSLNRTPSVTEASPWRATNPFLNETLQDVQPSPINPFSAFFEEQERRSQNSSISSTTGKSQRDSLIVIYQDAISFDDSSKTQSHSDAVEKLKQLQIDDPDHFGSATLPDDDPVAWIELDAHPPGSARSQPRDGWPMMLRIPEKKNIMSSRHWGPIFVKLTDTGYLQLYYEQGLEKPFREFKLEICHEISEPRLQNYDENGRIHSLRIDRVTYKEKKKYQPKPAVAHTAEREQVIKLGTTNYDDFLSFIHAVQDRLMDLPVLSMDLSTVGLNYLEEEITVDVRDEFSGIVSKGDNQILQHHVLTRIHILSFLSGLAECRLGLNDILVKGNEIVLRQDIMPTTTTKWIKLHECRFHGCVDEDVFHNSRVILFNPLDACRFELMRFRTVFAEKTLPFTLRTATSVNGAEVEVQSWLRMSTGFSANRDPLTQVPCENVMIRYPVPSEWVKNFRRESVLGEKSLKAKVNRGASFGSTSVSGSEPVMRVTLGTAKYEHAFNSIVWRINRLPDKNSASGHPHCFFCHLELGSDREVPSRFANHVNVEFSMPTTSASKASVRSISVEDKTDVRKWVNYSAHYSYQVALGSIWLMLPTPFVHPTTLPLLFLLAMLTMFAW

SEQ ID NO: 4495 - protein, 667 aa, unidentified
MSSQPAGNQTSPGATEDYSYGSWYIDEPQGGEELQPEGEVPSCHTSIPPGLYHACLASLSILVLLLLAMLVRRRQLWPDCVRGRPGLPSPVDFLAGDRPRAVPAAVFMVLLSSLCLLLPDEDALPFLTLASAPSQDGKTEAPRGAWKILGLFYYAALYYPLAACATAGHTAAHLLGSTLSWAHLGVQVWQRAECPQVPKIYKYYSLLASLPLLLGLGFLSLWYPVQLVRSFSRRTGAGSKGLQSSYSEEYLRNLLCRKKLGSSYHTSKHGFLSWARVCLRHCIYTPQPGFHLPLKLVLSATLTGTAIYQVALLLLVGVVPTIQKVRAGVTTDVSYLLAGFGIVLSEDKQEVVELVKHHLWALEVCYISALVLSCLLTFLVLMRSLVTHRTNLRALHRGAALDLSPLHRSPHPSRQAIFCWMSFSAYQTAFICLGLLVQQIIFFLGTTALAFLVLMPVLHGRNLLLFRSLESSWPFWLTLALAVILQNMAAHWVFLETHDGHPQLTNRRVLYAATFLLFPLNVLVGAMVATWRVLLSALYNAIHLGQMDLSLLPPRAATLDPGYYTYRNFLKIEVSQSHPAMTAFCSLLLQAQSLLPRTMAAPQDSLRPGEEDEGMQLLQTKDSMAKGARPGASRGRARWGLAYTLLHNPTLQVFRKTALLGANGAQP

SEQ ID NO: 4496 - protein, 753 aa, unidentified
MMEERAAAAVAAAASSCRPLGSGAGPGPTGAAPVSAPAPGPGPAGKGGGGGGSPGPTAGPEPLSLPGILHFIQHEWARFEAEKARWEAERAELQAQVAFLQGERKGQENLKTDLVRRIKMLEYALKQERAKYHKLKFGTDLNQGEKKADVSEQVSNGPVESVTLENSPLVWKEGRQLLRQYLEEVGYTDTILDMRSKRVRSLLGRSLELNGAVEPSEGAPRAPPGPAGLSGGESLLVKQIEEQIKRNAAGKDGKERLGGSVLGQIPFLQNCEDEDSDEDDELDSVQHKKQRVKLPSKALVPEMEDEDEEDDSEDAINEFDFLGSGEDGEGAPDPRRCTVDGSPHELESRRVKLQGILADLRDVDGLPPKVTGPPPGTPQPRPHEDVFIMDTIGGGEVSLGDLADLTVTNDNDLSCDLSDSKDAFKKTWNPKFTLRSHYDGIRSLAFHHSQSALLTASEDGTLKLWNLQKAVTAKKNAALDVEPIHAFRAHRGPVLAVAMGSNSEYCYSGGADACIHSWKIPDLSMDPYDGYDPSVLSHVLEGHGDAVWGLAFSPTSQRLASCSADGTVRIWDPSSSSPACLCTFPTASEHGVPTSVAFTSTEPAHIVASFRSGDTVLYDMEVGSALLTLESRGSSGPTQINQVVSHPNQPLTITAHDDRGIRFLDNRTGKPVHSMVAHLDAVTCLAVDPNGAFLMSGSHDCSLRLWSLDNKTCVQEITAHRKKHEEAIHAVACHPSKALIASAGADALAKVFV

SEQ ID NO: 4497 - protein, 583 aa, unidentified
MPLRKMKIPFLLLFFLWEAESHAASRPNIILVMADDLGIGDPGCYGNKTIRTPNIDRLASGGVKLTQHLAASPLCTPSRAAFMTGRYPVRSGMASWSRTGVFLFTASSGGLPTDEITFAKLLKDQGYSTALIGKWHLGMSCHSKTDFCHHPLHHGFNYFYGISLTNLRDCKPGEGSVFTTGFKRLVFLPLQIVGVTLLTLAALNCLGLLHVPLGVFFSLLFLAALILTLFLGFLHYFRPLNCFMMRNYEIIQQPMSYDNLTQRLTVEAAQFIQRNTETPFLLVLSYLHVHTALFSSKDFAGKSQHGVYGDAVEEMDWSVGQILNLLDELRLANDTLIYFTSDQGAHVEEVSSKGEIHGGSNGIYKGGKANNWEGGIRVPGILRWPRVIQAGQKIDEPTSNMDIFPTVAKLAGAPLPEDRIIDGRDLMPLLEGKSQRSDHEFLFHYCNAYLNAVRWHPQNSTSIWKAFFFTPNFNPVGSNGCFATHVCFCFGSYVTHHDPPLLFDISKDPRERNPLTPASEPRFYEILKVMQEAADRHTQTLPEVPDQFSWNNFLWKPWLQLCCPSTGLSCQCDREKQDKRLSR

SEQ ID NO: 4498 - protein, 705 aa, unidentified
MTKFGFLRLSYEKQDTLLKLLILSMAAVLSFSTRLFAVLRFESVIHEFDPYFNYRTTRFLAEEGFYKFHNWFDDRAWYPLGRIIGGTIYPGLMITSAAIYHVLHFFHITIDIRNVCVFLAPLFSSFTTIVTYHLTKELKDAGAGLLAAAMIAVVPGYISRSVAGSYDNEGIAIFCMLLTYYMWIKAVKTGSICWAAKCALAYFYMVSSWGGYVFLINLIPLHVLVLMLTGRFSHRIYVAYCTVYCLGTILSMQISFVGFQPVLSSEHMAAFGVFGLCQIHAFVDYLRSKLNPQQFEVLFRSVISLVGFVLLTVGALLMLTGKISPWTGRFYSLLDPSYAKNNIPIIASVSEHQPTTWSSYYFDLQLLVFMFPVGLYYCFSNLSDARIFIIMYGVTSMYFSAVMVRLMLVLAPVMCILSGIGVSQVLSTYMKNLDISRPDKKSKKQQDSTYPIKNEVASGMILVMAFFLITYTFHSTWVTSEAYSSPSIVLSARGGDGSRIIFDDFREAYYWLRHNTPEDAKVMSWWDYGYQITAMANRTILVDNNTWNNTHISRVGQAMASTEEKAYEIMRELDVSYVLVIFGGLTGYSSDDINKFLWMVRIGGSTDTGKHIKENDYYTPTGEFRVDREGSPVLLNCLMYKMCYYRFGQVYTEAKRPPGFDRVRNAEIGNKDFELDVLEEAYTTEHWLVRIYKVKDLDNRGLSRT

SEQ ID NO: 4499 - protein, 826 aa, unidentified
MAEPSAPESKHKSSLNSSPWSGLMALGNSRHGHHGPGAQCAHKAAGGAAPPKPAPAGLSGGLSQPAGWQSLLSFTILFLAWLAGFSSRLFAVIRFESIIHEFDPWFNYRSTHHLASHGFYEFLNWFDERAWYPLGRIVGGTVYPGLMITAGLIHWILNTLNITVHIRDVCVFLAPTFSGLTSISTFLLTRELWNQGAGLLAACFIAIVPGYISRSVAGSFDNEGIAIFALQFTYYLWVKSVKTGSVFWTMCCCLSYFYMVSAWGGYVFIINLIPLHVFVLLLMQRYSKRVYIAYSTFYIVGLILSMQIPFVGFQPIRTSEHMAAAGVFALLQAYAFLQYLRDRLTKQEFQTLFFLGVSLAAGAVFLSVIYLTYTGYIAPWSGRFYSLWDTGYAKIHIPIIASVSEHQPTTWVSFFFDLHILVCTFPAGLWFCIKNINDERVFVALYAISAVYFAGVMVRLMLTLTPVVCMLSAIAFSNVFEHYLGDDMKRENPPVEDSSDEDDKRNQGNLYDKAGKVRKHATEQEKTEEGLGPNIKSIVTMLMLMLLMMFAVHCTWVTSNAYSSPSVVLASYNHDGTRNILDDFREAYFWLRQNTDEHARVMSWWDYGYQIAGMANRTTLVDNNTWNNSHIALVGKAMSSNETAAYKIMRTLDVDYVLVIFGGVIGYSGDDINKFLWMVRIAEGEHPKDIRESDYFTPQGEFRVDKAGSPTLLNCLMYKMSYYRFGEMQLDFRTPPGFDRTRNAEIGNKDIKFKHLEEAFTSEHWLVRIYKVKAPDNRETLDHKPRVTNIFPKQKYLSKKTTKRKRGYIKNKLVFKKGKKISKKTV

SEQ ID NO: 4500 - protein, 141 aa, unidentified
MEPSHKDAETAAAAAAVAAADPRGASSSSGVVVQVREKKGPLRAAIPYMPFPVAVICLFLNTFVPGLGTFVSAFTVLCGARTDLPDRHVCCVFWLNIAAALIQILTAIVMVGWIMSIFWGMDMVILAISQGYKEQGIPQQL

SEQ ID NO: 4501 - protein, 249 aa, unidentified
MSLEDPFFVVRGEVQKAVNTARGLYQRWCELLQESAAVGREELDWTTNELRNGLRSIEWDLEDLEETIGIVEANPGKFKLPAGDLQERKVFVERMREAVQEMKDHMVSPTAVAFLERNNREILAGKPAAQKSPSDLLDASAVSATSRYIEEQQATQQLIMDEQDQQLEMVSGSIQVLKHMSGRVGEELDEQGIMLDAFAQEMDHTQSRMDGVLRKLAKVSHMTSDRRQWCAIAVLVGVLLLVLILLFSL

SEQ ID NO: 4502 - protein, 276 aa, unidentified
MSYGPLDMYRNPGPSGPQLRDFSSIIQTCSGNIQRISQATAQIKNLMSQLGTKQDSSKLQENLQQLQHSTNQLAKETNELLKELGSLPLPLSTSEQRQQRLQKERLMNDFSAALNNFQAVQRRVSEKEKESIARARAGSRLSAEERQREEQLVSFDSHEEWNQMQSQEDEVAITEQDLELIKERETAIRQLEADILDVNQIFKDLAMMIHDQGDLIDSIEANVESSEVHVERATEQLQRAAYYQKKSRKKMCILVLVLSVIILILGLIIWLVYKTK

SEQ ID NO: 4503 - protein, 325 aa, unidentified
MATRRLTDAFLLLRNNSIQNRQLLAEQVSSHITSSPLHSRSIAAELDELADDRMALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRGFTEDQLVLVEQNTLMVEEREREIRQIVQSISDLNEIFRDLGAMIVEQGTVLDRIDYNVEQSCIKTEDGLKQLHKAEQYQKKNRKMLVILILFVIIIVLIVVLVGVKSR

SEQ ID NO: 4504 - protein, 302 aa, unidentified
MSEDEEKVKLRRLEPAIQKFIKIVIPTDLERLRKHQINIEKYQRCRIWDKLHEEHINAGRTVQQLRSNIREIEKLCLKVRKDDLVLLKRMIDPVKEEASAATAEFLQLHLESVEELKKQFNDEETLLQPPLTRSMTVGGAFHTTEAEASSQSLTQIYALPEIPQDQNAAESWETLEADLIELSQLVTDFSLLVNSQQEKIDSIADHVNSAAVNVEEGTKNLGKAAKYKLAALPVAGALIGGMVGGPIGLLAGFKVAGIAAALGGGVLGFTGGKLIQRKKQKMMEKLTSSCPDLPSQTDKKCS

SEQ ID NO: 4505 - protein, 335 aa, unidentified
MAVDITLLFRASVKTVKTRNKALGVAVGGGVDGSRDELFRRSPRPKGDFSSRAREVISHIGKLRDFLLEHRKDYINAYSHTMSEYGRMTDTERDQIDQDAQIFMRTCSEAIQQLRTEAHKEIHSQQVKEHRTAVLDFIEDYLKRVCKLYSEQRAIRVKRVVDKKRLSKLEPEPNTKTRESTSSEKVSQSPSKDSEENPATEERPEKILAETQPELGTWGDGKGEDELSPEEIQMFEQENQRLIGEMNSLFDEVRQIEGRVVEISRLQEIFTEKVLQQEAEIDSIHQLVVGATENIKEGNEDIREAIKNNAGFRVWILFFLVMCSFSLLFLDWYDS

SEQ ID NO: 4506 - protein, 288 aa, unidentified
MKDRTQELRTAKDSDDDDDVAVTVDRDRFMDEFFEQVEEIRGFIDKIAENVEEVKRKHSAILASPNPDEKTKEELEELMSDIKKTANKVRSKLKSIEQSIEQEEGLNRSSADLRIRKTQHSTLSRKFVEVMSEYNATQSDYRERCKGRIQRQLEITGRTTTSEELEDMLESGNPAIFASGIIMDSSISKQALSEIETRHSEIIKLENSIRELHDMFMDMAMLVESQGEMIDRIEYNVEHAVDYVERAVSDTKKAVKYQSKARRKKIMIIICCVILGIVIASTVGGIFA

SEQ ID NO: 4507 - protein, 288 aa, unidentified
MKDRTQELRSAKDSDDEEEVVHVDRDHFMDEFFEQVEEIRGCIEKLSEDVEQVKKQHSAILAAPNPDEKTKQELEDLTADIKKTANKVRSKLKAIEQSIEQEEGLNRSSADLRIRKTQHSTLSRKFVEVMTEYNATQSKYRDRCKDRIQRQLEITGRTTTNEELEDMLESGKLAIFTDDIKMDSQMTKQALNEIETRHNEIIKLETSIRELHDMFVDMAMLVESQGEMIDRIEYNVEHSVDYVERAVSDTKKAVKYQSKARRKKIMIIICCVVLGVVLASSIGGTLGL

SEQ ID NO: 4508 - protein, 288 aa, unidentified
MRDRLPDLTACRKNDDGDTVVVVEKDHFMDDFFHQVEEIRNSIDKITQYVEEVKKNHSIILSAPNPEGKIKEELEDLNKEIKKTANKIRAKLKAIEQSFDQDESGNRTSVDLRIRRTQHSVLSRKFVEAMAEYNEAQTLFRERSKGRIQRQLEITGRTTTDDELEEMLESGKPSIFTSDIISDSQITRQALNEIESRHKDIMKLETSIRELHEMFMDMAMFVETQGEMINNIERNVMNATDYVEHAKEETKKAIKYQSKARRKKWIIIAVSVVLVAIIALIIGLSVGK

SEQ ID NO: 4509 - protein, 289 aa, unidentified
MKDRLEQLKAKQLTQDDDTDAVEIAIDNTAFMDEFFSEIEETRLNIDKISEHVEEAKKLYSIILSAPIPEPKTKDDLEQLTTEIKKRANNVRNKLKSMEKHIEEDEVRSSADLRIRKSQHSVLSRKFVEVMTKYNEAQVDFRERSKGRIQRQLEITGKKTTDEELEEMLESGNPAIFTSGIIDSQISKQALSEIEGRHKDIVRLESSIKELHDMFMDIAMLVENQGEMLDNIELNVMHTVDHVEKARDETKKAVKYQSQARKKLIIIIVLVVVLLGILALIIGLSVGLN

SEQ ID NO: 4510 - protein, 297 aa, unidentified
MRDRTHELRQGDDSSDEEDKERVALVVHPGTARLGSPDEEFFHKVRTIRQTIVKLGNKVQELEKQQVTILATPLPEESMKQELQNLRDEIKQLGREIRLQLKAIEPQKEEADENYNSVNTRMRKTQHGVLSQQFVELINKCNSMQSEYREKNVERIRRQLKITNAGMVSDEELEQMLDSGQSEVFVSNILKDTQVTRQALNEISARHSEIQQLERSIRELHDIFTFLATEVEMQGEMINRIEKNILSSADYVERGQEHVKTALENQKKARKKKVLIAICVSITVVLLAVIIGVTVVG

SEQ ID NO: 4511 - protein, 355 aa, unidentified
MIPRKRYGSKNTDQGVYLGLSKTQVLSPATAGSSSSDIAPLPPPVTLVPPPPDTMSCRDRTQEFLSACKSLQTRQNGIQTNKPALRAVRQRSEFTLMAKRIGKDLSNTFAKLEKLTILAKRKSLFDDKAVEIEELTYIIKQDINSLNKQIAQLQDFVRAKGSQSGRHLQTHSNTIVVSLQSKLASMSNDFKSVLEVRTENLKQQRSRREQFSRAPVSALPLAPNHLGGGAVVLGAESHASKDVAIDMMDSRTSQQLQLIDEQDSYIQSRADTMQNIESTIVELGSIFQQLAHMVKEQEETIQRIDENVLGAQLDVEAAHSEILKYFQSVTSNRWLMVKIFLILIVFFIIFVVFLA

SEQ ID NO: 4512 - protein, 255 aa, unidentified
MSMEDPFFVVKGEVQKAVNTAQGLFQRWTELLQDPSTATREEIDWTTNELRNNLRSIEWDLEDLDETISIVEANPRKFNLDATELSIRKAFITSTRQVVRDMKDQMSTSSVQALAERKNRQALLGDSGSQNWSTGTTDKYGRLDRELQRANSHFIEEQQAQQQLIVEQQDEQLELVSGSIGVLKNMSQRIGGELEEQAVMLEDFSHELESTQSRLDNVMKKLAKVSHMTSDRRQWCAIAILFAVLLVVLILFLVL

SEQ ID NO: 4513 - protein, 261 aa, unidentified
MSYTPGVGGDPAQLAQRISSNIQKITQCSVEIQRTLNQLGTPQDSPELRQQLQQKQQYTNQLAKETDKYIKEFGSLPTTPSEQRQRKIQKDRLVAEFTTSLTNFQKVQRQAAEREKEFVARVRASSRVSGSFPEDSSKERNLVSWESQTQPQVQVQDEEITEDDLRLIHERESSIRQLEADIMDINEIFKDLGMMIHEQGDVIDSIEANVENAEVHVQQANQQLSRAADYQRKSRKTLCIIILILVIGVAIISLIIWGLNH

SEQ ID NO: 4514 - protein, 236 aa, unidentified
MAPDPWFSTYDSTCQIAQEIAEKIQQRNQYERKGEKAPKLTVTIRALLQNLKEKIALLKDLLLRAVSTHQITQLEGDRRQNLLDDLVTRERLLLASFKNEGAEPDLIRSSLMSEEAKRGAPNPWLFEEPEETRGLGFDEIRQQQQKIIQEQDAGLDALSSIISRQKQMGQEIGNELDEQNEIIDDLANLVENTDEKLRNETRRVNMVDRKSASCGMIMVILLLLVAIVVVAVWPTN

SEQ ID NO: 4515 - protein, 422 aa, unidentified
MGMTRMLLECSLSDKLCVIQEKQYEVIIVPTLLVTIFLILLGVILWLFIREQRTQQQRSGPQGIAPVPPPRDLSWEAGHGGNVALPLKETSVENFLGATTPALAKLQVPREQLSEVLEQICSGSCGPIFRANMNTGDPSKPKSVILKALKEPAGLHEVQDFLGRIQFHQYLGKHKNLVQLEGCCTEKLPLYMVLEDVAQGDLLSFLWTCRRDVMTMDGLLYDLTEKQVYHIGKQVLLALEFLQEKHLFHGDVAARNILMQSDLTAKLCGLGLAYEVYTRGAISSTQTIPLKWLAPERLLLRPASIRADVWSFGILLYEMVTLGAPPYPEVPPTSILEHLQRRKIMKRPSSCTHTMYSIMKSCWRWREADRPSPRELRLRLEAAIKTADDEAVLQVPELVVPELYAAVAGIRVESLFYNYSML

SEQ ID NO: 4516 - protein, 334 aa, unidentified
MLGIMAWNATCKNWLAAEAALEKYYLSIFYGIEFVVGVLGNTIVVYGYIFSLKNWNSSNIYLFNLSVSDLAFLCTLPMLIRSYANGNWIYGDVLCISNRYVLHANLYTSILFLTFISIDRYLIIKYPFREHLLQKKEFAILISLAIWVLVTLELLPILPLINPVITDNGTTCNDFASSGDPNYNLIYSMCLTLLGFLIPLFVMCFFYYKIALFLKQRNRQVATALPLEKPLNLVIMAVVIFSVLFTPYHVMRNVRIASRLGSWKQYQCTQVVINSFYIVTRPLAFLNSVINPVFYFLLGDHFRDMLMNQLRHNFKSLTSFSRWAHELLLSFREK

SEQ ID NO: 4517 - protein, 1254 aa, unidentified
MKKHRRALALVSCLFLCSLVWLPSWRVCCKESSSASASSYYSQDDNCALENEDVQFQKKDEREGPINAESLGKSGSNLPISPKEHKLKDDSIVDVQNTESKKLSPPVVETLPTVDLHEESSNAVVDSETVENISSSSTSEITPISKLDEIEKSGTIPIAKPSETEQSETDCDVGEALDASAPIEQPSFVSPPDSLVGQHIENVSSSHGKGKITKSEFESKVSASEQGGGDPKSALNASDNLKNESSDYTKPGDIDPTSVASPKDPEDIPTFDEWKKKVMEVEKEKSQSMHASSNGGSHATKKVQKNRNNYASVECGAKILAANPEAKSTSAILIENMDLYMLNPCSTKIWFVIELCEPIQVKQLDIANYELFSSTPKDFLVSISDRYPTNKWIKLGTFHGRDERNVQSFPLDEQMYAKYVKMFIKYIKVELLSHFGSEHFCPLSLIRVFGTSMVEEYEEIADSQYHSERQELFDEDYDYPLDYNTGEDKSSKNLLGSATNAILNMVNIAANILGAKTEDLTEGNKSISENATATAAPKMPESTPVSTPVPSPEYVTTEVHTHDMEPSTPDTPKESPIVQLVQEEEEEASPSTVTLLGSGEQEDESSPWFESETQIFCSELTTICCISSFSEYIYKWCSVRVALYRQRSRTALSKGKDYLVLAQPPLLLPAESVDVSVLQPLSGELENTNIEREAETVVLGDLSSSMHQDDLVNHTVDAVELEPSHSQTLSQSLLLDITPEINPLPKIEVSESVEYEAGHIPSPVIPQESSVEIDNETEQKSESFSSIEKPSITYETNKVNELMDNIIKEDVNSMQIFTKLSETIVPPINTATVPDNEDGEAKMNIADTAKQTLISVVDSSSLPEVKEEEQSPEDALLRGLQRTATDFYAELQNSTDLGYANGNLVHGSNQKESVFMRLNNRIKALEVNMSLSGRYLEELSQRYRKQMEEMQKAFNKTIVKLQNTSRIAEEQDQRQTEAIQLLQAQLTNMTQLVSNLSATVAELKREVSDRQSYLVISLVLCVVLGLMLCMQRCRNTSQFDGDYISKLPKSNQYPSPKRCFSSYDDMNLKRRTSFPLMRSKSLQLTGKEVDPNDLYIVEPLKFSPEKKKKRCKYKIEKIETIKPEEPLHPIANGDIKGRKPFTNQRDFSNMGEVYHSSYKGPPSEGSSETSSQSEESYFCGISACTSLCNGQSQKTKTEKRALKRRRSKVQDQGKLIKTLIQTKSGSLPSLHDIIKGNKEITVGTFGVTAVSGHI

SEQ ID NO: 4518 - protein, 812 aa, unidentified
MDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAAPGPVSRVYSRDRNQKCDDCKGKRHLDAHPGRAGTLWHIWACAGYFLLQILRRIGAVGQAVSRTAWSALWLAVVAPGKAASGVFWWLGIGWYQFVTLISWLNVFLLTRCLRNICKFLVLLIPLFLLLAGLSLRGQGNFFSFLPVLNWASMHRTQRVDDPQDVFKPTTSRLKQPLQGDSEAFPWHWMSGVEQQVASLSGQCHHHGENLRELTTLLQKLQARVDQMEGGAAGPSASVRDAVGQPPRETDFMAFHQEHEVRMSHLEDILGKLREKSEAIQKELEQTKQKTISAVGEQLLPTVEHLQLELDQLKSELSSWRHVKTGCETVDAVQERVDVQVREMVKLLFSEDQQGGSLEQLLQRFSSQFVSKGDLQTMLRDLQLQILRNVTHHVSVTKQLPTSEAVVSAVSEAGASGITEAQARAIVNSALKLYSQDKTGMVDFALESGGGSILSTRCSETYETKTALMSLFGIPLWYFSQSPRVVIQPDIYPGNCWAFKGSQGYLVVRLSMMIHPAAFTLEHIPKTLSPTGNISSAPKDFAVYGLENEYQEEGQLLGQFTYDQDGESLQMFQALKRPDDTAFQIVELRIFSNWGHPEYTCLYRFRVHGEPVK

SEQ ID NO: 4519 - protein, 717 aa, unidentified
MSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWGEDLRVRRRRGTGGSESSRASGLVGRKATEDFLGSSSGYSSEDDYVGYSDVDQQSSSSRLRSAVSRAGSLLWMVATSPGRLFRLLYWWAGTTWYRLTTAASLLDVFVLTRRFSSLKTFLWFLLPLLLLTCLTYGAWYFYPYGLQTFHPALVSWWAAKDSRRPDEGWEARDSSPHFQAEQRVMSRVHSLERRLEALAAEFSSNWQKEAMRLERLELRQGAPGQGGGGGLSHEDTLALLEGLVSRREAALKEDFRRETAARIQEELSALRAEHQQDSEDLFKKIVRASQESEARIQQLKSEWQSMTQESFQESSVKELRRLEDQLAGLQQELAALALKQSSVAEEVGLLPQQIQAVRDDVESQFPAWISQFLARGGGGRVGLLQREEMQAQLRELESKILTHVAEMQGKSAREAAASLSLTLQKEGVIGVTEEQVHHIVKQALQRYSEDRIGLADYALESGGASVISTRCSETYETKTALLSLFGIPLWYHSQSPRVILQPDVHPGNCWAFQGPQGFAVVRLSARIRPTAVTLEHVPKALSPNSTISSAPKDFAIFGFDEDLQQEGTLLGKFTYDQDGEPIQTFHFQAPTMATYQVVELRILTNWGHPEYTCIYRFRVHGEPAH

SEQ ID NO: 4520 - protein, 357 aa, unidentified
MSGKTKARRAAMFFRRCSEDASGSASGNALLSEDENPDANGVTRSWKIILSTMLTLTFLLVGLLNHQWLKETDVPQKSRQLYAIIAEYGSRLYKYQARLRMPKEQLELLKKESQNLENNFRQILFLIEQIDVLKALLRDMKDGMDNNHNWNTHGDPVEDPDHTEEVSNLVNYVLKKLREDQVEMADYALKSAGASIIEAGTSESYKNNKAKLYWHGIGFLNHEMPPDIILQPDVYPGKCWAFPGSQGHTLIKLATKIIPTAVTMEHISEKVSPSGNISSAPKEFSVYGITKKCEGEEIFLGQFIYNKTGTTVQTFELQHAVSEYLLCVKLNIFSNWGHPKYTCLYRFRVHGTPGKHI

SEQ ID NO: 4521 - protein, 379 aa, unidentified
MPRSSRSPGDPGALLEDVAHNPRPRRIAQRGRNTSRMAEDTSPNMNDNILLPVRNNDQALGLTQCMLGCVSWFTCFACSLRTQAQQVLFNTCRCKLLCQKLMEKTGILLLCAFGFWMFSIHLPSKMKVWQDDSINGPLQSLRLYQEKVRHHSGEIQDLRGSMNQLIAKLQEMEAMSDEQKMAQKIMKMIHGDYIEKPDFALKSIGASIDFEHTSVTYNHEKAHSYWNWIQLWNYAQPPDVILEPNVTPGNCWAFEGDRGQVTIQLAQKVYLSNLTLQHIPKTISLSGSLDTAPKDFVIYGMEGSPKEEVFLGAFQFQPENIIQMFPLQNQPARAFSAVKVKISSNWGNPGFTCLYRVRVHGSVAPPREQPHQNPYPKRD

SEQ ID NO: 4522 - protein, 300 aa, unidentified
MAAVAALQLGLRAAGLGRAPASAAWRSVLRVSPRPGVAWRPSRCGSSAAEASATKAEDDSFLQWVLLLIPVTAFGLGTWQVQRRKWKLNLIAELESRVLAEPVPLPADPMELKNLEYRPVKVRGCFDHSKELYMMPRTMVDPVREAREGGLISSSTQSGAYVVTPFHCTDLGVTILVNRGFVPRKKVNPETRQKGQIEGEVDLIGMVRLTETRQPFVPENNPERNHWHYRDLEAMARITGAEPIFIDANFQSTVPGGPIGGQTRVTLRNEHLQYIVTWYGLSAATSYLWFKKFLRGTPGV

SEQ ID NO: 4523 - protein, 269 aa, unidentified
MGQNDLMGTAEDFADQFLRVTKQYLPHVARLCLISTFLEDGIRMWFQWSEQRDYIDTTWNCGYLLASSFVFLNLLGQLTGCVLVLSRNFVQYACFGLFGIIALQTIAYSILWDLKFLMRNLALGGGLLLLLAESRSEGKSMFAGVPTMRESSPKQYMQLGGRVLLVLMFMTLLHFDASFFSIVQNIVGTALMILVAIGFKTKLAALTLVVWLFAINVYFNAFWTIPVYKPMHDFLKYDFFQTMSVIGGLLLVVALGPGGVSMDEKKKEW

SEQ ID NO: 4524 - protein, 747 aa, unidentified
MGRGPWDAGPSRRLLPLLLLLGLARGAAGAPGPDGLDVCATCHEHATCQQREGKKICICNYGFVGNGRTQCVDKNECQFGATLVCGNHTSCHNTPGGFYCICLEGYRATNNNKTFIPNDGTFCTDIDECEVSGLCRHGGRCVNTHGSFECYCMDGYLPRNGPEPFHPTTDATSCTEIDCGTPPEVPDGYIIGNYTSSLGSQVRYACREGFFSVPEDTVSSCTGLGTWESPKLHCQEINCGNPPEMRHAILVGNHSSRLGGVARYVCQEGFESPGGKITSVCTEKGTWRESTLTCTEILTKINDVSLFNDTCVRWQINSRRINPKISYVISIKGQRLDPMESVREETVNLTTDSRTPEVCLALYPGTNYTVNISTAPPRRSMPAVIGFQTAEVDLLEDDGSFNISIFNETCLKLNRRSRKVGSEHMYQFTVLGQRWYLANFSHATSFNFTTREQVPVVCLDLYPTTDYTVNVTLLRSPKRHSVQITIATPPAVKQTISNISGFNETCLRWRSIKTADMEEMYLFHIWGQRWYQKEFAQEMTFNISSSSRDPEVCLDLRPGTNYNVSLRALSSELPVVISLTTQITEPPLPEVEFFTVHRGPLPRLRLRKAKEKNGPISSYQVLVLPLALQSTFSCDSEGASSFFSNASDADGYVAAELLAKDVPDDAMEIPIGDRLYYGEYYNAPLKRGSDYCIILRITSEWNKVRRHSCAVWAQVKDSSLMLLQMAGVGLGSLAVVIILTFLSFSAV

SEQ ID NO: 4525 - protein, 822 aa, unidentified
MKPALLPWALLLLATALGPGPGPTADAQESCSMRCGALDGPCSCHPTCSGLGTCCLDFRDFCLEILPYSGSMMGGKDFVVRHFKMSSPTDASVICRFKDSIQTLGHVDSSGQVHCVSPLLYESGRIPFTVSLDNGHSFPRAGTWLAVHPNKVSMMEKSELVNETRWQYYGTANTSGNLSLTWHVKSLPTQTITIELWGYEETGMPYSQEWTAKWSYLYPLATHIPNSGSFTFTPKPAPPSYQRWRVGALRIIDSKNYAGQKDVQALWTNDHALAWHLSDDFREDPVAWARTQCQAWEELEDQLPNFLEELPDCPCTLTQARADSGRFFTDYGCDMEQGSVCTYHPGAVHCVRSVQASLRYGSGQQCCYTADGTQLLTADSSGGSTPDRGHDWGAPPFRTPPRVPSMSHWLYDVLSFYYCCLWAPDCPRYMQRRPSNDCRNYRPPRLASAFGDPHFVTFDGTNFTFNGRGEYVLLEAALTDLRVQARAQPGTMSNGTETRGTGLTAVAVQEGNSDVVEVRLANRTGGLEVLLNQEVLSFTEQSWMDLKGMFLSVAAGDRVSIMLASGAGLEVSVQGPFLSVSVLLPEKFLTHTHGLLGTLNNDPTDDFTLHSGRVLPPGTSPQELFLFGANWTVHNASSLLTYDSWFLVHNFLYQPKHDPTFEPLFPSETTLNPSLAQEAAKLCGDDHFCNFDVAATGSLSTGTATRVAHQLHQRRMQSLQPVVSCGWLAPPPNGQKEGNRYLAGSTIYFHCDNGYSLAGAETSTCQADGTWSSPTPKCQPGRSYAVLLGIIFGGLAVVAAVALVYVLLRRRKGNTHVWGAQP

SEQ ID NO: 4526 - protein, 255 aa, unidentified
MRWAAATLRGKARPRGRAGVTTPAPGNRTGTCAKLRLPPQATFQVLRGNGASVGTVLMFRCPSNHQMVGSGLLTCTWKGSIAEWSSGSPVCKLVPPHETFGFKVAVIASIVSCAIILLMSMAFLTCCLLKCVKKSKRRRSNRSAQLWSQLKDEDLETVQAAYLGLKHFNKPVSGPSQAHDNHSFTTDHGESTSKLASVTRSVDKDPGIPRALSLSGSSSSPQAQVMVHMANPRQPLPASGLATGMPQQPAAYALG

SEQ ID NO: 4527 - protein, 490 aa, unidentified
MYHGMNPSNGDGFLEQQQQQQQPQSPQRLLAVILWFQLALCFGPAQLTGGFDDLQVCADPGIPENGFRTPSGGVFFEGSVARFHCQDGFKLKGATKRLCLKHFNGTLGWIPSDNSICVQEDCRIPQIEDAEIHNKTYRHGEKLIITCHEGFKIRYPDLHNMVSLCRDDGTWNNLPICQGCLRPLASSNGYVNISELQTSFPVGTVISYRCFPGFKLDGSAYLECLQNLIWSSSPPRCLALEVCPLPPMVSHGDFVCHPRPCERYNHGTVVEFYCDPGYSLTSDYKYITCQYGEWFPSYQVYCIKSEQTWPSTHETLLTTWKIVAFTATSVLLVLLLVILARMFQTKFKAHFPPRGPPRSSSSDPDFVVVDGVPVMLPSYDEAVSGGLSALGPGYMASVGQGCPLPVDDQSPPAYPGSGDTDTGPGESETCDSVSGSSELLQSLYSPPRCQESTHPASDNPDIIASTAEEVASTSPGIDIADEIPLMEEDP

SEQ ID NO: 4528 - protein, 629 aa, unidentified
MTAEGPSPPARWHRRLPGLWAAALLLLGLPRLSVRADGKFFVLESQNGSQGLQLEAARLSCKSRGAHLASADELRRVVQDCSFAVCTTGWLADGTLGTTVCSKGSGEQQIMRAVDVRIESNPVPGGTYSALCIKDEEKPCGDPPSFPHTILQGRTGLEMGDELLYVCAPGHIMGHRETAFTLLCNSCGEWYGLVQACGKDEAEAHIDYEDNFPDDRSVSFRELMEDSRTEADEDRGQGDSSEEAPKQDRLVSISVGRENIARDKVFVPTTGLPGAGSSVPADSPGSRLLQKHLFWFPAEAFHKPGLEKEVDDDTKKQFSAGDNHSGVKLVPGEPETKVIYGNTDGPSGPFVGKNDSKAGDPVVSSSDESWLDGYPVTEGAWRKTEAEEEEDGDRGDGSVGLDENVLVTPDQPILVEVKKPKSSTLTPSEGMTHSSVLPSQMLDVEALALRPVNASETEGIGDGDLTKYQSTLPWRFITEESPMATLSYELTSSTLEILTVNTVKQTPNHIPSTIMATTQPPVETTVPEIQDSFPYLLSEDFFGQEGPGPGASEELHPTLESCVGDGCPGLSRGPVIATIVTVLCLLLLLAGVGMVWGYRKCQHKSSVYKLNVGQRQARHYHQQIEMEKV

SEQ ID NO: 4529 - protein, 303 aa, unidentified
MCHGRIAPKSTSVFAVASVGHGVFLPLVILCTLLGDGLASVCPLPPEPENGGYICHPRPCRDPLTAGSVIEYLCAEGYMLKGDYKYLTCKNGEWKPAMEISCRLNEDKDTHTSLGVPTLSIVASTASSVALILLLVVLFVLLQPKLKSFHHSRRDQGVSGDQVSIMVDGVQVALPSYEEAVYGSSGHCVPPADPRVQIVLSEGSGPSGRSVPREQQLPDQGACSSAGGEDEAPGQSGLCEAWGSRASETVMVHQATTSSWVAGSGNRQLAHKETADSENSDIQSLLSLTSEEYTDDIPLLKEA

SEQ ID NO: 4530 - protein, 742 aa, unidentified
MEEGFRDRAAFIRGAKDIAKEVKKHAAKKVVKGLDRVQDEYSRRSYSRFEEEDDDDDFPAPSDGYYRGEGTQDEEEGGASSDATEGHDEDDEIYEGEYQGIPRAESGGKGERMADGAPLAGVRGGLSDGEGPPGGRGEAQRRKEREELAQQYEAILRECGHGRFQWTLYFVLGLALMADGVEVFVVGFVLPSAEKDMCLSDSNKGMLGLIVYLGMMVGAFLWGGLADRLGRRQCLLISLSVNSVFAFFSSFVQGYGTFLFCRLLSGVGIGGSIPIVFSYFSEFLAQEKRGEHLSWLCMFWMIGGVYAAAMAWAIIPHYGWSFQMGSAYQFHSWRVFVLVCAFPSVFAIGALTTQPESPRFFLENGKHDEAWMVLKQVHDTNMRAKGHPERVFSVTHIKTIHQEDELIEIQSDTGTWYQRWGVRALSLGGQVWGNFLSCFGPEYRRITLMMMGVWFTMSFSYYGLTVWFPDMIRHLQAVDYASRTKVFPGERVEHVTFNFTLENQIHRGGQYFNDKFIGLRLKSVSFEDSLFEECYFEDVTSSNTFFRNCTFINTVFYNTDLFEYKFVNSRLINSTFLHNKEGCPLDVTGTGEGAYMVYFVSFLGTLAVLPGNIVSALLMDKIGRLRMLAGSSVMSCVSCFFLSFGNSESAMIALLCLFGGVSIASWNALDVLTVELYPSDKRTTAFGFLNALCKLAAVLGISIFTSFVGITKAAPILFASAALALGSSLALKLPETRGQVLQ

SEQ ID NO: 4531 - protein, 683 aa, unidentified
MDDYKYQDNYGGYAPSDGYYRGNESNPEEDAQSDVTEGHDEEDEIYEGEYQGIPHPDDVKAKQAKMAPSRMDSLRGQTDLMAERLEDEEQLAHQYETIMDECGHGRFQWILFFVLGLALMADGVEVFVVSFALPSAEKDMCLSSSKKGMLGMIVYLGMMAGAFILGGLADKLGRKRVLSMSLAVNASFASLSSFVQGYGAFLFCRLISGIGIGGALPIVFAYFSEFLSREKRGEHLSWLGIFWMTGGLYASAMAWSIIPHYGWGFSMGTNYHFHSWRVFVIVCALPCTVSMVALKFMPESPRFLLEMGKHDEAWMILKQVHDTNMRAKGTPEKVFTVSNIKTPKQMDEFIEIQSSTGTWYQRWLVRFKTIFKQVWDNALYCVMGPYRMNTLILAVVWFAMAFSYYGLTVWFPDMIRYFQDEEYKSKMKVFFGEHVYGATINFTMENQIHQHGKLVNDKFTRMYFKHVLFEDTFFDECYFEDVTSTDTYFKNCTIESTIFYNTDLYEHKFINCRFINSTFLEQKEGCHMDLEQDNDFLIYLVSFLGSLSVLPGNIISALLMDRIGRLKMIGGSMLISAVCCFFLFFGNSESAMIGWQCLFCGTSIAAWNALDVITVELYPTNQRATAFGILNGLCKFGAILGNTIFASFVGITKVVPILLAAASLVGGGLIALRLPETREQVLM

SEQ ID NO: 4532 - protein, 727 aa, unidentified
MEDSYKDRTSLMKGAKDIAREVKKQTVKKVNQAVDRAQDEYTQRSYSRFQDEEDDDDYYPAGETYNGEANDDEGSSEATEGHDEDDEIYEGEYQGIPSMNQAKDSIVSVGQPKGDEYKDRRELESERRADEEELAQQYELIIQECGHGRFQWALFFVLGMALMADGVEVFVVGFVLPSAETDLCIPNSGSGWLGSIVYLGMMVGAFFWGGLADKVGRKQSLLICMSVNGFFAFLSSFVQGYGFFLFCRLLSGFGIGGAIPTVFSYFAEVLAREKRGEHLSWLCMFWMIGGIYASAMAWAIIPHYGWSFSMGSAYQFHSWRVFVIVCALPCVSSVVALTFMPESPRFLLEVGKHDEAWMILKLIHDTNMRARGQPEKVFTVNKIKTPKQIDELIEIESDTGTWYRRCFVRIRTELYGIWLTFMRCFNYPVRDNTIKLTIVWFTLSFGYYGLSVWFPDVIKPLQSDEYALLTRNVERDKYANFTINFTMENQIHTGMEYDNGRFIGVKFKSVTFKDSVFKSCTFEDVTSVNTYFKNCTFIDTVFDNTDFEPYKFIDSEFKNCSFFHNKTGCQITFDDDYSAYWIYFVNFLGTLAVLPGNIVSALLMDRIGRLTMLGGSMVLSGISCFFLWFGTSESMMIGMLCLYNGLTISAWNSLDVVTVELYPTDRRATGFGFLNALCKAAAVLGNLIFGSLVSITKSIPILLASTVLVCGGLVGLCLPDTRTQVLM

SEQ ID NO: 4533 - protein, 548 aa, unidentified
MEEDLFQLRQLPVVKFRRTGESARSEDDTASGEHEVQIEGVHVGLEAVELDDGAAVPKEFANPTDDTFMVEDAVEAIGFGKFQWKLSVLTGLAWMADAMEMMILSILAPQLHCEWRLPSWQVALLTSVVFVGMMSSSTLWGNISDQYGRKTGLKISVLWTLYYGILSAFAPVYSWILVLRGLVGFGIGGVPQSVTLYAEFLPMKARAKCILLIEVFWAIGTVFEVVLAVFVMPSLGWRWLLILSAVPLLLFAVLCFWLPESARYDVLSGNQEKAIATLKRIATENGAPMPLGKLIISRQEDRGKMRDLFTPHFRWTTLLLWFIWFSNAFSYYGLVLLTTELFQAGDVCGISSRKKAVEAKCSLACEYLSEEDYMDLLWTTLSEFPGVLVTLWIIDRLGRKKTMALCFVIFSFCSLLLFICVGRNVLTLLLFIARAFISGGFQAAYVYTPEVYPTATRALGLGTCSGMARVGALITPFIAQVMLESSVYLTLAVYSGCCLLAALASCFLPIETKGRGLQESSHREWGQEMVGRGMHGAGVTRSNSGSQE

SEQ ID NO: 4534 - protein, 492 aa, unidentified
MATKPTEPVTILSLRKLSLGTAEPQVKEPKTFTVEDAVETIGFGRFHIALFLIMGSTGVVEAMEIMLIAVVSPVIRCEWQLENWQVALVTTMVFFGYMVFSILFGLLADRYGRWKILLISFLWGAYFSLLTSFAPSYIWFVFLRTMVGCGVSGHSQGLIIKTEFLPTKYRGYMLPLSQVFWLAGSLLIIGLASVIIPTIGWRWLIRVASIPGIILIVAFKFIPESARFNVSTGNTRAALATLERVAKMNRSVMPEGKLVEPVLEKRGRFADLLDAKYLRTTLQIWVIWLGISFAYYGVILASAELLERDLVCGSKSDSAVVVTGGDSGESQSPCYCHMFAPSDYRTMIISTIGEIALNPLNILGINFLGRRLSLSITMGCTALFFLLLNICTSSAGLIGFLFMLRALVAANFNTVYIYTAEVYPTTMRALGMGTSGSLCRIGAMVAPFISQVLMSASILGALCLFSSVCVVCAISAFTLPIETKGRALQQIK

SEQ ID NO: 4535 - protein, 663 aa, unidentified
MGPLRESKKEHRVQHHDKEISRSRIPRLILRPHMPQQQHKVSPASESPFSEEESREFNPSSSGRSARTVSSNSFCSDDTGCPSSQSVSPVKTPSDAGNSPIGFCPGSDEGFTRKKCTIGMVGEGSIQSSRYKKESKSGLVKPGSEADFSSSSSTGSISAPEVHMSTAGSKRSSSSRNRGPHGRSNGASSHKPGSSPSSPREKDLLSMLCRNQLSPVNIHPSYAPSSPSSSNSGSYKGSDCSPIMRRSGRYMSCGENHGVRPPNPEQYLTPLQQKEVTVRHLKTKLKESERRLHERESEIVELKSQLARMREDWIEEECHRVEAQLALKEARKEIKQLKQVIETMRSSLADKDKGIQKYFVDINIQNKKLESLLQSMEMAHSGSLRDELCLDFPCDSPEKSLTLNPPLDTMADGLSLEEQVTGEGADRELLVGDSIANSTDLFDEIVTATTTESGDLELVHSTPGANVLELLPIVMGQEEGSVVVERAVQTDVVPYSPAISELIQSVLQKLQDPCPSSLASPDESEPDSMESFPESLSALVVDLTPRNPNSAILLSPVETPYANVDAEVHANRLMRELDFAACVEERLDGVIPLARGGVVRQYWSSSFLVDLLAVAAPVVPTVLWAFSTQRGGTDPVYNIGALLRGCCVVALHSLRRTAFRIKT

SEQ ID NO: 4536 - protein, 258 aa, unidentified
MDGIIEQKSMLVHSKISDAGKRNGLINTRNLMAESRDGLVSVYPAPQYQSHRVGASTVPASLDSSRSEPMQQLLDPNTLQQSVESRYRPNIILYSEGVLRSWGDGVAADCCETTFIEDRSPTKDSLEYPDGKFIDLSADDIKIHTLSYDVEEEEEFQELESDYSSDTESEDNFLMMPPRDHLGLSVFSMLCCFWPLGIAAFYLSHETNKAVAKGDLHQASTSSRRALFLAVLSITIGTGVYVGVAVALIAYLSKNNHL

SEQ ID NO: 4537 - protein, 238 aa, unidentified
MESLSELQNPLLPRSPAHLHGPYPYPETPPSWSCQEKLYSYLLGGAGPAGAHQLLDPGSLQLAVEAWYRPSCLLGRDKVKEPRAGSCETSFTEDREPQEGPPEQPTGPGQAAENVTIQTVSYGVQEELRDQEDDQEEEESDATSTESESEDNFLTLPPRDHLGLTLFSMLCCFWPLGIAAFYFSQGTSKAISKGDFRLASTTSRRALFLATLAIAVGAGLYVAVVVALAAYMSQNGHG

SEQ ID NO: 4538 - protein, 8797 aa, unidentified
MATSRGASRCPRDIANVMQRLQDEQEIVQKRTFTKWINSHLAKRKPPMVVDDLFEDMKDGVKLLALLEVLSGQKLPCEQGRRMKRIHAVANIGTALKFLEGRKIKLVNINSTDIADGRPSIVLGLMWTIILYFQIEELTSNLPQLQSLSSSASSVDSIVSSETPSPPSKRKVTTKIQGNAKKALLKWVQYTAGKQTGIEVKDFGKSWRSGVAFHSVIHAIRPELVDLETVKGRSNRENLEDAFTIAETELGIPRLLDPEDVDVDKPDEKSIMTYVAQFLKHYPDIHNASTDGQEDDEILPGFPSFANSVQNFKREDRVIFKEMKVWIEQFERDLTRAQMVESNLQDKYQSFKHFRVQYEMKRKQIEHLIQPLHRDGKLSLDQALVKQSWDRVTSRLFDWHIQLDKSLPAPLGTIGAWLYRAEVALREEITVQQVHEETANTIQRKLEQHKDLLQNTDAHKRAFHEIYRTRSVNGIPVPPDQLEDMAERFHFVSSTSELHLMKMEFLELKYRLLSLLVLAESKLKSWIIKYGRRESVEQLLQNYVSFIENSKFFEQYEVTYQILKQTAEMYVKADGSVEEAENVMKFMNETTAQWRNLSVEVRSVRSMLEEVISNWDRYGNTVASLQAWLEDAEKMLNQSENAKKDFFRNLPHWIQQHTAMNDAGNFLIETCDEMVSRDLKQQLLLLNGRWRELFMEVKQYAQADEMDRMKKEYTDCVVTLSAFATEAHKKLSEPLEVSFMNVKLLIQDLEDIEQRVPVMDAQYKIITKTAHLITKESPQEEGKEMFATMSKLKEQLTKVKECYSPLLYESQQLLIPLEELEKQMTSFYDSLGKINEIITVLEREAQSSALFKQKHQELLACQENCKKTLTLIEKGSQSVQKFVTLSNVLKHFDQTRLQRQIADIHVAFQSMVKKTGDWKKHVETNSRLMKKFEESRAELEKVLRIAQEGLEEKGDPEELLRRHTEFFSQLDQRVLNAFLKACDELTDILPEQEQQGLQEAVRKLHKQWKDLQGEAPYHLLHLKIDVEKNRFLASVEECRTELDRETKLMPQEGSEKIIKEHRVFFSDKGPHHLCEKRLQLIEELCVKLPVRDPVRDTPGTCHVTLKELRAAIDSTYRKLMEDPDKWKDYTSRFSEFSSWISTNETQLKGIKGEAIDTANHGEVKRAVEEIRNGVTKRGETLSWLKSRLKVLTEVSSENEAQKQGDELAKLSSSFKALVTLLSEVEKMLSNFGDCVQYKEIVKNSLEELISGSKEVQEQAEKILDTENLFEAQQLLLHHQQKTKRISAKKRDVQQQIAQAQQGEGGLPDRGHEELRKLESTLDGLERSRERQERRIQVTLRKWERFETNKETVVRYLFQTGSSHERFLSFSSLESLSSELEQTKEFSKRTESIAVQAENLVKEASEIPLGPQNKQLLQQQAKSIKEQVKKLEDTLEEDIKTMEMVKTKWDHFGSNFETLSVWITEKEKELNALETSSSAMDMQISQIKVTIQEIESKLSSIVGLEEEAQSFAQFVTTGESARIKAKLTQIRRYGEELREHAQCLEGTILGHLSQQQKFEENLRKIQQSVSEFEDKLAVPIKICSSATETYKVLQEHMDLCQALESLSSAITAFSASARKVVNRDSCVQEAAALQQQYEDILRRAKERQTALENLLAHWQRLEKELSSFLTWLERGEAKASSPEMDISADRVKVEGELQLIQALQNEVVSQASFYSKLLQLKESLFSVASKDDVKMMKLHLEQLDERWRDLPQIINKRINFLQSVVAEHQQFDELLLSFSVWIKLFLSELQTTSEISIMDHQVALTRHKDHAAEVESKKGELQSLQGHLAKLGSLGRAEDLHLLQGKAEDCFQLFEEASQVVERRQLALSHLAEFLQSHASLSGILRQLRQTVEATNSMNKNESDLIEKDLNDALQNAKALESAAVSLDGILSKAQYHLKIGSSEQRTSCRATADQLCGEVERIQNLLGTKQSEADALAVLKKAFQDQKEELLKSIEDIEERTDKERLKEPTRQALQQRLRVFNQLEDELNSHEHELCWLKDKAKQIAQKDVAFAPEVDREINRLEVTWDDTKRLIHENQGQCCGLIDLMREYQNLKSAVSKVLENASSVIVTRTTIKDQEDLKWAFSKHETAKNKMNYKQKDLDNFTSKGKHLLSELKKIHSSDFSLVKTDMESTVDKWLDVSEKLEENMDRLRVSLSIWDDVLSTRDEIEGWSNNCVPQMAENISNLDNHLRAEELLKEFESEVKNKALRLEELHSKVNDLKELTKNLETPPDLQFIEADLMQKLEHAKEITEVAKGTLKDFTAQSTQVEKFINDITTWFTKVEESLMNCAQNETCEALKKVKDIQKELQSQQSNISSTQENLNSLCRKYHSAELESLGRAMTGLIKKHEAVSQLCSKTQASLQESLEKHFSESMQEFQEWFLGAKAAAKESSDRTGDSKVLEAKLHDLQNILDSVSDGQSKLDAVTQEGQTLYAHLSKQIVSSIQEQITKANEEFQAFLKQCLKDKQALQDCASELGSFEDQHRKLNLWIHEMEERFNTENLGESKQHIPEKKNEVHKVEMFLGELLAARESLDKLSQRGQLLSEEGHGAGQEGRLCSQLLTSHQNLLRMTKEKLRSCQVALQEHEALEEALQSMWFWVKAIQDRLACAESTLGSKDTLEKRLSQIQDILLMKGEGEVKLNMAIGKGEQALRSSNKEGQRVIQTQLETLKEVWADIMSSSVHAQSTLESVISQWNDYVERKNQLEQWMESVDQKIEHPLQPQPGLKEKFVLLDHLQSILSEAEDHTRALHRLIAKSRELYEKTEDESFKDTAQEELKTQFNDIMTVAKEKMRKVEEIVKDHLMYLDAVHEFTDWLHSAKEELHRWSDMSGDSSATQKKLSKIKELIDSREIGASRLSRVESLAPEVKQNTTASGCELMHTEMQALRADWKQWEDSVFQTQSCLENLVSQMALSEQEFSGQVAQLEQALEQFSALLKTWAQQLTLLEGKNTDEEIVECWHKGQEILDALQKAEPRTEDLKSQLNELCRFSRDLSTYSGKVSGLIKEYNCLCLQASKGCQNKEQILQQRFRKAFRDFQQWLVNAKITTAKCFDIPQNISEVSTSLQKIQEFLSESENGQHKLNMMLSKGELLSTLLTKEKAKGIQAKVTAAKEDWKNFHSNLHQKESALENLKIQMKDFEVSAEPIQDWLSKTEKMVHESSNRLYDLPAKRREQQKLQSVLEEIHCYEPQLNRLKEKAQQLWEGQAASKSFRHRVSQLSSQYLALSNLTKEKVSRLDRIVAEHNQFSLGIKELQDWMTDAIHMLDSYCHPTSDKSVLDSRTLKLEALLSVKQEKEIQMKMIVTRGESVLQNTSPEGIPTIQQQLQSVKDMWASLLSAGIRCKSQLEGALSKWTSYQDGVRQFSGWMDSMEANLNESERQHAELRDKTTMLGKAKLLNEEVLSYSSLLETIEVKGAGMTEHYVTQLELQDLQERYRAIQERAKEAVTKSEKLVRLHQEYQRDLKAFEVWLGQEQEKLDQYSVLEGDAHTHETTLRDLQELQVHCAEGQALLNSVLHTREDVIPSGIPQAEDRALESLRQDWQAYQHRLSETRTQFNNVVNKLRLMEQKFQQVDEWLKTAEEKVSPRTRRQSNRATKEIQLHQMKKWHEEVTAYRDEVEEVGARAQEILDESHVNSRMGCQATQLTSRYQALLLQVLEQIKFLEEEIQSLEESESSLSSYSDWYGSTHKNFKNVATKIDKVDTVMMGKKLKTLEVLLKDMEKGHSLLKSAREKGERAVKYLEEGEAERLRKEIHDHMEQLKELTSTVRKEHMTLEKGLHLAKEFSDKCKALTQWIAEYQEILHVPEEPKMELYEKKAQLSKYKSLQQTVLSHEPSVKSVREKGEALLELVQDVTLKDKIDQLQSDYQDLCSIGKEHVFSLEAKVKDHEDYNSELQEVEKWLLQMSGRLVAPDLLETSSLETITQQLAHHKAMMEEIAGFEDRLNNLQMKGDTLIGQCADHLQAKLKQNVHAHLQGTKDSYSAICSTAQRMYQSLEHELQKHVSRQDTLQQCQAWLSAVQPDLEPSPQPPLSRAEAIKQVKHFRALQEQARTYLDLLCSMCDLSNASVKTTAKDIQQTEQTIEQKLVQAQNLTQGWEEIKHLKSELWIYLQDADQQLQNMKRRHSELELNIAQNMVSQVKDFVKKLQSKQASVNTIIEKVNKLTKKEESPEHKEINHLNDQWLDLCRQSNNLCLQREEDLQRTRDYHDCMNVVEVFLEKFTTEWDNLARSDAESTAVHLEALKKLALALQERKYAIEDLKDQKQKMIEHLNLDDKELVKEQTSHLEQRWFQLEDLIKRKIQVSVTNLEELNVVQSRFQELMEWAEEQQPNIAEALKQSPPPDMAQNLLMDHLAICSELEAKQMLLKSLIKDADRVMADLGLNERQVIQKALSDAQSHVNCLSDLVGQRRKYLNKALSEKTQFLMAVFQATSQIQQHERKIMFREHICLLPDDVSKQVKTCKSAQASLKTYQNEVTGLWAQGRELMKEVTEQEKSEVLGKLQELQSVYDSVLQKCSHRLQELEKNLVSRKHFKEDFDKACHWLKQADIVTFPEINLMNESSELHTQLAKYQNILEQSPEYENLLLTLQRTGQTILPSLNEVDHSYLSEKLNALPRQFNVIVALAKDKFYKVQEAILARKEYASLIELTTQSLSELEAQFLRMSKVPTDLAVEEALSLQDGCRAILDEVAGLGEAVDELNQKKEGFRSTGQPWQPDKMLHLVTLYHRLKRQTEQRVSLLEDTTSAYQEHEKMCQQLERQLKSVKEEQSKVNEETLPAEEKLKMYHSLAGSLQDSGIVLKRVTIHLEDLAPHLDPLAYEKARHQIQSWQGELKLLTSAIGETVTECESRMVQSIDFQTEMSRSLDWLRRVKAELSGPVYLDLNLQDIQEEIRKIQIHQEEVQSSLRIMNALSHKEKEKFTKAKELISADLEHSLAELSELDGDIQEALRTRQATLTEIYSQCQRYYQVFQAANDWLEDAQELLQLAGNGLDVESAEENLKSHMEFFSTEDQFHSNLEELHSLVATLDPLIKPTGKEDLEQKVASLELRSQRMSRDSGAQVDLLQRCTAQWHDYQKAREEVIELMNDTEKKLSEFSLLKTSSSHEAEEKLSEHKALVSVVNSFHEKIVALEEKASQLEKTGNDASKATLSRSMTTVWQRWTRLRAVAQDQEKILEDAVDEWTGFNNKVKKATEMIDQLQDKLPGSSAEKASKAELLTLLEYHDTFVLELEQQQSALGMLRQQTLSMLQDGAAPTPGEEPPLMQEITAMQDRCLNMQEKVKTNGKLVKQELKDREMVETQINSVKCWVQETKEYLGNPTIEIDAQLEELQILLTEATNHRQNIEKMAEEQKEKYLGLYTILPSELSLQLAEVALDLKIRDQIQDKIKEVEQSKATSQELSRQIQKLAKDLTTILTKLKAKTDNVVQAKTDQKVLGEELDGCNSKLMELDAAVQKFLEQNGQLGKPLAKKIGKLTELHQQTIRQAENRLSKLNQAASHLEEYNEMLELILKWIEKAKVLAHGTIAWNSASQLREQYILHQTLLEESKEIDSELEAMTEKLQYLTSVYCTEKMSQQVAELGRETEELRQMIKIRLQNLQDAAKDMKKFEAELKKLQAALEQAQATLTSPEVGRLSLKEQLSHRQHLLSEMESLKPKVQAVQLCQSALRIPEDVVASLPLCHAALRLQEEASRLQHTAIQQCNIMQEAVVQYEQYEQEMKHLQQLIEGAHREIEDKPVATSNIQELQAQISRHEELAQKIKGYQEQIASLNSKCKMLTMKAKHATMLLTVTEVEGLAEGTEDLDGELLPTPSAHPSVVMMTAGRCHTLLSPVTEESGEEGTNSEISSPPACRSPSPVANTDASVNQDIAYYQALSAERLQTDAAKIHPSTSASQEFYEPGLEPSATAKLGDLQRSWETLKNVISEKQRTLYEALERQQKYQDSLQSISTKMEAIELKLSESPEPGRSPESQMAEHQALMDEILMLQDEINELQSSLAEELVSESCEADPAEQLALQSTLTVLAERMSTIRMKASGKRQLLEEKLNDQLEEQRQEQALQRYRCEADELDSWLLSTKATLDTALSPPKEPMDMEAQLMDCQNMLVEIEQKVVALSELSVHNENLLLEGKAHTKDEAEQLAGKLRRLKGSLLELQRALHDKQLNMQGTAQEKEESDVDLTATQSPGVQEWLAQARTTWTQQRQSSLQQQKELEQELAEQKSLLRSVASRGEEILIQHSAAETSGDAGEKPDVLSQELGMEGEKSSAEDQMRMKWESLHQEFSTKQKLLQNVLEQEQEQVLYSRPNRLLSGVPLYKGDVPTQDKSAVTSLLDGLNQAFEEVSSQSGGAKRQSIHLEQKLYDGVSATSTWLDDVEERLFVATALLPEETETCLFNQEILAKDIKEMSEEMDKNKNLFSQAFPENGDNRDVIEDTLGCLLGRLSLLDSVVNQRCHQMKERLQQILNFQNDLKVLFTSLADNKYIILQKLANVFEQPVAEQIEAIQQAEDGLKEFDAGIIELKRRGDKLQVEQPSMQELSKLQDMYDELMMIIGSRRSGLNQNLTLKSQYERALQDLADLLETGQEKMAGDQKIIVSSKEEIQQLLDKHKEYFQGLESHMILTETLFRKIISFAVQKETQFHTELMAQASAVLKRAHKRGVELEYILETWSHLDEDQQELSRQLEVVESSIPSVGLVEENEDRLIDRITLYQHLKSSLNEYQPKLYQVLDDGKRLLISISCSDLESQLNQLGECWLSNTNKMSKELHRLETILKHWTRYQSESADLIHWLQSAKDRLEFWTQQSVTVPQELEMVRDHLNAFLEFSKEVDAQSSLKSSVLSTGNQLLRLKKVDTATLRSELSRIDSQWTDLLTNIPAVQEKLHQLQMDKLPSRHAISEVMSWISLMENVIQKDEDNIKNSIGYKAIHEYLQKYKGFKIDINCKQLTVDFVNQSVLQISSQDVESKRSDKTDFAEQLGAMNKSWQILQGLVTEKIQLLEGLLESWSEYENNVQCLKTWFETQEKRLKQQHRIGDQASVQNALKDCQDLEDLIKAKEKEVEKIEQNGLALIQNKKEDVSSIVMSTLRELGQTWANLDHMVGQLKILLKSVLDQWSSHKVAFDKINSYLMEARYSLSRFRLLTGSLEAVQVQVDNLQNLQDDLEKQERSLQKFGSITNQLLKECHPPVTETLTNTLKEVNMRWNNLLEEIAEQLQSSKALLQLWQRYKDYSKQCASTVQQQEDRTNELLKAATNKDIADDEVATWIQDCNDLLKGLGTVKDSLFFLHELGEQLKQQVDASAASAIQSDQLSLSQHLCALEQALCKQQTSLQAGVLDYETFAKSLEALEAWIVEAEEILQGQDPSHSSDLSTIQERMEELKGQMLKFSSMAPDLDRLNELGYRLPLNDKEIKRMQNLNRHWSLISSQTTERFSKLQSFLLQHQTFLEKCETWMEFLVQTEQKLAVEISGNYQHLLEQQRAHELFQAEMFSRQQILHSIIIDGQRLLEQGQVDDRDEFNLKLTLLSNQWQGVIRRAQQRRGIIDSQIRQWQRYREMAEKLRKWLVEVSYLPMSGLGSVPIPLQQARTLFDEVQFKEKVFLRQQGSYILTVEAGKQLLLSADSGAEAALQAELAEIQEKWKSASMRLEEQKKKLAFLLKDWEKCEKGIADSLEKLRTFKKKLSQSLPDHHEELHAEQMRCKELENAVGSWTDDLTQLSLLKDTLSAYISADDISILNERVELLQRQWEELCHQLSLRRQQIGERLNEWAVFSEKNKELCEWLTQMESKVSQNGDILIEEMIEKLKKDYQEEIAIAQENKIQLQQMGERLAKASHESKASEIEYKLGKVNDRWQHLLDLIAARVKKLKETLVAVQQLDKNMSSLRTWLAHIESELAKPIVYDSCNSEEIQRKLNEQQELQRDIEKHSTGVASVLNLCEVLLHDCDACATDAECDSIQQATRNLDRRWRNICAMSMERRLKIEETWRLWQKFLDDYSRFEDWLKSSERTAAFPSSSGVIYTVAKEELKKFEAFQRQVHECLTQLELINKQYRRLARENRTDSACSLKQMVHEGNQRWDNLQKRVTSILRRLKHFIGQREEFETARDSILVWLTEMDLQLTNIEHFSECDVQAKIKQLKAFQQEISLNHNKIEQIIAQGEQLIEKSEPLDAAIIEEELDELRRYCQEVFGRVERYHKKLIRLPLPDDEHDLSDRELELEDSAALSDLHWHDRSADSLLSPQPSSNLSLSLAQPLRSERSGRDTPASVDSIPLEWDHDYDLSRDLESAMSRALPSEDEEGQDDKDFYLRGAVGLSGDHSALESQIRQLGKALDDSRFQIQQTENIIRSKTPTGPELDTSYKGYMKLLGECSSSIDSVKRLEHKLKEEEESLPGFVNLHSTETQTAGVIDRWELLQAQALSKELRMKQNLQKWQQFNSDLNSIWAWLGDTEEELEQLQRLELSTDIQTIELQIKKLKELQKAVDHRKAIILSINLCSPEFTQADSKESRDLQDRLSQMNGRWDRVCSLLEEWRGLLQDALMQCQGFHEMSHGLLLMLENIDRRKNEIVPIDSNLDAEILQDHHKQLMQIKHELLESQLRVASLQDMSCQLLVNAEGTDCLEAKEKVHVIGNRLKLLLKEVSRHIKELEKLLDVSSSQQDLSSWSSADELDTSGSVSPTSGRSTPNRQKTPRGKCSLSQPGPSVSSPHSRSTKGGSDSSLSEPGPGRSGRGFLFRVLRAALPLQLLLLLLIGLACLVPMSEEDYSCALSNNFARSFHPMLRYTNGPPPL

SEQ ID NO: 4539 - protein, 6885 aa, unidentified
MASSPELPTEDEQGSWGIDDLHISLQAEQEDTQKKAFTCWINSQLARHTSPSVISDLFTDIKKGHVLLDLLEVLSGQQLPRDKGSNTFQCRINIEHALTFLRNRSIKLINIHVTDIIDGNPSIILGLIWTIILHFHIEKLAQTLSCNYNQPSLDDVSVVDSSPASSPPAKKCSKVQARWQMSARKALLLWAQEQCATYESVNVTDFKSSWRNGMAFLAIIHALRPDLIDMKSVKHRSNKDNLREAFRIAEQELKIPRLLEPEDVDVVDPDEKSIMTYVAQFLQYSKDAPGTGEEAQGKVKDAMGWLTLQKEKLQKLLKDSENDTYFKKYNSLLSFMESFNEEKKSFLDVLSIKRDLDELDKDHLQLREAWDGLDHQINAWKIKLNYALPPPLHQTEAWLQEVEELMDEDLSASQDHSQAVTLIQEKMTLFKSLMDRFEHHSNILLTFENKDENHLPLVPPNKLEEMKRRINNILEKKFILLLEFHYYKCLVLGLVDEVKSKLDIWNIKYGSRESVELLLEDWHKFIEEKEFLARLDTSFQKCGEIYKNLAGECQNINKQYMMVKSDVCMYRKNIYNVKSTLQKVLACWATYVENLRLLRACFEETKKEEIKEVPFETLAQWNLEHATLNEAGNFLVEVSNDVVGSSISKELRRLNKRWRKLVSKTQLEMNLPLMIKKQDQPTFDNSGNILSKEEKATVEFSTDMSVELPENYNQNIKAGEKHEKENEEFTGQLKVAKDVEKLIGQVEIWEAEAKSVLDQDDVDTSMEESLKHLIAKGSMFDELMARSEDMLQMDIQNISSQESFQHVLTTGLQAKIQEAKEKVQINVVKLIAALKNLTDVSPDLDIRLKMEESQKELESYMMRAQQLLGQRESPGELISKHKEALIISNTKSLAKYLKAVEELKNNVTEDIKMSLEEKSRDVCAKWESLHHELSLYVQQLKIDIEKGKLSDNILKLEKQINKEKKLIRRGRTKGLIKEHEACFSEEGCLYQLNHHMEVLRELCEELPSQKSQQEVKRLLKDYEQKIERLLKCASEIHMTLQPTAGGTSKNEGTITTSENRGGDPHSEAPFAKSDNQPSTEKAMEPTMKFSLASVLRPLQEESIMEKDYSASINSLLERYDTYRDILEHHLQNNKFRITSDFSSEEDRSSSCLQAKLTDLQVIKNETDARWKEFEIISLKLENHVNDIKKPFVIKERDTLKERERELQMTLNTRMESLETALRLVLPVEKASLLLCGSDLPLHKMAIQGFHLIDADRIYQHLRNIQDSIAKQIEICNRLEEPGNFVLKELHPFDLHAMQNIILKYKTQFEGMNHRVQRSEDTLKALEDFLASLRTAKLSAEPVTDLSASDTQVAQENTLTVKNKEGEIHLMKDKAKHLDKCLKMLDMSFKDAERGDDTSCENLLDAFSIKLSETHGYGVQEEFTEENKLLEACIFKNNELLKNIQDVQSQISKIGLKDPTVPAVKHRKKSLIRLDKVLDEYEEEKRHLQEMANSLPHFKDGREKTVNQQCQNTVVLWENTKALVTECLEQCGRVLELLKQYQNFKSILTTLIQKEESVISLQASYMGKENLKKRIAEIEIVKEEFNEHLEVVDKINQVCKNLQFYLNKMKTFEEPPFEKEANIIVDRWLDINEKTEDYYENLGRALALWDKLFNLKNVIDEWTEKALQKMELHQLTEEDRERLKEELQVHEQKTSEFSRRVAEIQFLLQSSEIPLELQVMESSILNKMEHVQKCLTGESNCHALSGSTAELREDLDQAKTQIGMTESLLKALSPSDSLEIFTKLEEIQQQILQQKHSMILLENQIGCLTPELSELKKQYESVSDLFNTKKSVLQDHFSKLLNDQCKNFNDWFSNIKVNLKECFESSETKKSVEQKLQKLSDFLTLEGRNSKIKQVDSVLKHVKKHLPKAHVKELISWLVGQEFELEKMESICQARAKELEDSLQQLLRLQDDHRNLRKWLTNQEEKWKGMEEPGEKTELFCQALARKREQFESVAQLNNSLKEYGFTEEEEIIMEATCLMDRYQTLLRQLSEIEEEDKLLPTEDQSFNDLAHDVIHWIKEIKESLMVLNSSEGKMPLEERIQKIKEIILLKPEGDARIETIMKQAESSEAPLVQKTLTDISNQWDNTLHLASTYLSHQEKLLLEGEKYLQSKEDLRLMLIELKKKQEAGFALQHGLQEKKAQLKIYKKFLKKAQDLTSLLKELKSQGNYLLECTKNPSFSEEPWLEIKHLHESLLQQLQDSVQNLDGHVREHDSYQVCVTDLNTTLDNFSKEFVSFSDKPVDQIAVEEKLQKLQELENRLSLQDGTLKKILALAKSVKQNTSSVGQKIIKDDIKSLQCKQKDLENRLASAKQEMECCLNSILKSKRSTEKKGKFTLPGREKQATSDVQESTQESAAVEKLEEDWEINKDSAVEMAMSKQLSLNAQESMKNTEDERKVNELQNQPLELDTMLRNEQLEEIEKLYTQLEAKKAAIKPLEQTECLNKTETGALVLHNIGYSAQHLDNLLQALITLKKNKESQYCVLRDFQEYLAAVESSMKALLTDKESLKVGPLDSVTYLDKIKKFIASIEKEKDSLGNLKIKWENLSNHVTDMDKKLLESQIKQLEHGWEQVEQQIQKKYSQQVVEYDEFTTLMNKVQDTEISLQQQQQHLQLRLKSPEERAGNQSMIALTTDLQATKHGFSVLKGQAELQMKRIWGEKEKKNLEDGINNLKKQWETLEPLHLEAENQIKKCDIRNKMKETILWAKNLLGELNPSIPLLPDDILSQIRKCKVTHDGILARQQSVESLAEEVKDKVPSLTTYEGSDLNNTLEDLRNQYQMLVLKSTQRSQQLEFKLEERSNFFAIIRKFQLMVQESETLIIPRVETAATEAELKHHHVTLEASQKELQEIDSGISTHLQELTNIYEELNVFERLFLEDQLKNLKIRTNRIQRFIQNTCNEVEHKIKFCRQFHEKTSALQEEADSIQRNELLLNQEVNKGVKEEIYNLKDRLTAIKCCILQVLKLKKVFDYIGLNWDFSQLDQLQTQVFEKEKELEEKIKQLDTFEEEHGKYQALLSKMRAIDLQIKKMTEVVLKAPDSSPESRRLNAQILSQRIEKAKCLCDEIIKKLNENKTFDDSFKEKEILQIKLNAEENDKLYKVLQNMVLELSPKELDEKNCQDKLETSLHVLNQIKSQLQQPLLINLEIKHIQNEKDNCEAFQEQVWAEMCSIKAVTAIEKQREENSSEASDVETKLREFEDLQMQLNTSIDLRTNVLNDAYENLTRYKEAVTRAVESITSLEAIIIPYRVDVGNPEESLEMPLRKQEELESTVAHIQDLTEKLGMISSPEAKLQLQYTLQELVSKNSAMKEAFKAQETEAERYLENYKCYRKMEEDIYTNLSKMETVLGQSMSSLPLSYREALERLEQSKALVSNLISTKEELMKLRQILRLLRLRCTENDGICLLKIVSALWEKWLSLLEAAKEWEMWCEELKQEWKFVSEEIEREAIILDNLQEELPEISKTKEAATTEELSELLDCLCQYGENVEKQQLLLTLLLQRIRSIQNVPESSGAVETVPAFQEITSMKERCNKLLQKVQKNKELVQTEIQERHSFTKEIIALKNFFQQTTTSFQNMAFQDHPEKSEQFEELQSILKKGKLTFENIMEKLRIKYSEMYTIVPAEIESQVEECRKALEDIDEKISNEVLKSSPSYAMRRKIEEINNGLHNVEKMLQQKSKNIEKAQEIQKKMWDELDLWHSKLNELDSEVQDIVEQDPGQAQEWMDNLMIPFQQYQQVSQRAECRTSQLNKATVKMEEYSDLLKSTEAWIENTSHLLANPADYDSLRTLSHHASTVQMALEDSEQKHNLLHSIFMDLEDLSIIFETDELTQSIQELSNQVTALQQKIMESLPQIQRMADDVVAIESEVKSMEKRVSKIKTILLSKEIFDFSPEEHLKHGEVILENIRPMKKTIAEIVSYQVELRLPQTGMKPLPVFQRTNQLLQDIKLLENVTQEQNELLKVVIKQTNEWDEEIENLKQILNNYSAQFSLEHMSPDQADKLPQLQGEIERMEKQILSLNQRKEDLLVDLKATVLNLHQHLKQEQEGVERDRLPAVTSEEGGVAERDASERKLNRRGSMSYLAAVEEEVEESSVKSDNGDEKAEPSPQSWSSLWKHDKDMEEDRASSSSGTIVQEAYGKISTSDNSMAQILTPDSLNTEQGPECSLRPNQTEEGTTPPIEADTLDSSDAQGGLEPRVEKTRPEPTEVLHACKTQVAELELWLQQANVAVEPETLNADMQQVLEQQLVGCQAMLTEIEHKVAFLLETCKDQGLGDNGATQHEAEALSLKLKTVKCNLEKVQMMLQEKHSEDQHPTILKKSSEPEHQEALQPVNLSELESIVTERPQFSRQKDFQQQQVLELKPMEQKDFIKFIEFNAKKMWPQYCQHDNDTTQESSASNQASSPENDVPDSILSPQGQNGDKWQYLHHELSSKIKLPLPQLVEPQVSTNMGILPSVTMYNFRYPTTEELKTYTTQLEDLRQEASNLQTQENMTEEAYINLDKKLFELFLTLSQCLSSVEEMLEMPRLYREDGSGQQVHYETLALELKKLYLALSDKKGDLLKAMTWPGENTNLLLECFDNLQVCLEHTQAAAVCRSKSLKAGLDYNRSYQNEIKRLYHQLIKSKTSLQQSLNEISGQSVAEQLQKADAYTVELENAESRVAKLRDEGERLHLPYALLQEVYKLEDVLDSMWGMLRARYTELSSPFVTESQQDALLQGMVELVKIGKEKLAHGHLKQTKSKVALQAQIENHKVFFQKLVADMLLIQAYSAKILPSLLQNRETFWAEQVTEVKILEEKSRQCGMKLQSLLQKWEEFDENYASLEKDLEILISTLPSVSLVEETEERLVERISFYQQIKRNIGGKHARLYQTLNEGKQLVASVSCPELEGQIAKLEEQWLSLNKKIDHELHRLQALLKHLLSYNRDSDQLTKWLESSQHTLNYWKEQSLNVSQDLDTIRSNINNFFEFSKEVDEKSSLKTAVISIGNQLLHLKETDTATLRASLAQFEQKWTMLITQLPDIQEKLHQLQMEKLPSRKAITEMISWMNNVEHQTSDEDSVHSPSSASQVKHLLQKHKEFRMEMDYKQWIVDFVNQSLLQLSTCDVESKRYERTEFAEHLGEMNRQWHRVHGMLNRKIQHLEQLLESITESENKIQILNNWLEAQEERLKTLQKPESVISVQKLLLDCQDIENQLAIKSKALDELKQSYLTLESGAVPLLEDTASRIDELFQKRSSVLTQVNQLKTSMQSVLQEWKIYDQLYDEVNMMTIRFWYCMEHSKPVVLSLETLRCQVENLQSLQDEAESSEGSWEKLQEVIGKLKGLCPSVAEIIEEKCQNTHKRWTQVNQAIADQLQKAQSLLQLWKAYSNAHGEAAARLKQQEAKFQQLANISMSGNNLAEILPPALQDIKELQHDVQKTKEAFLQNSSVLDRLPQPAESSTHMLLPGPLHSLQRAAYLEKMLLVKANEFEFVLSQFKDFGVRLESLKGLIMHEEENLDRLHQQEKENPDSFLNHVLALTAQSPDIEHLNEVSLKLPLSDVAVKTLQNMNRQWIRATATALERCSELQGIGLNEKFLYCCEKWIQLLEKIEEALKVDVANSLPELLEQQKTYKMLEAEVSINQTIADSYVTQSLQLLDTTEIENRPEFITEFSKLTDRWQNAVQGVRQRKGDVDGLVRQWQDFTTSVENLFRFLTDTSHLLSAVKGQERFSLYQTRSLIHELKNKEIHFQRRRTTCALTLEAGEKLLLTTDLKTKESVGRRISQLQDSWKDMEPQLAEMIKQFQSTVETWDQCEKKIKELKSRLQVLKAQSEDPLPELHEDLHNEKELIKELEQSLASWTQNLKELQTMKADLTRHVLVEDVMVLKEQIEHLHRQWEDLCLRVAIRKQEIEDRLNTWVVFNEKNKELCAWLVQMENKVLQTADISIEEMIEKLQKDCMEEINLFSENKLQLKQMGDQLIKASNKSRAAEIDDKLNKINDRWQHLFDVIGSRVKKLKETFAFIQQLDKNMSNLRTWLARIESELSKPVVYDVCDDQEIQKRLAEQQDLQRDIEQHSAGVESVFNICDVLLHDSDACANETECDSIQQTTRSLDRRWRNICAMSMERRMKIEETWRLWQKFLDDYSRFEDWLKSAERTAACPNSSEVLYTSAKEELKRFEAFQRQIHERLTQLELINKQYRRLARENRTDTASRLKQMVHEGNQRWDNLQRRVTAVLRRLRHFTNQREEFEGTRESILVWLTEMDLQLTNVEHFSESDADDKMRQLNGFQQEITLNTNKIDQLIVFGEQLIQKSEPLDAVLIEDELEELHRYCQEVFGRVSRFHRRLTSCTPGLEDEKEASENETDMEDPREIQTDSWRKRGESEEPSSPQSLCHLVAPGHERSGCETPVSVDSIPLEWDHTGDVGGSSSHEEDEEGPYYSALSGKSISDGHSWHVPDSPSCPEHHYKQMEGDRNVPPVPPASSTPYKPPYGKLLLPPGTDGGKEGPRVLNGNPQQEDGGLAGITEQQSGAFDRWEMIQAQELHNKLKIKQNLQQLNSDISAITTWLKKTEAELEMLKMAKPPSDIQEIELRVKRLQEILKAFDTYKALVVSVNVSSKEFLQTESPESTELQSRLRQLSLLWEAAQGAVDSWRGGLRQSLMQCQDFHQLSQNLLLWLASAKNRRQKAHVTDPKADPRALLECRRELMQLEKELVERQPQVDMLQEISNSLLIKGHGEDCIEAEEKVHVIEKKLKQLREQVSQDLMALQGTQNPASPLPSFDEVDSGDQPPATSVPAPRAKQFRAVRTTEGEEETESRVPGSTRPQRSFLSRVVRAALPLQLLLLLLLLLACLLPSSEEDYSCTQANNFARSFYPMLRYTNGPPPT

SEQ ID NO: 4540 - protein, 975 aa, unidentified
MTQQPQDDFDRSVEDAQAWMKAVQDQLQVNDNTQGPRAALEARLWETEKICQLEPEGRVRVDLVLRMAEALLACCPGDQKPGILARLKDIKAQWEETVTYMTHCHSRIEWVWLHWSEYLLARDEFYRWFQKMMVTLEPHIELQLGLKEKQWQLSHAQVLLHNVDNQAVLLDRLLEEAASLFNRIGDPSVDEDAQKRMKAEYDAVKAKAQKRVDLLEQVAREHEEYQAGVDEFQLWLKAVVEKVNGCLGRNCKLPITQRLSTLQDIAKDFPRGEESLETLEEQSAGVIRNTSPLGAEKITGELEEMRKVLEKLRALWEEEEERLRGLLRSRGAWEQQIKQLEAELSEFRMVLQRLAQEGLQPAAKAGTEDELVAHWRRYSATRAALASEEPRVDRLQAQLKELIVFPHNLKPLSDSVIATIQEYQSLKVKSARLRNAAAVELWQHFQRPLQDLQLWKALAQRLLEVTASLPDLPSLHTFLPQIEAALMESSRLKELLTMLQLKKDLLIGIFGQERATALLEQVAGSMRDRDLLHNSLLQRKSKLQSLLAQHKDFGAAFEPLQRKLLDLQVRVQAEKGLQRDLPGKQAQLSRLQGLQEEGLDLGAQMEAARPLVQENPNHQHKMDQLSSDFQALQRSLEDLVDRCRQSVQEHCTFSHQLLELRQWIVVTTQKLEAHRGEAGPGDAESQEAEFERLVAEFPEKEAQLSLVEAQGWLVMEKSSPEGAAVVQEELRELAESWRALRLLEESLLSLIRNWHLQRMEVDSGKKMVFTNNIPKSGFLINPMDPIPRHRRRANLLQEEEGSHEDFSQLLRNFGQWLQVENSKLVRIIAMRTSTAEDLRTRKSKLQELEARVPEGQHLFENLLRLGPARGTSDELEDLRYQWMLYKSKLKDSGHLLTQSSPGEPTGFQKTRRWRGLGSLFRRACCVALPLQLLLLLFLLLLFLLPIREEDRSCTLANNFARSFTLMLRYNGPPPT

SEQ ID NO: 4541 - protein, 404 aa, unidentified
MALSLPLGPRLGSEPLNHPPGAPREADIVGCTVCPASGEESTSPEQAQTLGQDSLGPPEHFQGGPRGNEPAAHPPRWSTPSSYEDPAGGKHCEHPISGLEVLEAEQNSLHLCLLGLGRRLQDLEQGLGHWALAQSGMVQLQALQVDLRGAAERVEALLAFGEGLAQRSEPRAWAALEQILRALGAYRDSIFRRLWQLQAQLVSYSLVFEEANTLDQDLEVEGDSDWPGPGGVWGPWAPSSLPTSTELEWDPAGDIGGLGPLGQKTARTLGVPCELCGQRGPQGRGQGLEEADTSHSRQDMLESGLGHQKRLARHQRHSLLRKPQDKKRQASPHLQDVRLEGNPGAPDPASRQPLTFLLILFLLFLLLVGAMFLLPASGGPCCSHARIPRTPYLVLSYVNGLPPV

SEQ ID NO: 4542 - protein, 233 aa, unidentified
MEGGAYGAGKAGGAFDPYTLVRQPHTILRVVSWLFSIVVFGSIVNEGYLNSASEGEEFCIYNRNPNACSYGVAVGVLAFLTCLLYLALDVYFPQISSVKDRKKAVLSDIGVSAFWAFLWFVGFCYLANQWQVSKPKDNPLNEGTDAARAAIAFSFFSIFTWAGQAVLAFQRYQIGADSALFSQDYMDPSQDSSMPYAPYVEPTGPDPAGMGGTYQQPANTFDTEPQGYQSQGY

SEQ ID NO: 4543 - protein, 224 aa, unidentified
MESGAYGAAKAGGSFDLRRFLTQPQVVARAVCLVFALIVFSCIYGEGYSNAHESKQMYCVFNRNEDACRYGSAIGVLAFLASAFFLVVDAYFPQISNATDRKYLVIGDLLFSALWTFLWFVGFCFLTNQWAVTNPKDVLVGADSVRAAITFSFFSIFSWGVLASLAYQRYKAGVDDFIQNYVDPTPDPNTAYASYPGASVDNYQQPPFTQNAETTEGYQPPPVY

SEQ ID NO: 4544 - protein, 229 aa, unidentified
MEGASFGAGRAGAALDPVSFARRPQTLLRVASWVFSIAVFGPIVNEGYVNTDSGPELRCVFNGNAGACRFGVALGLGAFLACAAFLLLDVRFQQISSVRDRRRAVLLDLGFSGLWSFLWFVGFCFLTNQWQRTAPGPATTQAGDAARAAIAFSFFSILSWVALTVKALQRFRLGTDMSLFATEQLSTGASQAYPGYPVGSGVEGTETYQSPPFTETLDTSPKGYQVPAY

SEQ ID NO: 4545 - protein, 234 aa, unidentified
MHIPKSLQELANSEAVQFLRRPKTITRVFEGVFSLIVFSSLLTDGYQNKMESPQLHCILNSNSVACSFAVGAGFLAFLSCLAFLVLDTQETRIAGTRFKTAFQLLDFILAVLWAVVWFMGFCFLANQWQHSPPKEFLLGSSSAQAAIAFTFFSILVWIFQAYLAFQDLRNDAPVPYKRFLDEGGMVLTTLPLPSANSPVNMPTTGPNSLSYASSALSPCLTAPKSPRLAMMPDN

SEQ ID NO: 4546 - protein, 145 aa, unidentified
MNGRVDYLVTEEEINLTRGPSGLGFNIVGGTDQQYVSNDSGIYVSRIKENGAAALDGRLQEGDKILSVNGQDLKNLLHQDAVDLFRNAGYAVSLRVQHRLQVQNGPIGHRGEGDPSGIPIFMVLVPVFALTMVAAWAFMRYRQQL

SEQ ID NO: 4547 - protein, 265 aa, unidentified
MCMVIFAPLFAIFAFATCGGYSGGLRLSVDCVNKTESNLSIDIAFAYPFRLHQVTFEVPTCEGKERQKLALIGDSSSSAEFFVTVAVFAFLYSLAATVVYIFFQNKYRENNRGPLIDFIVTVVFSFLWLVGSSAWAKGLSDVKVATDPKEVLLLMSACKQPSNKCMAIHSPVMSSLNTSVVFGFLNFILWAGNIWFVFKETGWHSSGQRYLSDPMEKHSSSYNQGGYNQDSYGSSSGYSQQASLGPTSDEFGQQPTGPTSFTNQI

SEQ ID NO: 4548 - protein, 313 aa, unidentified
MLLLADMDVVNQLVAGGQFRVVKEPLGFVKVLQWVFAIFAFATCGSYSGELQLSVDCANKTESDLSIEVEFEYPFRLHQVYFDAPTCRGGTTKVFLVGDYSSSAEFFVTVAVFAFLYSMGALATYIFLQNKYRENNKGPMLDFLATAVFAFMWLVSSSAWAKGLSDVKMATDPENIIKEMPVCRQTGNTCKELRDPVTSGLNTSVVFGFLNLVLWVGNLWFVFKETGWAAPFLRAPPGAPEKQPAPGDAYGDAGYGQGPGGYGPQDSYGPQGGYQPDYGQPAGSGGSGYGPQGDYGQQGYGPQGAPTSFSNQM

SEQ ID NO: 4549 - protein, 259 aa, unidentified
MAPNIYLVRQRISRLGQRMSGFQINLNPLKEPLGFIKVLEWIASIFAFATCGGFKGQTEIQVNCPPAVTENKTVTATFGYPFRLNEASFQPPPGVNICDVNWKDYVLIGDYSSSAQFYVTFAVFVFLYCIAALLLYVGYTSLYLDSRKLPMIDFVVTLVATFLWLVSTSAWAKALTDIKIATGHNIIDELPPCKKKAVLCYFGSVTSMGSLNVSVIFGFLNMILWGGNAWFVYKETSLHSPSNTSAPHSQGGIPPPTGI

SEQ ID NO: 4550 - protein, 272 aa, unidentified
MSSTESAGRTADKSPRQQVDRLLVGLRWRRLEEPLGFIKVLQWLFAIFAFGSCGSYSGETGAMVRCNNEAKDVSSIIVAFGYPFRLHRIQYEMPLCDEESSSKTMHLMGDFSAPAEFFVTLGIFSFFYTMAALVIYLRFHNLYTENKRFPLVDFCVTVSFTFFWLVAAAAWGKGLTDVKGATRPSSLTAAMSVCHGEEAVCSAGATPSMGLANISVLFGFINFFLWAGNCWFVFKETPWHGQGQGQDQDQDQDQGQGPSQESAAEQGAVEKQ

SEQ ID NO: 4551 - protein, 156 aa, unidentified
MAGQFRSYVWDPLLILSQIVLMQTVYYGSLGLWLALVDGLVRSSPSLDQMFDAEILGFSTPPGRLSMMSFILNALTCALGLLYFIRRGKQCLDFTVTVHFFHLLGCWFYSSRFPSALTWWLVQAVCIALMAVIGEYLCMRTELKEIPLNSAPKSNV

SEQ ID NO: 4552 - protein, 422 aa, unidentified
MVSESHHEALAAPPVTTVATVLPSNATEPASPGEGKEDAFSKLKEKFMNELHKIPLPPWALIAIAIVAVLLVLTCCFCICKKCLFKKKNKKKGKEKGGKNAINMKDVKDLGKTMKDQALKDDDAETGLTDGEEKEEPKEEEKLGKLQYSLDYDFQNNQLLVGIIQAAELPALDMGGTSDPYVKVFLLPDKKKKFETKVHRKTLNPVFNEQFTFKVPYSELGGKTLVMAVYDFDRFSKHDIIGEFKVPMNTVDFGHVTEEWRDLQSAEKEEQEKLGDICFSLRYVPTAGKLTVVILEAKNLKKMDVGGLSDPYVKIHLMQNGKRLKKKKTTIKKNTLNPYYNESFSFEVPFEQIQKVQVVVTVLDYDKIGKNDAIGKVFVGYNSTGAELRHWSDMLANPRRPIAQWHTLQVEEEVDAMLAVKK

SEQ ID NO: 4553 - protein, 523 aa, unidentified
MSFHKEDGVNSLCQKALHIVTELCFAGQVEWEKCSGIFPRDRGSQGGSSTDISVSLLAVVVSFCGLALLVVSLFVFWKLCWPCWKSKPVTSNITTLPQSISSAPTEVFETEEKKEIKENEKPAVKAIEPAIKISHTSPDIPAEVQTALKEHLIKHARVQRQITEPTSSTRHSSFRRHLPRQMQVSSVDFSMGTEPVLQRGETTTSIGRIKPELYKQKSVDSEGNQNEDVKICGKLNFTLQYDYENELLVVKIIKALDLPAKDFTGTSDPYVKMYLLPDRKKKFQTRVHRKTLNPLFDETFQFPVAYDQLSNRKLHFSVYDFDRFSRHDMIGEVILDNLFEVSDLSREATVWKDIHCATTESIDLGEIMFSLCYLPTAGRMTLTVIKCRNLKAMDITGSSDPYVKVSLMCEGRRLKKRKTTTKKNTLNPVYNEAIIFDIPPENVDQVSLSIAVMDYDRVGHNEVIGVCRTGLDAEGLGRDHWNEMLAYHRKPITHWHPLLELPGRATSFDSQGSCPSPKPPSTP

SEQ ID NO: 4554 - protein, 555 aa, unidentified
MAIEGGERTCGVHELICIRKVSPEAVGFLSAVGVFIILMLLLFLYINKKFCFENVGGFPDLGSEYSTRKNSQDKIYNSYMDKDEHGSSSESEDEALGKYHEALSRTHNSRLPLADSRQRNYAWETRQKYSPLSAEYDGYSSEASIDEGNCIQRMRRTPPLDELQPPPYQDDSGSPHLSCTPSEIGDSKCEFSHCSNSPRCSYNKCPSEGSTGHEIESFHNKGYEEDVPSDSTAVLSPEDMSAQGSSSQLPKPFDPEPEAKYGTLDVTFDYDSQEQKLLVTVTAVTDIPTYNRTGGNSWQVHLVLLPIKKQRAKTSIQRGPCPVFTETFKFNHVESEMIGNYAVRFRLYGVHRMKKEKIVGEKIFYLTKLNLQGKMSLPVILEPSYNHSGCDSQMSVSEMSCSESTSSCQSLEHGSVPEILIGLLYNATTGRLSAEVIKGSHFKNLAANRPPNTYVKLTLLNSMGQEMSKCKTSIRRGQPNPVYKETFVFQVALFQLSDVTLILSVYNKRSMKRKEMIGWISLGLNSSGEEELNHWTEMKESKGQQVCRWHALLES

SEQ ID NO: 4555 - protein, 421 aa, unidentified
MAEQLALVIGGTIGGLLLLLLIGASCCLWRRFCATLTYEELPGTPAMATTAASSGQRDRPCQPHARTQLSRPPAVPFVVPPTLQGRDWVPLHSGEWADAPWDPCPASELLPHTSSGGLGDACMVGAINPELYKFPEDKSETDFPDGCLGRLWFSVEYEQEAERLLVGLIKAQHLQAPSETCSPLVKLYLLPDERRFLQSKTKRKTSNPQFDEHFIFQVSSKTITQRVLKFSVYHVDRQRKHQLLGQVLFPLKNETLVGDCRRVIWRDLEAESLEPPSEFGDLQFCLSYNDYLSRLTVVVLRAKGLRLQEDRGIVSVFVKVSLMNHNKFVKCKKTSAVLGSINPVYNETFSFKADATELDTASLSLTVVQNMEGDKSQQLGRVVVGPYMYTRGRELEHWDEMLSKPKELVKRWHALCRTTEP

SEQ ID NO: 4556 - protein, 645 aa, unidentified
MVLAMASQDVQNFFQPFSSWISRVYEALQQAGDMLSASLVNISKQDSKLSDKLDQDLDNIQIQETYFEDEEQDNDWSQEDANSLFLEVDHFSCCNSDLQDSAQNSSPSLSQHAKDSCSTMSQWPNWASDDRKLPHVLSSIAEEEHHLEKQRSGLQHGFDSQLPGTLETVNGKKQVNSFGDDEELSTSSDSDEEVIKQFEISVSRSQSFRSVTSEKGKQTGLEQKPKFSRSLLTHGEDGTEVSACEDLDGASQRRYSENLSYGEDDHIPAHSQSPCERGDAKHHGTSHQESSVVQSLRRQSTEGSLEMETAFNSRGFEDSYATDSSSMWSPEEQDRTNLQVPSGVSEPISKCGDLDVIFEYRAASQKLTVTIVRAQGLPDKDRSGVNSWQVHVVLLPGKKHRGRTNIQRGPNPVFREKVTFAKLEPRDVAACAVRFRLYAARKMTRERMMGEKLFYLSHLHPEGEMKVTLVLEPRSNISSGGSPLSPSAVSHSDSTSSTQSLSHGGAPELLVGLSYNATTGRLSVEMIKGSHFRNLAVNRAPDTYGKLFLLNSVGQEMSRCKTSIRRGQPNPVYKETFVFQVALFQLSDVTLMISVYNRRTMKRKEMIGWIALGQNSSGEEEQDHWEEMKETKGQQICRWHTLLES

SEQ ID NO: 4557 - protein, 419 aa, unidentified
MRNIFKRNQEPIVAPATTTATMPIGPVDNSTESGGAGESQEDMFAKLKEKLFNEINKIPLPPWALIAIAVVAGLLLLTCCFCICKKCCCKKKKNKKEKGKGMKNAMNMKDMKGGQDDDDAETGLTEGEGEGEEEKEPENLGKLQFSLDYDFQANQLTVGVLQAAELPALDMGGTSDPYVKVFLLPDKKKKYETKVHRKTLNPAFNETFTFKVPYQELGGKTLVMAIYDFDRFSKHDIIGEVKVPMNTVDLGQPIEEWRDLQGGEKEEPEKLGDICTSLRYVPTAGKLTVCILEAKNLKKMDVGGLSDPYVKIHLMQNGKRLKKKKTTVKKKTLNPYFNESFSFEIPFEQIQKVQVVVTVLDYDKLGKNEAIGKIFVGSNATGTELRHWSDMLANPRRPIAQWHSLKPEEEVDALLGKNK

SEQ ID NO: 4558 - protein, 590 aa, unidentified
MSGDYEDDLCRRALILVSDLCARVRDADTNDRCQEFNDRIRGYPRGPDADISVSLLSVIVTFCGIVLLGVSLFVSWKLCWVPWRDKGGSAVGGGPLRKDLGPGVGLAGLVGGGGHHLAAGLGGHPLLGGPHHHAHAAHHPPFAELLEPGSLGGSDTPEPSYLDMDSYPEAAAAAVAAGVKPSQTSPELPSEGGAGSGLLLLPPSGGGLPSAQSHQQVTSLAPTTRYPALPRPLTQQTLTSQPDPSSEERPPALPLPLPGGEEKAKLIGQIKPELYQGTGPGGRRSGGGPGSGEAGTGAPCGRISFALRYLYGSDQLVVRILQALDLPAKDSNGFSDPYVKIYLLPDRKKKFQTKVHRKTLNPVFNETFQFSVPLAELAQRKLHFSVYDFDRFSRHDLIGQVVLDNLLELAEQPPDRPLWRDIVEGGSEKADLGELNFSLCYLPTAGRLTVTIIKASNLKAMDLTGFSDPYVKASLISEGRRLKKRKTSIKKNTLNPTYNEALVFDVAPESVENVGLSIAVVDYDCIGHNEVIGVCRVGPDAADPHGREHWAEMLANPRKPVEHWHQLVEEKTVTSFTKGSKGLSEKENSE

SEQ ID NO: 4559 - protein, 386 aa, unidentified
MFPEPPTPGPPSPDTPPDSSRISHGPVPPWALATIVLVSGLLIFSCCFCLYRKSCRRRTGKKSQAQAQVHLQEVKGLGQSYIDKVQPEVEELEPAPSGPGQQVADKHELGRLQYSLDYDFQSGQLLVGILQAMGLAALDLGGSSDPYVRVYLLPDKRRRYETKVHRQTLNPHFGETFAFKVPYVELGGRVLVMAVYDFDRFSRNDAIGEVRVPMSSVDLGRPVQAWRELQAAPREEQEKLGDICFSLRYVPTAGKLTVIVLEAKNLKKMDVGGLSDPYVKVHLLQGGKKVRKKKTTIKKNTLNPYYNEAFSFEVPCDQVQKVQVELTVLDYDKLGKNEAIGRVAVGAAAGGAGLRHWADMLANPRRPIAQWHSLRPPDRVRLLPAP

SEQ ID NO: 4560 - protein, 510 aa, unidentified
MSGVWGAGGPRCQEALAVLASLCRARPPPLGLDVETCRSFELQPPERSPSAAGAGTSVSLLAVVVIVCGVALVAVFLFLFWKLCWMPWRNKEASSPSSANPPLEALQSPSFRGNMADKLKDPSTLGFLEAAVKISHTSPDIPAEVQMSVKEHIMRHTRLQRQTTEPASSTRHTSFKRHLPRQMHVSSVDYGNELPPAAEQPTSIGRIKPELYKQKSVDGEDAKSEATKSCGKINFSLRYDYETETLIVRILKAFDLPAKDFCGSSDPYVKIYLLPDRKCKLQTRVHRKTLNPTFDENFHFPVPYEELADRKLHLSVFDFDRFSRHDMIGEVILDNLFEASDLSRETSIWKDIQYATSESVDLGEIMFSLCYLPTAGRLTLTVIKCRNLKAMDITGYSDPYVKVSLLCDGRRLKKKKTTIKKNTLNPVYNEAIIFDIPPENMDQVSLLISVMDYDRVGHNEIIGVCRVGITAEGLGRDHWNEMLAYPRKPIAHWHSLVEVKKSFKEGNPRL

SEQ ID NO: 4561 - protein, 403 aa, unidentified
MYRDPEAASPGAPSRDVLLVSAIITVSLSVTVVLCGLCHWCQRKLGKRYKNSLETVGTPDSGRGRSEKKAIKLPAGGKAVNTAPVPGQTPHDESDRRTEPRSSVSDLVNSLTSEMLMLSPGSEEDEAHEGCSRENLGRIQFSVGYNFQESTLTVKIMKAQELPAKDFSGTSDPFVKIYLLPDKKHKLETKVKRKNLNPHWNETFLFEGFPYEKVVQRILYLQVLDYDRFSRNDPIGEVSIPLNKVDLTQMQTFWKDLKPCSDGSGSRGELLLSLCYNPSANSIIVNIIKARNLKAMDIGGTSDPYVKVWLMYKDKRVEKKKTVTMKRNLNPIFNESFAFDIPTEKLRETTIIITVMDKDKLSRNDVIGKIYLSWKSGPGEVKHWKDMIARPRQPVAQWHQLKA

SEQ ID NO: 4562 - protein, 401 aa, unidentified
MLHLHGWQTMQGRKMGHPPVSPSAPAPAGTTAIPGLIPDLVAGTPWPRWALIAGALAAGVLLVSCLLCAACCCCRRHRKKPRDKESVGLGSARGTTTTHLVQPDVDGLESSPGDAQQWGCLQLSLEFDFGSQEIRVGLRQAADLRPGGTVDPYARVSVSTQAGHRHETKVHRGTLCPVFDETCCFHIPQAELPGATLQVQLFNFKRFSGHEPLGELRLPLGTVDLQHVLEHWYLLGPPAATQPEQVGELCFSLRYVPSSGRLTVVVLEARGLRPGLAEPYVKVQLMLNQRKWKKRKTATKKGTAAPYFNEAFTFLVPFSQVQNVDLVLAVWDRSLPLRTEPVGKVHLGARASGQPLQHWADMLAHARRPIAQRHPLRPAREVDRMLALQPRLRLRLPLPHS

SEQ ID NO: 4563 - protein, 491 aa, unidentified
MPGARDALCHQALQLLAELCARGALEHDSCQDFIYHLRDRARPRLRDPDISVSLLTLVVTACGLALFGVSLFVSWKLCWVPWRERGLPSGSKDNNQEPLNYMDTETNEQENSEDFLDPPTPCPDSSMKISHTSPDIPLSTQTGIQENCAHGVRVQRQVTEPTSSARHNSIRRQLNLSNPDFNIQQLQKQEQLTGIGRIKPELYKQRSLDNDDGRRSNSKACGKLNFILKYDCDLEQLIVKIHKAVNLPAKDFSGTSDPYVKIYLLPDRKTKHQTKVHRKTLNPVFDEVFLFPVPYNDLEARKLHFSVYDFDRFSRHDLIGQVVVDHFLDLADFPRECILWKDIEYVTNDNVDLGELMFSLCYLPTAGRLTITIIKARNLKAMDITGASDPYVKVSLMCDGRRLKKRKTSTKRNTLNPVYNEAIVFDVPPENIDQIHLSIAVMDYDRVGHNEIIGVCQVGNEAERLGRDHWSEMLSYPRKPIAHWHSLVEKR

SEQ ID NO: 4564 - protein, 617 aa, unidentified
MFRTAVMMAASLALTGAVVAHAYYLKHQFYPTVVYLTKSSPSMAVLYIQAFVLVFLLGKVMGKVFFGQLRAAEMEHLLERSWYAVTETCLAFTVFRDDFSPRFVALFTLLLFLKCFHWLAEDRVDFMERSPNISWLFHCRIVSLMFLLGILDFLFVSHAYHSILTRGASVQLVFGFEYAILMTMVLTIFIKYVLHSVDLQSENPWDNKAVYMLYTELFTGFIKVLLYMAFMTIMIKVHTFPLFAIRPMYLAMRQFKKAVTDAIMSRRAIRNMNTLYPDATPEELQAMDNVCIICREEMVTGAKRLPCNHIFHTSCLRSWFQRQQTCPTCRMDVLRASLPAQSPPPPEPADQGPPPAPHPPPLLPQPPNFPQGLLPPFPPGMFPLWPPMGPFPPVPPPPSSGEAVAPPSTSAAALSRPSGAATTTAAGTSATAASATASGPGSGSAPEAGPAPGFPFPPPWMGMPLPPPFAFPPMPVPPAGFAGLTPEELRALEGHERQHLEARLQSLRNIHTLLDAAMLQINQYLTVLASLGPPRPATSVNSTEETATTVVAAASSTSIPSSEATTPTPGASPPAPEMERPPAPESVGTEEMPEDGEPDAAELRRRRLQKLESPVAH

SEQ ID NO: 4565 - protein, 339 aa, unidentified
MMPFCHNIINISCVKNNWSNDVRASLYSLMVLIILTTLVGNLIVIVSISHFKQLHTPTNWLIHSMATVDFLLGCLVMPYSMVRSAEHCWYFGEVFCKIHTSTDIMLSSASIFHLSFISIDRYYAVCDPLRYKAKMNILVICVMIFISWSVPAVFAFGMIFLELNFKGAEEIYYKHVHCRGGCSVFFSKISGVLTFMTSFYIPGSIMLCVYYRIYLIAKEQARLISDANQKLQIGLEMKNGISQSKERKAVKTLGIVMGVFLICWCPFFICTVMDPFLHYIIPPTLNDVLIWFGYLNSTFNPMVYAFFYPWFRKALKMMLFGKIFQKDSSRCKLFLELSS

SEQ ID NO: 4566 - protein, 351 aa, unidentified
MAVSSEQHELSHFKRTQTKKEKFNCSEYGNRSCPENERSLGVRVAMYSFMAGSIFITIFGNLAMIISISYFKQLHTPTNFLILSMAITDFLLGFTIMPYSMIRSVENCWYFGLTFCKIYYSFDLMLSITSIFHLCSVAIDRFYAICYPLLYSTKITIPVIKRLLLLCWSVPGAFAFGVVFSEAYADGIEGYDILVACSSSCPVMFNKLWGTTLFMAGFFTPGSMMVGIYGKIFAVSRKHAHAINNLRENQNNQVKKDKKAAKTLGIVIGVFLLCWFPCFFTILLDPFLNFSTPVVLFDALTWFGYFNSTCNPLIYGFFYPWFRRALKYILLGKIFSSCFHNTILCMQKESE

SEQ ID NO: 4567 - protein, 337 aa, unidentified
MRAVFIQGAEEHPAAFCYQVNGSCPRTVHTLGIQLVIYLACAAGMLIIVLGNVFVAFAVSYFKALHTPTNFLLLSLALADMFLGLLVLPLSTIRSVESCWFFGDFLCRLHTYLDTLFCLTSIFHLCFISIDRHCAICDPLLYPSKFTVRVALRYILAGWGVPAAYTSLFLYTDVVETRLSQWLEEMPCVGSCQLLLNKFWGWLNFPLFFVPCLIMISLYVKIFVVATRQAQQITTLSKSLAGAAKHERKAAKTLGIAVGIYLLCWLPFTIDTMVDSLLHFITPPLVFDIFIWFAYFNSACNPIIYVFSYQWFRKALKLTLSQKVFSPQTRTVDLYQE

SEQ ID NO: 4568 - protein, 345 aa, unidentified
MSSNSSLLVAVQLCYANVNGSCVKIPFSPGSRVILYIVFGFGAVLAVFGNLLVMISILHFKQLHSPTNFLVASLACADFLVGVTVMPFSMVRTVESCWYFGRSFCTFHTCCDVAFCYSSLFHLCFISIDRYIAVTDPLVYPTKFTVSVSGICISVSWILPLMYSGAVFYTGVYDDGLEELSDALNCIGGCQTVVNQNWVLTDFLSFFIPTFIMIILYGNIFLVARRQAKKIENTGSKTESSSESYKARVARRERKAAKTLGVTVVAFMISWLPYSIDSLIDAFMGFITPACIYEICCWCAYYNSAMNPLIYALFYPWFRKAIKVIVTGQVLKNSSATMNLFSEHI

SEQ ID NO: 4569 - protein, 342 aa, unidentified
MTSNFSQPVVQLCYEDVNGSCIETPYSPGSRVILYTAFSFGSLLAVFGNLLVMTSVLHFKQLHSPTNFLIASLACADFLVGVTVMLFSMVRTVESCWYFGAKFCTLHSCCDVAFCYSSVLHLCFICIDRYIVVTDPLVYATKFTVSVSGICISVSWILPLTYSGAVFYTGVNDDGLEELVSALNCVGGCQIIVSQGWVLIDFLLFFIPTLVMIILYSKIFLIAKQQAIKIETTSSKVESSSESYKIRVAKRERKAAKTLGVTVLAFVISWLPYTVDILIDAFMGFLTPAYIYEICCWSAYYNSAMNPLIYALFYPWFRKAIKLILSGDVLKASSSTISLFLE

SEQ ID NO: 4570 - protein, 407 aa, unidentified
MDNVLPVDSDLSPNISTNTSEPNQFVQPAWQIVLWAAAYTVIVVTSVVGNVVVMWIILAHKRMRTVTNYFLVNLAFAEASMAAFNTVVNFTYAVHNEWYYGLFYCKFHNFFPIAAVFASIYSMTAVAFDRYMAIIHPLQPRLSATATKVVICVIWVLALLLAFPQGYYSTTETMPSRVVCMIEWPEHPNKIYEKVYHICVTVLIYFLPLLVIGYAYTVVGITLWASEIPGDSSDRYHEQVSAKRKVVKMMIVVVCTFAICWLPFHIFFLLPYINPDLYLKKFIQQVYLAIMWLAMSSTMYNPIIYCCLNDRFRLGFKHAFRCCPFISAGDYEGLEMKSTRYLQTQGSVYKVSRLETTISTVVGAHEEEPEDGPKATPSSLDLTSNCSSRSDSKTMTESFSFSSNVLS

SEQ ID NO: 4571 - protein, 398 aa, unidentified
MGTCDIVTEANISSGPESNTTGITAFSMPSWQLALWATAYLALVLVAVTGNAIVIWIILAHRRMRTVTNYFIVNLALADLCMAAFNAAFNFVYASHNIWYFGRAFCYFQNLFPITAMFVSIYSMTAIAADRYMAIVHPFQPRLSAPSTKAVIAGIWLVALALASPQCFYSTVTMDQGATKCVVAWPEDSGGKTLLLYHLVVIALIYFLPLAVMFVAYSVIGLTLWRRAVPGHQAHGANLRHLQAMKKFVKTMVLVVLTFAICWLPYHLYFILGSFQEDIYCHKFIQQVYLALFWLAMSSTMYNPIIYCCLNHRFRSGFRLAFRCCPWVTPTKEDKLELTPTTSLSTRVNRCHTKETLFMAGDTAPSEATSGEAGRPQDGSGLWFGYGLLAPTKTHVEI

SEQ ID NO: 4572 - protein, 465 aa, unidentified
MATLPAAETWIDGGGGVGADAVNLTASLAAGAATGAVETGWLQLLDQAGNLSSSPSALGLPVASPAPSQPWANLTNQFVQPSWRIALWSLAYGVVVAVAVLGNLIVIWIILAHKRMRTVTNYFLVNLAFSDASMAAFNTLVNFIYALHSEWYFGANYCRFQNFFPITAVFASIYSMTAIAVDRYMAIIDPLKPRLSATATKIVIGSIWILAFLLAFPQCLYSKTKVMPGRTLCFVQWPEGPKQHFTYHIIVIILVYCFPLLIMGITYTIVGITLWGGEIPGDTCDKYHEQLKAKRKVVKMMIIVVMTFAICWLPYHIYFILTAIYQQLNRWKYIQQVYLASFWLAMSSTMYNPIIYCCLNKRFRAGFKRAFRWCPFIKVSSYDELELKTTRFHPNRQSSMYTVTRMESMTVVFDPNDADTTRSSRKKRATPRDPSFNGCSRRNSKSASATSSFISSPYTSVDEYS

SEQ ID NO: 4573 - protein, 323 aa, unidentified
MARGPGLAPPPLRLPLLLLVLAAVTGHTAAQDNCTCPTNKMTVCSPDGPGGRCQCRALGSGMAVDCSTLTSKCLLLKARMSAPKNARTLVRPSEHALVDNDGLYDPDCDPEGRFKARQCNQTSVCWCVNSVGVRRTDKGDLSLRCDELVRTHHILIDLRHRPTAGAFNHSDLDAELRRLFRERYRLHPKFVAAVHYEQPTIQIELRQNTSQKAAGDVDIGDAAYYFERDIKGESLFQGRGGLDLRVRGEPLQVERTLIYYLDEIPPKFSMKRLTAGLIAVIVVVVVALVAGMAVLVITNRRKSGKYKKVEIKELGELRKEPSL

SEQ ID NO: 4574 - protein, 592 aa, unidentified
MSDSGSYGQSGGEQQSYSTYGNPGSQGYGQASQSYSGYGQTTDSSYGQNYSGYSSYGQSQSGYSQSYGGYENQKQSSYSQQPYNNQGQQQNMESSGSQGGRAPSYDQPDYGQQDSYDQQSGYDQHQGSYDEQSNYDQQHDSYSQNQQSYHSQRENYSHHTQDDRRDVSRYGEDNRGYGGSQGGGRGRGGYDKDGRGPMTGSSGGDRGGFKNFGGHRDYGPRTDADSESDNSDNNTIFVQGLGEGVSTDQVGEFFKQIGIIKTNKKTGKPMINLYTDKDTGKPKGEATVSFDDPPSAKAAIDWFDGKEFHGNIIKVSFATRRPEFMRGGGSGGGRRGRGGYRGRGGFQGRGGDPKSGDWVCPNPSCGNMNFARRNSCNQCNEPRPEDSRPSGGDFRGRGYGGERGYRGRGGRGGDRGGYGGDRSGGGYGGDRSSGGGYSGDRSGGGYGGDRSGGGYGGDRGGGYGGDRGGGYGGDRGGGYGGDRGGYGGDRGGGYGGDRGGYGGDRGGYGGDRGGYGGDRGGYGGDRSRGGYGGDRGGGSGYGGDRSGGYGGDRSGGGYGGDRGGGYGGDRGGYGGKMGGRNDYRNDQRNRPY

SEQ ID NO: 4575 - protein, 588 aa, unidentified
MDLEEAEEFKERCTQCAAVSWGLTDEGKYYCTSCHNVTERYQEVTNTDLIPNTQIKALNRGLKKKNNTEKGWDWYVCEGFQYILYQQAEALKNLGVGPELKNDVLHNFWKRYLQKSKQAYCKNPVYTTGRKPTVLEDNLSHSDWASEPELLSDVSCPPFLESGAESQSDIHTRKPFPVSKASQSETSVCSGSLDGVEYSQRKEKGIVKMTMPQTLAFCYLSLLWQREAITLSDLLRFVEEDHIPYINAFQHFPEQMKLYGRDRGIFGIESWPDYEDIYKKTVEVGTFLDLPRFPDITEDCYLHPNILCMKYLMEVNLPDEMHSLTCHVVKMTGMGEVDFLTFDPIAKMAKTVKYDVQAVAIIVVVLKLLFLLDDSFEWSLSNLAEKHNEKNKKDKPWFDFRKWYQIMKKAFDEKKQKWEEARAKYLWKSEKPLYYSFVDKPVAYKKREMVVNLQKQFSTLVESTATAGKKSPSSFQFNWTEEDTDRTCFHGHSLQGVLKEKGQSLLTKNSLYWLSTQKFCRCYCTHVTTYEESNYSLSYQFILNLFSFLLRIKTSLLHEEVSLVEKKLFEKKYSVKRKKSRSKKVRRH

SEQ ID NO: 4576 - protein, 278 aa, unidentified
MDKSGIDSLDHVTSDAVELANRSDNSSDSSLFKTQCIPYSPKGEKRNPIRKFVRTPESVHASDSSSDSSFEPIPLTIKAIFERFKNRKKRYKKKKKRRYQPTGRPRGRPEGRRNPIYSLIDKKKQFRSRGSGFPFLESENEKNAPWRKILTFEQAVARGFFNYIEKLKYEHHLKESLKQMNVGEDLENEDFDSRRYKFLDDDGSISPIEESTAEDEDATHLEDNECDIKLAGDSFIVSSEFPVRLSVYLEEEDITEEAALSKKRATKAKNTGQRGLKM

SEQ ID NO: 4577 - protein, 1094 aa, unidentified
MAARQAVGSGAQETCGLDRILEALKLLLSPGGSGSSSLQVTKHDVLLATLKSNLSALEDKFLKDPQWKNLKLLRDEIADKAEWPQNSVDVTWSFTSQTLLLLLCLKETMIRLAANFNPGKPNPRTPEVAPALSPDALSISQQKTVQFVLQFVVTLGICPYLMPGVGVPLRYRTEFGAVVQDVVCFDAAPDATRRLYTSCKALLNVAQHTSLGSLIFCHHFGDIAAGLCQLGFCPTKRKLLTPAEEVLTEEERTLSRGALRDMLDQVYQPLAVRELLILQGGPPQSCTDVKTQMRCRAPAWLRRLCGQLLSERLMRPNGVQAVVRGILEGAGAGAAGGSDAEVTAADWKKCDLIAKILASCPQQSLSPENYYRDICPQVLDLFHFQDKLTARQFQRVATTTFITLSRERPHLAAKYLLQPVLAPLHRCLNTAELSESDMVPGTILVTEEELSRCIEDVFKVYVVGNEPLTVLMDSLLPVLGVLFLLYCFTKQSVSHIRSLCQEILLWILGKLERKKAIASLKGFAGLDKAVPSLHSLCQFRVATQGGIMITIKEAISDEDEDEALYQKVSSEQGRVEHLGDLLSHCQECGLAGDFFIFCLKELTHVASENETELKTEPFSSKSLLELEQHQTLLVEGQERKLLVLQLMAVLCERMSEQIFTNVTQVVDFVAATLQRACASLAHQAESTVESQTLSMSMGLVAVMLGGAVQLKSSDFAVLKQLLPLLEKVSNTYPDPVIQELAVDLRITISTHGAFATEAVSMAAQSTLNRKDLEGKIEEQQQTSHERPTDVAHSHLEQQQSHETAPQTGLQSNAPIIPQGVNEPSTTTSQKSGSVTTEQLQEVLLSAYDPQIPTRAAALRTLSHWIEQREAKALEMQEKLLKIFLENLEHEDTFVYLSAIQGVALLSDVYPEKILPDLLAQYDSSKDKHTPETRMKVGEVLMRIVRALGDMVSKYREPLIHTFLRGVRDPDGAHRASSLANLGELCQRLDFLLGSVVHEVTACLIAVAKTDGEVQVRRAAIHVVVLLLRGLSQKATEVLSAVLKDLYHLLKHVVCLEPDDVAKLHAQLALEELDDIMKNFLFPPQKLEKKIMVLP

SEQ ID NO: 4578 - protein, 1235 aa, unidentified
MPAGGRAGSLKDPDVAELFFKDDPEKLFSDLREIGHGSFGAVYFARDVRNSEVVAIKKMSYSGKQSNEKWQDIIKEVRFLQKLRHPNTIQYRGCYLREHTAWLVMEYCLGSASDLLEVHKKPLQEVEIAAVTHGALQGLAYLHSHNMIHRDVKAGNILLSEPGLVKLGDFGSASIMAPANSFVGTPYWMAPEVILAMDEGQYDGKVDVWSLGITCIELAERKPPLFNMNAMSALYHIAQNESPVLQSGHWSEYFRNFVDSCLQKIPQDRPTSEVLLKHRFVLRERPPTVIMDLIQRTKDAVRELDNLQYRKMKKILFQEAPNGPGAEAPEEEEEAEPYMHRAGTLTSLESSHSVPSMSISASSQSSSVNSLADASDNEEEEEEEEEEEEEEEGPEAREMAMMQEGEHTVTSHSSIIHRLPGSDNLYDDPYQPEITPSPLQPPAAPAPTSTTSSARRRAYCRNRDHFATIRTASLVSRQIQEHEQDSALREQLSGYKRMRRQHQKQLLALESRLRGEREEHSARLQRELEAQRAGFGAEAEKLARRHQAIGEKEARAAQAEERKFQQHILGQQKKELAALLEAQKRTYKLRKEQLKEELQENPSTPKREKAEWLLRQKEQLQQCQAEEEAGLLRRQRQYFELQCRQYKRKMLLARHSLDQDLLREDLNKKQTQKDLECALLLRQHEATRELELRQLQAVQRTRAELTRLQHQTELGNQLEYNKRREQELRQKHAAQVRQQPKSLKVRAGQRPPGLPLPIPGALGPPNTGTPIEQQPCSPGQEAVLDQRMLGEEEEAVGERRILGKEGATLEPKQQRILGEESGAPSPSPQKHGSLVDEEVWGLPEEIEELRVPSLVPQERSIVGQEEAGTWSLWGKEDESLLDEEFELGWVQGPALTPVPEEEEEEEEGAPIGTPRDPGDGCPSPDIPPEPPPTHLRPCPASQLPGLLSHGLLAGLSFAVGSSSGLLPLLLLLLLPLLAAQGGGGLQAALLALEVGLVGLGASYLLLCTALHLPSSLFLLLAQGTALGAVLGLSWRRGLMGVPLGLGAAWLLAWPGLALPLVAMAAGGRWVRQQGPRVRRGISRLWLRVLLRLSPMAFRALQGCGAVGDRGLFALYPKTNKDGFRSRLPVPGPRRRNPRTTQHPLALLARVWVLCKGWNWRLARASQGLASHLPPWAIHTLASWGLLRGERPTRIPRLLPRSQRQLGPPASRQPLPGTLAGRRSRTRQSRALPPWR

SEQ ID NO: 4579 - protein, 808 aa, unidentified
MAELLASAGSACSWDFPRAPPSFPPPAASRGGLGGTRSFRPHRGAESPRPGRDRDGVRVPMASSRCPAPRGCRCLPGASLAWLGTVLLLLADWVLLRTALPRIFSLLVPTALPLLRVWAVGLSRWAVLWLGACGVLRATVGSKSENAGAQGWLAALKPLAAALGLALPGLALFRELISWGAPGSADSTRLLHWGSHPTAFVVSYAAALPAAALWHKLGSLWVPGGQGGSGNPVRRLLGCLGSETRRLSLFLVLVVLSSLGEMAIPFFTGRLTDWILQDGSADTFTRNLTLMSILTIASAVLEFVGDGIYNNTMGHVHSHLQGEVFGAVLRQETEFFQQNQTGNIMSRVTEDTSTLSDSLSENLSLFLWYLVRGLCLLGIMLWGSVSLTMVTLITLPLLFLLPKKVGKWYQLLEVQVRESLAKSSQVAIEALSAMPTVRSFANEEGEAQKFREKLQEIKTLNQKEAVAYAVNSWTTSISGMLLKVGILYIGGQLVTSGAVSSGNLVTFVLYQMQFTQAVEVLLSIYPRVQKAVGSSEKIFEYLDRTPRCPPSGLLTPLHLEGLVQFQDVSFAYPNRPDVLVLQGLTFTLRPGEVTALVGPNGSGKSTVAALLQNLYQPTGGQLLLDGKPLPQYEHRYLHRQVAAVGQEPQVFGRSLQENIAYGLTQKPTMEEITAAAVKSGAHSFISGLPQGYDTEVDEAGSQLSGGQRQAVALARALIRKPCVLILDDATSALDANSQLQVEQLLYESPERYSRSVLLITQHLSLVEQADHILFLEGGAIREGGTHQQLMEKKGCYWAMVQAPADAPE

SEQ ID NO: 4580 - protein, 686 aa, unidentified
MRLPDLRPWTSLLLVDAALLWLLQGPLGTLLPQGLPGLWLEGTLRLGGLWGLLKLRGLLGFVGTLLLPLCLATPLTVSLRALVAGASRAPPARVASAPWSWLLVGYGAAGLSWSLWAVLSPPGAQEKEQDQVNNKVLMWRLLKLSRPDLPLLVAAFFFLVLAVLGETLIPHYSGRVIDILGGDFDPHAFASAIFFMCLFSFGSSLSAGCRGGCFTYTMSRINLRIREQLFSSLLRQDLGFFQETKTGELNSRLSSDTTLMSNWLPLNANVLLRSLVKVVGLYGFMLSISPRLTLLSLLHMPFTIAAEKVYNTRHQEVLREIQDAVARAGQVVREAVGGLQTVRSFGAEEHEVCRYKEALEQCRQLYWRRDLERALYLLVRRVLHLGVQMLMLSCGLQQMQDGELTQGSLLSFMIYQESVGSYVQTLVYIYGDMLSNVGAAEKVFSYMDRQPNLPSPGTLAPTTLQGVVKFQDVSFAYPNRPDRPVLKGLTFTLRPGEVTALVGPNGSGKSTVAALLQNLYQPTGGQVLLDEKPISQYEHCYLHSQVVSVGQEPVLFSGSVRNNIAYGLQSCEDDKVMAAAQAAHADDFIQEMEHGIYTDVGEKGSQLAAGQKQRLAIARALVRDPRVLILDEATSALDVQCEQALQDWNSRGDRTVLVIAHRLQTVQRAHQILVLQEGKLQKLAQL

SEQ ID NO: 4581 - protein, 448 aa, unidentified
MKSLSLLLAVALGLATAVSAGPAVIECWFVEDASGKGLAKRPGALLLRQGPGEPPPRPDLDPELYLSVHDPAGALQAAFRRYPRGAPAPHCEMSRFVPLPASAKWASGLTPAQNCPRALDGAWLMVSISSPVLSLSSLLRPQPEPQQEPVLITMATVVLTVLTHTPAPRVRLGQDALLDLSFAYMPPTSEAASSLAPGPPPFGLEWRRQHLGKGHLLLAATPGLNGQMPAAQEGAVAFAAWDDDEPWGPWTGNGTFWLPRVQPFQEGTYLATIHLPYLQGQVTLELAVYKPPKVSLMPATLARAAPGEAPPELLCLVSHFYPSGGLEVEWELRGGPGGRSQKAEGQRWLSALRHHSDGSVSLSGHLQPPPVTTEQHGARYACRIHHPSLPASGRSAEVTLEVAGLSGPSLEDSVGLFLSAFLLLGLFKALGWAAVYLSTCKDSKKKAE

SEQ ID NO: 4582 - protein, 468 aa, unidentified
MGTQEGWCLLLCLALSGAAETKPHPAEGQWRAVDVVLDCFLAKDGAHRGALASSEDRARASLVLKQVPVLDDGSLEDFTDFQGGTLAQDDPPIIFEASVDLVQIPQAEALLHADCSGKEVTCEISRYFLQMTETTVKTAAWFMANMQVSGGGPSISLVMKTPRVTKNEALWHPTLNLPLSPQGTVRTAVEFQVMTQTQSLSFLLGSSASLDCGFSMAPGLDLISVEWRLQHKGRGQLVYSWTAGQGQAVRKGATLEPAQLGMARDASLTLPGLTIQDEGTYICQITTSLYRAQQIIQLNIQASPKVRLSLANEALLPTLICDIAGYYPLDVVVTWTREELGGSPAQVSGASFSSLRQSVAGTYSISSSLTAEPGSAGATYTCQVTHISLEEPLGASTQVVPPERRTALGVIFASSLFLLALMFLGLQRRQAPTGLGLLQAERWETTSCADTQSSHLHEDRTARVSQPS

SEQ ID NO: 4583 - protein, 567 aa, unidentified
MAGVGDAAAPGEGGGGGVDGPQRDGRGEAEQPGGSGGQGPPPAPQLTETLGFYESDRRRERRRGRTELSLLRFLSAELTRGYFLEHNEAKYTERRERVYTCLRIPRELEKLMVFGIFLCLDAFLYVFTLLPLRVFLALFRLLTLPCYGLRDRRLLQPAQVCDILKGVILVICYFMMHYVDYSMMYHLIRGQSVIKLYIIYNMLEVADRLFSSFGQDILDALYWTATEPKERKRAHIGVIPHFFMAVLYVFLHAILIMVQATTLNVAFNSHNKSLLTIMMSNNFVEIKGSVFKKFEKNNLFQMSNSDIKERFTNYVLLLIVCLRNMEQFSWNPDHLWVLFPDVCMVIASEIAVDIVKHAFITKFNDITADVYSEYRASLAFDLVSSRQKNAYTDYSDSVARRMGFIPLPLAVLLIRVVTSSIKVQGILSYACVILFYFGLISLKVLNSIVLLGKSCQYVKEAKMEEKLSNPPATCTPGKPSSKSQNKCKPSQGLSTEENLSASITKQPIHQKENIIPLLVTSNSDQFLTTPDGDEKDITQDNSELKHRSSKKDLLEIDRFTICGNRID

SEQ ID NO: 4584 - protein, 271 aa, unidentified
MIPKLLSLLCFRLCVGQGDTRGDGSLPKPSLSAWPSSVVPANSNVTLRCWTPARGVSFVLRKGGIILESPKPLDSTEGAAEFHLNNLKVRNAGEYTCEYYRKASPHILSQRSDVLLLLVTGHLSKPFLRTYQRGTVTAGGRVTLQCQKRDQLFVPIMFALLKAGTPSPIQLQSPAGKEIDFSLVDVTAGDAGNYSCMYYQTKSPFWASEPSDQLEILVTVPPGTTSSNYSLGNFVRLGLAAVIVVIMGAFLVEAWYSRNVSPGESEAFKPE

SEQ ID NO: 4585 - protein, 841 aa, unidentified
MLLCTARLVGLQLLISCCWAFACHSTESSPDFTLPGDYLLAGLFPLHSGCLQVRHRPEVTLCDRSCSFNEHGYHLFQAMRLGVEEINNSTALLPNITLGYQLYDVCSDSANVYATLRVLSLPGQHHIELQGDLLHYSPTVLAVIGPDSTNRAATTAALLSPFLVPMISYAASSETLSVKRQYPSFLRTIPNDKYQVETMVLLLQKFGWTWISLVGSSDDYGQLGVQALENQATGQGICIAFKDIMPFSAQVGDERMQCLMRHLAQAGATVVVVFSSRQLARVFFESVVLTNLTGKVWVASEAWALSRHITGVPGIQRIGMVLGVAIQKRAVPGLKAFEEAYARADKKAPRPCHKGSWCSSNQLCRECQAFMAHTMPKLKAFSMSSAYNAYRAVYAVAHGLHQLLGCASGACSRGRVYPWQLLEQIHKVHFLLHKDTVAFNDNRDPLSSYNIIAWDWNGPKWTFTVLGSSTWSPVQLNINETKIQWHGKDNQVPKSVCSSDCLEGHQRVVTGFHHCCFECVPCGAGTFLNKSDLYRCQPCGKEEWAPEGSQTCFPRTVVFLALREHTSWVLLAANTLLLLLLLGTAGLFAWHLDTPVVRSAGGRLCFLMLGSLAAGSGSLYGFFGEPTRPACLLRQALFALGFTIFLSCLTVRSFQLIIIFKFSTKVPTFYHAWVQNHGAGLFVMISSAAQLLICLTWLVVWTPLPAREYQRFPHLVMLECTETNSLGFILAFLYNGLLSISAFACSYLGKDLPENYNEAKCVTFSLLFNFVSWIAFFTTASVYDGKYLPAANMMAGLSSLSSGFGGYFLPKCYVILCRPDLNSTEHFQASIQDYTRRCGST

SEQ ID NO: 4586 - protein, 839 aa, unidentified
MGPRAKTISSLFFLLWVLAEPAENSDFYLPGDYLLGGLFSLHANMKGIVHLNFLQVPMCKEYEVKVIGYNLMQAMRFAVEEINNDSSLLPGVLLGYEIVDVCYISNNVQPVLYFLAHEDNLLPIQEDYSNYISRVVAVIGPDNSESVMTVANFLSLFLLPQITYSAISDELRDKVRFPALLRTTPSADHHIEAMVQLMLHFRWNWIIVLVSSDTYGRDNGQLLGERVARRDICIAFQETLPTLQPNQNMTSEERQRLVTIVDKLQQSTARVVVVFSPDLTLYHFFNEVLRQNFTGAVWIASESWAIDPVLHNLTELRHLGTFLGITIQSVPIPGFSEFREWGPQAGPPPLSRTSQSYTCNQECDNCLNATLSFNTILRLSGERVVYSVYSAVYAVAHALHSLLGCDKSTCTKRVVYPWQLLEEIWKVNFTLLDHQIFFDPQGDVALHLEIVQWQWDRSQNPFQSVASYYPLQRQLKNIQDISWHTINNTIPMSMCSKRCQSGQKKKPVGIHVCCFECIDCLPGTFLNHTEDEYECQACPNNEWSYQSETSCFKRQLVFLEWHEAPTIAVALLAALGFLSTLAILVIFWRHFQTPIVRSAGGPMCFLMLTLLLVAYMVVPVYVGPPKVSTCLCRQALFPLCFTICISCIAVRSFQIVCAFKMASRFPRAYSYWVRYQGPYVSMAFITVLKMVIVVIGMLATGLSPTTRTDPDDPKITIVSCNPNYRNSLLFNTSLDLLLSVVGFSFAYMGKELPTNYNEAKFITLSMTFYFTSSVSLCTFMSAYSGVLVTIVDLLVTVLNLLAISLGYFGPKCYMILFYPERNTPAYFNSMIQGYTMRRD

SEQ ID NO: 4587 - protein, 852 aa, unidentified
MLGPAVLGLSLWALLHPGTGAPLCLSQQLRMKGDYVLGGLFPLGEAEEAGLRSRTRPSSPVCTRFSSNGLLWALAMKMAVEEINNKSDLLPGLRLGYDLFDTCSEPVVAMKPSLMFLAKAGSRDIAAYCNYTQYQPRVLAVIGPHSSELAMVTGKFFSFFLMPQVSYGASMELLSARETFPSFFRTVPSDRVQLTAAAELLQEFGWNWVAALGSDDEYGRQGLSIFSALAAARGICIAHEGLVPLPRADDSRLGKVQDVLHQVNQSSVQVVLLFASVHAAHALFNYSISSRLSPKVWVASEAWLTSDLVMGLPGMAQMGTVLGFLQRGAQLHEFPQYVKTHLALATDPAFCSALGEREQGLEEDVVGQRCPQCDCITLQNVSAGLNHHQTFSVYAAVYSVAQALHNTLQCNASGCPAQDPVKPWQLLENMYNLTFHVGGLPLRFDSSGNVDMEYDLKLWVWQGSVPRLHDVGRFNGSLRTERLKIRWHTSDNQKPVSRCSRQCQEGQVRRVKGFHSCCYDCVDCEAGSYRQNPDDIACTFCGQDEWSPERSTRCFRRRSRFLAWGEPAVLLLLLLLSLALGLVLAALGLFVHHRDSPLVQASGGPLACFGLVCLGLVCLSVLLFPGQPSPARCLAQQPLSHLPLTGCLSTLFLQAAEIFVESELPLSWADRLSGCLRGPWAWLVVLLAMLVEVALCTWYLVAFPPEVVTDWHMLPTEALVHCRTRSWVSFGLAHATNATLAFLCFLGTFLVRSQPGCYNRARGLTFAMLAYFITWVSFVPLLANVQVVLRPAVQMGALLLCVLGILAAFHLPRCYLLMRQPGLNTPEFFLGGGPGDAQGQNDGNTGNQGKHE

SEQ ID NO: 4588 - protein, 299 aa, unidentified
MLESHLIIYFLLAVIQFLLGIFTNGIIVVVNGIDLIKHRKMAPLDLLLSCLAVSRIFLQLFIFYVNVIVIFFIEFIMCSANCAILLFINELELWLATWLGVFYCAKVASVRHPLFIWLKMRISKLVPWMILGSLLYVSMICVFHSKYAGFMVPYFLRKFFSQNATIQKEDTLAIQIFSFVAEFSVPLLIFLFAVLLLIFSLGRHTRQMRNTVAGSRVPGRGAPISALLSILSFLILYFSHCMIKVFLSSLKFHIRRFIFLFFILVIGIYPSGHSLILILGNPKLKQNAKKFLLHSKCCQ

SEQ ID NO: 4589 - protein, 307 aa, unidentified
MLRVVEGIFIFVVVSESVFGVLGNGFIGLVNCIDCAKNKLSTIGFILTGLAISRIFLIWIIITDGFIQIFSPNIYASGNLIEYISYFWVIGNQSSMWFATSLSIFYFLKIANFSNYIFLWLKSRTNMVLPFMIVFLLISSLLNFAYIAKILNDYKTKNDTVWDLNMYKSEYFIKQILLNLGVIFFFTLSLITCIFLIISLWRHNRQMQSNVTGLRDSNTEAHVKAMKVLISFIILFILYFIGMAIEISCFTVRENKLLLMFGMTTTAIYPWGHSFILILGNSKLKQASLRVLQQLKCCEKRKNLRVT

SEQ ID NO: 4590 - protein, 303 aa, unidentified
MESALPSIFTLVIIAEFIIGNLSNGFIVLINCIDWVSKRELSSVDKLLIILAISRIGLIWEILVSWFLALHYLAIFVSGTGLRIMIFSWIVSNHFNLWLATIFSIFYLLKIASFSSPAFLYLKWRVNKVILMILLGTLVFLFLNLIQINMHIKDWLDRYERNTTWNFSMSDFETFSVSVKFTMTMFSLTPFTVAFISFLLLIFSLQKHLQKMQLNYKGHRDPRTKVHTNALKIVISFLLFYASFFLCVLISWISELYQNTVIYMLCETIGVFSPSSHSFLLILGNAKLRQAFLLVAAKVWAKR

SEQ ID NO: 4591 - protein, 317 aa, unidentified
MGGVIKSIFTFVLIVEFIIGNLGNSFIALVNCIDWVKGRKISSVDRILTALAISRISLVWLIFGSWCVSVFFPALFATEKMFRMLTNIWTVINHFSVWLATGLGTFYFLKIANFSNSIFLYLKWRVKKVVLVLLLVTSVFLFLNIALINIHINASINGYRRNKTCSSDSSNFTRFSSLIVLTSTVFIFIPFTLSLAMFLLLIFSMWKHRKKMQHTVKISGDASTKAHRGVKSVITFFLLYAIFSLSFFISVWTSERLEENLIILSQVMGMAYPSCHSCVLILGNKKLRQASLSVLLWLRYMFKDGEPSGHKEFRESS

SEQ ID NO: 4592 - protein, 291 aa, unidentified
MIPIQLTVFFMIIYVLESLTIIVQSSLIVAVLGREWLQVRRLMPVDMILISLGISRFCLQWASMLNNFCSYFNLNYVLCNLTITWEFFNILTFWLNSLLTVFYCIKVSSFTHHIFLWLRWRILRLFPWILLGSLMITCVTIIPSAIGNYIQIQLLTMEHLPRNSTVTDKLENFHQYQFQAHTVALVIPFILFLASTIFLMASLTKQIQHHSTGHCNPSMKARFTALRSLAVLFIVFTSYFLTILITIIGTLFDKRCWLWVWEAFVYAFILMHSTSLMLSSPTLKRILKGKC

SEQ ID NO: 4593 - protein, 299 aa, unidentified
MMCFLLIISSILVVFAFVLGNVANGFIALVNVIDWVNTRKISSAEQILTALVVSRIGLLWVMLFLWYATVFNSALYGLEVRIVASNAWAVTNHFSMWLAASLSIFCLLKIANFSNLISLHLKKRIKSVVLVILLGPLVFLICNLAVITMDERVWTKEYEGNVTWKIKLRNAIHLSSLTVTTLANLIPFTLSLICFLLLICSLCKHLKKMRLHSKGSQDPSTKVHIKALQTVTSFLMLFAIYFLCIITSTWNLRTQQSKLVLLLCQTVAIMYPSFHSFILIMGSRKLKQTFLSVLWQMTR

SEQ ID NO: 4594 - protein, 309 aa, unidentified
MMSFLHIVFSILVVVAFILGNFANGFIALINFIAWVKRQKISSADQIIAALAVSRVGLLWVILLHWYSTVLNPTSSNLKVIIFISNAWAVTNHFSIWLATSLSIFYLLKIVNFSRLIFHHLKRKAKSVVLVIVLGSLFFLVCHLVMKHTYINVWTEECEGNVTWKIKLRNAMHLSNLTVAMLANLIPFTLTLISFLLLIYSLCKHLKKMQLHGKGSQDPSTKIHIKALQTVTSFLILLAIYFLCLIISFWNFKMRPKEIVLMLCQAFGIIYPSFHSFILIWGNKTLKQTFLSVLWQVTCWAKGQNQSTP

SEQ ID NO: 4595 - protein, 316 aa, unidentified
MMGLTEGVFLILSGTQFTLGILVNCFIELVNGSSWFKTKRMSLSDFIITTLALLRIILLCIILTDSFLIEFSPNTHDSGIIMQIIDVSWTFTNHLSIWLATCLGVLYCLKIASFSHPTFLWLKWRVSRVMVWMLLGALLLSCGSTASLINEFKLYSVFRGIEATRNVTEHFRKKRSEYYLIHVLGTLWYLPPLIVSLASYSLLIFSLGRHTRQMLQNGTSSRDPTTEAHKRAIRIILSFFFLFLLYFLAFLIASFGNFLPKTKMAKMIGEVMTMFYPAGHSFILILGNSKLKQTFVVMLRCESGHLKPGSKGPIFS

SEQ ID NO: 4596 - protein, 309 aa, unidentified
MTTFIPIIFSSVVVVLFVIGNFANGFIALVNSIERVKRQKISFADQILTALAVSRVGLLWVLLLNWYSTVFNPAFYSVEVRTTAYNVWAVTGHFSNWLATSLSIFYLLKIANFSNLIFLHLKRRVKSVILVMLLGPLLFLACQLFVINMKEIVRTKEYEGNLTWKIKLRSAVYLSDATVTTLGNLVPFTLTLLCFLLLICSLCKHLKKMQLHGKGSQDPSTKVHIKALQTVIFFLLLCAVYFLSIMISVWSFGSLENKPVFMFCKAIRFSYPSIHPFILIWGNKKLKQTFLSVLRQVRYWVKGEKPSSP

SEQ ID NO: 4597 - protein, 333 aa, unidentified
MLTLTRIRTVSYEVRSTFLFISVLEFAVGFLTNAFVFLVNFWDVVKRQALSNSDCVLLCLSISRLFLHGLLFLSAIQLTHFQKLSEPLNHSYQAIIMLWMIANQANLWLAACLSLLYCSKLIRFSHTFLICLASWVSRKISQMLLGIILCSCICTVLCVWCFFSRPHFTVTTVLFMNNNTRLNWQIKDLNLFYSFLFCYLWSVPPFLLFLVSSGMLTVSLGRHMRTMKVYTRNSRDPSLEAHIKALKSLVSFFCFFVISSCAAFISVPLLILWRDKIGVMVCVGIMAACPSGHAAILISGNAKLRRAVMTILLWAQSSLKVRADHKADSRTLC

SEQ ID NO: 4598 - protein, 338 aa, unidentified
MLGRCFPPDTKEKQQLRMTKLCDPAESELSPFLITLILAVLLAEYLIGIIANGFIMAIHAAEWVQNKAVSTSGRILVFLSVSRIALQSLMMLEITISSTSLSFYSEDAVYYAFKISFIFLNFCSLWFAAWLSFFYFVKIANFSYPLFLKLRWRITGLIPWLLWLSVFISFSHSMFCINICTVYCNNSFPIHSSNSTKKTYLSEINVVGLAFFFNLGIVTPLIMFILTATLLILSLKRHTLHMGSNATGSNDPSMEAHMGAIKAISYFLILYIFNAVALFIYLSNMFDINSLWNNLCQIIMAAYPASHSILLIQDNPGLRRAWKRLQLRLHLYPKEWTL

SEQ ID NO: 4599 - protein, 299 aa, unidentified
MLRLFYFSAIIASVILNFVGIIMNLFITVVNCKTWVKSHRISSSDRILFSLGITRFLMLGLFLVNTIYFVSSNTERSVYLSAFFVLCFMFLDSSSVWFVTLLNILYCVKITNFQHSVFLLLKRNISPKIPRLLLACVLISAFTTCLYITLSQASPFPELVTTRNNTSFNISEGILSLVVSLVLSSSLQFIINVTSASLLIHSLRRHIQKMQKNATGFWNPQTEAHVGAMKLMVYFLILYIPYSVATLVQYLPFYAGMDMGTKSICLIFATLYSPGHSVLIIITHPKLKTTAKKILCFKK

SEQ ID NO: 4600 - protein, 323 aa, unidentified
MATVNTDATDKDISKFKVTFTLVVSGIECITGILGSGFITAIYGAEWARGKTLPTGDRIMLMLSFSRLLLQIWMMLENIFSLLFRIVYNQNSVYILFKVITVFLNHSNLWFAAWLKVFYCLRIANFNHPLFFLMKRKIIVLMPWLLRLSVLVSLSFSFPLSRDVFNVYVNSSIPIPSSNSTEKKYFSETNMVNLVFFYNMGIFVPLIMFILAATLLILSLKRHTLHMGSNATGSRDPSMKAHIGAIKATSYFLILYIFNAIALFLSTSNIFDTYSSWNILCKIIMAAYPAGHSVQLILGNPGLRRAWKRFQHQVPLYLKGQTL

SEQ ID NO: 4601 - protein, 307 aa, unidentified
MQAALTAFFVLLFSLLSLLGIAANGFIVLVLGREWLRYGRLLPLDMILISLGASRFCLQLVGTVHNFYYSAQKVEYSGGLGRQFFHLHWHFLNSATFWFCSWLSVLFCVKIANITHSTFLWLKWRFPGWVPWLLLGSVLISFIITLLFFWVNYPVYQEFLIRKFSGNMTYKWNTRIETYYFPSLKLVIWSIPFSVFLVSIMLLINSLRRHTQRMQHNGHSLQDPSTQAHTRALKSLISFLILYALSFLSLIIDAAKFISMQNDFYWPWQIAVYLCISVHPFILIFSNLKLRSVFSQLLLLARGFWVA

SEQ ID NO: 4602 - protein, 314 aa, unidentified
MATELDKIFLILAIAEFIISMLGNVFIGLVNCSEGIKNQKVFSADFILTCLAISTIGQLLVILFDSFLVGLASHLYTTYRLGKTVIMLWHMTNHLTTWLATCLSIFYFFKIAHFPHSLFLWLRWRMNGMIVMLLILSLFLLIFDSLVLEIFIDISLNIIDKSNLTLYLDESKTLYDKLSILKTLLSLTSFIPFSLFLTSLLFLFLSLVRHTRNLKLSSLGSRDSSTEAHRRAMKMVMSFLFLFIVHFFSLQVANGIFFMLWNNKYIKFVMLALNAFPSCHSFILILGNSKLRQTAVRLLWHLRNYTKTPNALPL

SEQ ID NO: 4603 - protein, 309 aa, unidentified
MITFLPIIFSSLVVVTFVIGNFANGFIALVNSIEWFKRQKISFADQILTALAVSRVGLLWVLLLNWYSTVLNPAFNSVEVRTTAYNIWAVINHFSNWLATTLSIFYLLKIANFSNFIFLHLKRRVKSVILVMLLGPLLFLACHLFVINMNEIVRTKEFEGNMTWKIKLKSAMYFSNMTVTMVANLVPFTLTLLSFMLLICSLCKHLKKMQLHGKGSQDPSTKVHIKALQTVISFLLLCAIYFLSIMISVWSFGSLENKPVFMFCKAIRFSYPSIHPFILIWGNKKLKQTFLSVFWQMRYWVKGEKTSSP

SEQ ID NO: 4604 - protein, 309 aa, unidentified
MITFLPIIFSILIVVTFVIGNFANGFIALVNSIEWFKRQKISFADQILTALAVSRVGLLWVLVLNWYATELNPAFNSIEVRITAYNVWAVINHFSNWLATSLSIFYLLKIANFSNLIFLHLKRRVKSVVLVILLGPLLFLVCHLFVINMNQIIWTKEYEGNMTWKIKLRSAMYLSNTTVTILANLVPFTLTLISFLLLICSLCKHLKKMQLHGKGSQDPSMKVHIKALQTVTSFLLLCAIYFLSIIMSVWSFESLENKPVFMFCEAIAFSYPSTHPFILIWGNKKLKQTFLSVLWHVRYWVKGEKPSSS

SEQ ID NO: 4605 - protein, 299 aa, unidentified
MLSAGLGLLMLVAVVEFLIGLIGNGSLVVWSFREWIRKFNWSSYNLIILGLAGCRFLLQWLIILDLSLFPLFQSSRWLRYLSIFWVLVSQASLWFATFLSVFYCKKITTFDRPAYLWLKQRAYNLSLWCLLGYFIINLLLTVQIGLTFYHPPQGNSSIRYPFESWQYLYAFQLNSGSYLPLVVFLVSSGMLIVSLYTHHKKMKVHSAGRRDVRAKAHITALKSLGCFLLLHLVYIMASPFSITSKTYPPDLTSVFIWETLMAAYPSLHSLILIMGIPRVKQTCQKILWKTVCARRCWGP

SEQ ID NO: 4606 - protein, 299 aa, unidentified
MITFLYIFFSILIMVLFVLGNFANGFIALVNFIDWVKRKKISSADQILTALAVSRIGLLWALLLNWYLTVLNPAFYSVELRITSYNAWVVTNHFSMWLAANLSIFYLLKIANFSNLLFLHLKRRVRSVILVILLGTLIFLVCHLLVANMDESMWAEEYEGNMTGKMKLRNTVHLSYLTVTTLWSFIPFTLSLISFLMLICSLCKHLKKMQLHGEGSQDLSTKVHIKALQTLISFLLLCAIFFLFLIVSVWSPRRLRNDPVVMVSKAVGNIYLAFDSFILIWRTKKLKHTFLLILCQIRC

SEQ ID NO: 4607 - protein, 318 aa, unidentified
MNGDHMVLGSSVTDKKAIILVTILLLLRLVAIAGNGFITAALGVEWVLRRMLLPCDKLLVSLGASRFCLQSVVMGKTIYVFLHPMAFPYNPVLQFLAFQWDFLNAATLWSSTWLSVFYCVKIATFTHPVFFWLKHKLSGWLPWMLFSSVGLSSFTTILFFIGNHRMYQNYLRNHLQPWNVTGDSIRSYCEKFYLFPLKMITWTMPTAVFFICMILLITSLGRHRKKALLTTSGFREPSVQAHIKALLALLSFAMLFISYFLSLVFSAAGIFPPLDFKFWVWESVIYLCAAVHPIILLFSNCRLRAVLKSRRSSRCGTP

SEQ ID NO: 4608 - protein, 318 aa, unidentified
MADKVQTTLLFLAVGEFSVGILGNAFIGLVNCMDWVKKRKIASIDLILTSLAISRICLLCVILLDCFILVLYPDVYATGKEMRIIDFFWTLTNHLSIWFATCLSIYYFFKIGNFFHPLFLWMKWRIDRVISWILLGCVVLSVFISLPATENLNADFRFCVKAKRKTNLTWSCRVNKTQHASTKLFLNLATLLPFCVCLMSFFLLILSLRRHIRRMQLSATGCRDPSTEAHVRALKAVISFLLLFIAYYLSFLIATSSYFMPETELAVIFGESIALIYPSSHSFILILGNNKLRHASLKVIWKVMSILKGRKFQQHKQI

SEQ ID NO: 4609 - protein, 309 aa, unidentified
MFSPADNIFIILITGEFILGILGNGYIALVNWIDWIKKKKISTVDYILTNLVIARICLISVMVVNGIVIVLNPDVYTKNKQQIVIFTFWTFANYLNMWITTCLNVFYFLKIASSSHPLFLWLKWKIDMVVHWILLGCFAISLLVSLIAAIVLSCDYRFHAIAKHKRNITEMFHVSKIPYFEPLTLFNLFAIVPFIVSLISFFLLVRSLWRHTKQIKLYATGSRDPSTEVHVRAIKTMTSFIFFFFLYYISSILMTFSYLMTKYKLAVEFGEIAAILYPLGHSLILIVLNNKLRQTFVRMLTCRKIACMI

SEQ ID NO: 4610 - protein, 312 aa, unidentified
MPSAIEAIYIILIAGELTIGIWGNGFIVLVNCIDWLKRRDISLIDIILISLAISRICLLCVISLDGFFMLLFPGTYGNSVLVSIVNVVWTFANNSSLWFTSCLSIFYLLKIANISHPFFFWLKLKINKVMLAILLGSFLISLIISVPKNDDMWYHLFKVSHEENITWKFKVSKIPGTFKQLTLNLGVMVPFILCLISFFLLLFSLVRHTKQIRLHATGFRDPSTEAHMRAIKAVIIFLLLLIVYYPVFLVMTSSALIPQGKLVLMIGDIVTVIFPSSHSFILIMGNSKLREAFLKMLRFVKCFLRRRKPFVP

SEQ ID NO: 4611 - protein, 297 aa, unidentified
MSRFKFIDIGINLTDPMFRGIYRGVQKHQDDLQDVIGRAVEIGVKKFMITGGNLQDSKDALHLAQTNGMFFSTVGCHPTRCGEFEKNNPDLYLKELLNLAENNKGKVVAIGECGLDFDRLQFCPKDTQLKYFEKQFELSEQTKLPMFLHCRNSHAEFLDIMKRNRDRCVGGVVHSFDGTKEAAAALIDLDLYIGFNGCSLKTEANLEVLKSIPSEKLMIETDAPWCGVKSTHAGSKYIRTAFPTKKKWESGHCLKDRNEPCHIIQILEIMSAVRDEDPLELANTLYNNTIKVFFPGI

SEQ ID NO: 4612 - protein, 789 aa, unidentified
MTSFQEVPLQTSNFAHVIFQNVAKSYLPNAHLECHYTLTPYIHPHPKDWVGIFKVGWSTARDYYTFLWSPMPEHYVEGSTVNCVLAFQGYYLPNDDGEFYQFCYVTHKGEIRGASTPFQFRASSPVEELLTMEDEGNSDMLVVTTKAGLLELKIEKTMKEKEELLKLIAVLEKETAQLREQVGRMERELNHEKERCDQLQAEQKGLTEVTQSLKMENEEFKKRFSDATSKAHQLEEDIVSVTHKAIEKETELDSLKDKLKKAQHEREQLECQLKTEKDEKELYKVHLKNTEIENTKLMSEVQTLKNLDGNKESVITHFKEEIGRLQLCLAEKENLQRTFLLTTSSKEDTCFLKEQLRKAEEQVQATRQEVVFLAKELSDAVNVRDRTMADLHTARLENEKVKKQLADAVAELKLNAMKKDQDKTDTLEHELRREVEDLKLRLQMAADHYKEKFKECQRLQKQINKLSDQSANNNNVFTKKTGNQQKVNDASVNTDPATSASTVDVKPSPSAAEADFDIVTKGQVCEMTKEIADKTEKYNKCKQLLQDEKAKCNKYADELAKMELKWKEQVKIAENVKLELAEVQDNYKELKRSLENPAERKMEGQNSQSPQCFKTCSEQNGYVLTLSNAQPVLQYGNPYASQETRDGADGAFYPDEIQRPPVRVPSWGLEDNVVCSQPARNFSRPDGLEDSEDSKEDENVPTAPDPPSQHLRGHGTGFCFDSSFDVHKKCPLCELMFPPNYDQSKFEEHVESHWKVCPMCSEQFPPDYDQQVFERHVQTHFDQNVLNFD

SEQ ID NO: 4613 - protein, 292 aa, unidentified
MPLHVKWPFPAVPPLTWTLASSVVMGLVGTYSCFWTKYMNHLTVHNREVLYELIEKRGPATPLITVSNHQSCMDDPHLWGILKLRHIWNLKLMRWTPAAADICFTKELHSHFFSLGKCVPVCRGAEFFQAENEGKGVLDTGRHMPGAGKRREKGDGVYQKGMDFILEKLNHGDWVHIFPEGKVNMSSEFLRFKWGIGRLIAECHLNPIILPLWHVGMNDVLPNSPPYFPRFGQKITVLIGKPFSALPVLERLRAENKSAVEMRKALTDFIQEEFQHLKTQAEQLHNHLQPGR

SEQ ID NO: 4614 - protein, 446 aa, unidentified
MAQALGEDLVQPPELQDDSSSLGSDSELSGPGPYRQADRYGFIGGSSAEPGPGHPPADLIRQREMKWVEMTSHWEKTMSRRYKKVKMQCRKGIPSALRARCWPLLCGAHVCQKNSPGTYQELAEAPGDPQWMETIGRDLHRQFPLHEMFVSPQGHGQQGLLQVLKAYTLYRPEQGYCQAQGPVAAVLLMHLPPEEAFWCLVQICEVYLPGYYGPHMEAVRLDAEVFMALLRRLLPHVHKHLQQVGVGPLLYLPEWFLCLFARSLPFPTVLRVWDAFLSEGARVLFRVGLTLVRLALGTAEQRGACPGLLETLGALRAIPPAQLQEEAFMSQVHSVVLSERDLQREIKAQLAQLPDSAPGPPPRPQVRLAGAQAIFEAQQLAGVRRGAKPEVPRIVVQPPEEPRPPRRKPQTRGKTFHGLLTRARGPPIEGPPRPQRGSTSFLDTRF

SEQ ID NO: 4615 - protein, 526 aa, unidentified
MLQEESDLSLIIAQIVQKLKGSNLYSQLERQAWASLQRPEIKLESLKEDIKEFFKISGWEKKLQNAVYSELSVFPLPSHPAAPPEHLKEPLVYMRKAQGSWEKRILKSLNSMCTELSIPLARKRPVGEQKELLNKWNEMGTDEPDLSLFRPVYAPKDFLEVLINLRNPNYENGDSLSFRTHLGLIQVPLKVKDIPELKECFVELGLNIGQLGIDDSTQVPPELFENEHVRIGQKVLAEQDSAAAQQYIRQGSPTALRAELWALILNISSQPEDVLYYEQLKTNVIQHDLLVDSLIYKDVKLTASNDDYYFVFEDYLYQVLLCFSRDTSVLSHFAFNSASPPKSYIRGKLGLEEYAVFYPPNGVIPFHGFSMYVAPLCFLYHEPSKLYQIFREMYVRFFFRLHSISSHPSGIVSLCLLFETLLQTYLPQLFYHLREIGAQPLRISFKWMVRAFSGYLATDQLLLLWDRILGYNSLEILAVLAAAVFAFRAVNLMEVTSLAAAEAVLADLSTLKVMPLLQIFLFATVT

SEQ ID NO: 4616 - protein, 403 aa, unidentified
MALRSAQGDGPTSGHWDGGAEKADFNAKRKKKVAEIHQALNSDPTDVAALRRMAISEGGLLTDEIRRKVWPKLLNVNANDPPPISGKNLRQMSKDYQQVLLDVRRSLRRFPPGMPEEQREGLQEELIDIILLILERNPQLHYYQGYHDIVVTFLLVVGERLATSLVEKLSTHHLRDFMDPTMDNTKHILNYLMPIIDQVNPELHDFMQSAEVGTIFALSWLITWFGHVLSDFRHVVRLYDFFLACHPLMPIYFAAVIVLYREQEVLDCDCDMASVHHLLSQIPQDLPYETLISRAGDLFVQFPPSELAREAAAQQQAERTAASTFKDFELASAQQRPDMVLRQRFRGLLRPEDRTKDVLTKPRTNRFVKLAVMGLTVALGAAALAVVKSALEWAPKFQLQLFP

SEQ ID NO: 4617 - protein, 699 aa, unidentified
MAEGEDVPPLPTSSGDGWEKDLEEALEAGGCDLETLRNIIQGRPLPADLRAKVWKIALNVAGKGDSLASWDGILDLPEQNTIHKDCLQFIDQLSVPEEKAAELLLDIESVITFYCKSRNIKYSTSLSWIHLLKPLVHLQLPRSDLYNCFYAIMNKYIPRDCSQKGRPFHLFRLLIQYHEPELCSYLDTKKITPDSYALNWLGSLFACYCSTEVTQAIWDGYLQQADPFFIYFLMLIILVNAKEVILTQESDSKEEVIKFLENTPSSLNIEDIEDLFSLAQYYCSKTPASFRKDNHHLFGSTLLGIKDDDADLSQALCLAISVSEILQANQLQGEGVRFFVVDCRPAEQYNAGHLSTAFHLDSDLMLQNPSEFAQSVKSLLEAQKQSIESGSIAGGEHLCFMGSGREEEDMYMNMVLAHFLQKNKEYVSIASGGFMALQQHLADINVDGPENGYGHWIASTSGSRSSINSVDGESPNGSSDRGMKSLVNKMTVALKTKSVNVREKVISFIENTSTPVDRMSFNLPWPDRSCTERHVSSSDRVGKPYRGVKPVFSIGDEEEYDTDEIDSSSMSDDDRKEVVNIQTWINKPDVKHHFPCKEVKESGHMFPSHLLVTATHMYCLREIVSRKGLAYIQSRQALNSVVKITSKKKHPELITFKYGNSSASGIEILAIERYLIPNAGDATKAIKQQIMKVLDALES

SEQ ID NO: 4618 - protein, 963 aa, unidentified
MPGAGARAEEGGGGGEGAAQGAAAEPGAGPAREPARLCGYLQKLSGKGPLRGYRSRWFVFDARRCYLYYFKSPQDALPLGHLDIADACFSYQGPDEAAEPGTEPPAHFQVHSAGAVTVLKAPNRQLMTYWLQELQQKRWEYCNSLDMVKWDSRTSPTPGDFPKGLVARDNTDLIYPHPNASAEKARNVLAVETVPGELVGEQAANQPAPGHPNSINFYSLKQWGNELKNSMSSFRPGRGHNDSRRTVFYTNEEWELLDPTPKDLEESIVQEEKKKLTPEGNKGVTGSGFPFDFGRNPYKGKRPLKDIIGSYKNRHSSGDPSSEGTSGSGSVSIRKPASEMQLQVQSQQEELEQLKKDLSSQKELVRLLQQTVRSSQYDKYFTSSRLCEGVPKDTLELLHQKDDQILGLTSQLERFSLEKESLQQEVRTLKSKVGELNEQLGMLMETIQAKDEVIIKLSEGEGNGPPPTVAPSSPSVVPVARDQLELDRLKDNLQGYKTQNKFLNKEILELSALRRNAERRERDLMAKYSSLEAKLCQIESKYLILLQEMKTPVCSEDQGPTREVIAQLLEDALQVESQEQPEQAFVKPHLVSEYDIYGFRTVPEDDEEEKLVAKVRALDLKTLYLTENQEVSTGVKWENYFASTVNREMMCSPELKNLIRAGIPHEHRSKVWKWCVDRHTRKFKDNTEPGHFQTLLQKALEKQNPASKQIELDLLRTLPNNKHYSCPTSEGIQKLRNVLLAFSWRNPDIGYCQGLNRLVAVALLYLEQEDAFWCLVTIVEVFMPRDYYTKTLLGSQVDQRVFRDLMSEKLPRLHGHFEQYKVDYTLITFNWFLVVFVDSVVSDILFKIWDSFLYEGPKVIFRFALALFKYKEEEILKLQDSMSIFKYLRYFTRTILDARKLISISFGDLNPFPLRQIRNRRAYHLEKVRLELTELEAIREDFLRERDTSPDKGELVSDEEEDT

SEQ ID NO: 4619 - protein, 924 aa, unidentified
MDVLPTGGGRPGLRTELEFRGGGGEARLESQEEETIPAAPPAPRLRGAAERPRRSRDTWDGDEDTEPGEACGGRTSRTASLVSGLLNELYSCTEEEEAAGGGRGAEGRRRRRDSLDSSTEASGSDVVLGGRSGAGDSRVLQELQERPSQRHQMLYLRQKDANELKTILRELKYRIGIQSAKLLRHLKQKDRLLHKVQRNCDIVTACLQAVSQKRRVDTKLKFTLEPSLGQNGFQQWYDALKAVARLSTGIPKEWRRKVWLTLADHYLHSIAIDWDKTMRFTFNERSNPDDDSMGIQIVKDLHRTGCSSYCGQEAEQDRVVLKRVLLAYARWNKTVGYCQGFNILAALILEVMEGNEGDALKIMIYLIDKVLPESYFVNNLRALSVDMAVFRDLLRMKLPELSQHLDTLQRTANKESGGGYEPPLTNVFTMQWFLTLFATCLPNQTVLKIWDSVFFEGSEIILRVSLAIWAKLGEQIECCETADEFYSTMGRLTQEMLENDLLQSHELMQTVYSMAPFPFPQLAELREKYTYNITPFPATVKPTSVSGRHSKARDSDEENDPDDEDAVVNAVGCLGPFSGFLAPELQKYQKQIKEPNEEQSLRSNNIAELSPGAINSCRSEYHAAFNSMMMERMTTDINALKRQYSRIKKKQQQQVHQVYIRADKGPVTSILPSQVNSSPVINHLLLGKKMKMTNRAAKNAVIHIPGHTGGKISPVPYEDLKTKLNSPWRTHIRVHKKNMPRTKSHPGCGDTVGLIDEQNEASKTNGLGAAEAFPSGCTATAGREGSSPEGSTRRTIEGQSPEPVFGDADVDVSAVQAKLGALELNQRDAAAETELRVHPPCQRHCPEPPSAPEENKATSKAPQGSNSKTPIFSPFPSVKPLRKSATARNLGLYGPTERTPTVHFPQMSRSFSKPGGGNSGTKKR

SEQ ID NO: 4620 - protein, 1257 aa, unidentified
MAHFSSEDQAMLQAMLRRLFQSVKEKITGAPSLECAEEILLHLEETDENFHNYEFVKYLRQHIGNTLGSMIEEEMEKCTSDRNQGEECGYDTVVQQVTKRTQESKEYKEMMHYLKNIMIAVVESMINKFEEDETRNQERQKKIQKEKSHSYRTDNCSDSDSSLNQSYKFCQGKLQLILDQLDPGQPKEVRYEALQTLCSAPPSDVLNCENWTTLCEKLTVSLSDPDPVFSDRILKFCAQTFLLSPLHMTKEIYTSLAKYLESYFLSRENHIPTLSAGVDITNPNMTRLLKKVRLLNEYQKEAPSFWIRHPEKYMEEIVESTLSLLTVKHNQSHVVSQKILDPIYFFALVDTKAVWFKKWMHAHYSRTTVLRLLETKYKSLVTTAIQQCVQYFEMCKTRKADETLGHSKHCRNKQKTFYYLGQELQYIYFIHSLCLLGRLLIYKQGRKLFPIKLKNKKGLVSLIDLLVLFTQLIYYSPSCPKMTSAAHSENYSPASMVTEVLWILSDQKECAVECLYNNIVIETLLQPIHNLMKGNEASPNCSETALIHIAGILARIASVEEGLILLLYGANMNSSEESPTGAHIIAQFSKKLLDEDISIFSGSEMLPVVKGAFISVCRHIYSTCEGLQVLITYNLHESIAKAWKKTSLLSERIPTPVEGSDSVSSVSQESQNIMAWEDNLLDDLLHFAATPKGLLLLQRTGAINECVTFIFNRYAKKLQVSRHKKFGYGVLVTRVASTAAGGIALKKSGFINELITELWSNLEYGRDDVRVTHPRTTPVDPIDRSCQKSFLALVNLLSYPAIYELVRNQDLPNKTEYSLREVPTCVIDIIDRLIILNSEAKIRSLFNYEQSHIFGLRDFIIDGLSVERNHVLVRINLVGGPLERILPPRLLEKSDNPYPWPMFSSYPLPNCYLSDITRNAGIKQDNDLDKLLLCLKISDKQTEWIENCQRQFCKMMKAKPDIISGEALIELLEKFVLHLTESPSECYFPSVEYTATDANVKNESLSSVQQLGIKMTVRYGKFLSLLKDGAENDLTWVLKHCERFLKQQQTSIKSSLLCLQGNYAGHDWFVSSLFMIMLGDKEKTFQFLHQFSRLLTSAFLWLPRLHISSYLPNDTVESGIHPVYFCSTHYIEMLLKAELPLVFSAFHMSGFAPSQICLQWITQCFWNYLDWIEICHYIATCVFLGPDYQVYICIAVFKHLQQDILQHTQTQDLQVFLKEEALHGFRVSDYFEYMEILEQNYRTVLLRDMRNIRLQST

SEQ ID NO: 4621 - protein, 795 aa, unidentified
MYHSLSETRHPLQPEEQEVGIDPLSSYSNKSGGDSNKNGRRTSSTLDSEGTFNSYRKEWEELFVNNNYLATIRQKGINGQLRSSRFRSICWKLFLCVLPQDKSQWISRIEELRAWYSNIKEIHITNPRKVVGQQDLMINNPLSQDEGSLWNKFFQDKELRSMIEQDVKRTFPEMQFFQQENVRKILTDVLFCYARENEQLLYKQGMHELLAPIVFVLHCDHQAFLHASESAQPSEEMKTVLNPEYLEHDAYAVFSQLMETAEPWFSTFEHDGQKGKETLMTPIPFARPQDLGPTIAIVTKVNQIQDHLLKKHDIELYMHLNRLEIAPQIYGLRWVRLLFGREFPLQDLLVVWDALFADGLSLGLVDYIFVAMLLYIRDALISSNYQTCLGLLMHYPFIGDVHSLILKALFLRDPKRNPRPVTYQFHPNLDYYKARGADLMNKSRTNAKGAPLNINKVSNSLINFGRKLISPAMAPGSAGGPVPGGNSSSSSSVVIPTRTSAEAPSHHLQQQQQQQRLMKSESMPVQLNKGLSSKNISSSPSVESLPGGREFTGSPPSSATKKDSFFSNISRSRSHSKTMGRKESEEELEAQISFLQGQLNDLDAMCKYCAKVMDTHLVNIQDVILQENLEKEDQILVSLAGLKQIKDILKGSLRFNQSQLEAEENEQITIADNHYCSSGQGQGRGQGQSVQMSGAIKQASSETPGCTDRGNSDDFILISKDDDGSSARGSFSGQAQPLRTLRSTSGKSQAPVCSPLVFSDPLMGPASASSSNPSSSPDDDSSKDSGFTIVSPLDI

SEQ ID NO: 4622 - protein, 293 aa, unidentified
MTEDSQRNFRSVYYEKVGFRGVEEKKSLEILLKDDRLDTEKLCTFSQRFPLPSMYRALVWKVLLGILPPHHESHAKVMMYRKEQYLDVLHALKVVRFVSDATPQAEVYLRMYQLESGKLPRSPSFPLEPDDEVFLAIAKAMEEMVEDSVDCYWITRRFVNQLNTKYRDSLPQLPKAFEQYLNLEDGRLLTHLRMCSAAPKLPYDLWFKRCFAGCLPESSLQRVWDKVVSGSCKILVFVAVEILLTFKIKVMALNSAEKITKFLENIPQDSSDAIVSKAIDLWHKHCGTPVHSS

SEQ ID NO: 4623 - protein, 1140 aa, unidentified
MWLKPEEVLLKNALKLWVTQKSSCYFILQRRRGHGEGGGRLTGRLVGALDAVLDSNARVAPFRILLQVPGSQVYSPIACGATLEEINQHWDWLEQNLLHTLSVFDNKDDIASFVKGKVKALIAEETSSRLAEQEEEPEKFREALVKFEARFNFPEAEKLVTYYSCCCWKGRVPRQGWLYLSINHLCFYSFFLGKELKLVVPWVDIQKLERTSNVFLTDTIRITTQNKERDFSMFLNLDEVFKVMEQLADVTLRRLLDNEVFDLDPDLQEPSQITKRDLEARAQNEFFRAFFRLPRKEKLHAVVDCSLWTPFSRCHTTGRMFASDSYICFASREDGCCKIILPLREVVSIEKMEDTSLLPHPIIVSIRSKVAFQFIELRDRDSLVEALLARLKQVHANHPVHYDTSADDDMASLVFHSTSMCSDHRFGDLEMMSSQNSEESEKEKSPLMHPDALVTAFQQSGSQSPDSRMSREQIKISLWNDHFVEYGRTVCMFRTEKIRKLVAMGIPESLRGRLWLLFSDAVTDLASHPGYYGNLVEESLGKCCLVTEEIERDLHRSLPEHPAFQNETGIAALRRVLTAYAHRNPKIGYCQSMNILTSVLLLYTKEEEAFWLLVAVCERMLPDYFNHRVIGAQVDQSVFEELIKGHLPELAEHMNDLSALASVSLSWFLTLFLSIMPLESAVNVVDCFFYDGIKAIFQLGLAVLEANAEDLCSSKDDGQALMILSRFLDHIKNEDSPGPPVGSHHAFFSDDQEPYPVTDISDLIRDSYEKFGDQSVEQIEHLRYKHRIRVLQGHEDTTKQNVLRVVIPEVSILPEDLEELYDLFKREHMMSCYWEQPRPMASRHDPSRPYAEQYRIDARQFAHLFQLVSPWTCGAHTEILAERTFRLLDDNMDQLIEFKAFVSCLDIMYNGEMNEKIKLLYRLHIPPALTENDRDSQSPLRNPLLSTSRPLVFGKPNGDAVDYQKQLKQMIKDLAKEKDKTEKELPKMSQREFIQFCKTLYSMFHEDPEENDLYQAIATVTTLLLQIGEVGQRGSSSGSCSQECGEELRASAPSPEDSVFADTGKTPQDSQAFPEAAERDWTVSLEHILASLLTEQSLVNFFEKPLDMKSKLENAKINQYNLKTFEMSHQSQSELKLSNL

SEQ ID NO: 4624 - protein, 1192 aa, unidentified
MALSDEPAAGGPEEEAEDETLAFGAALEAFGESAETRALLGRLREVHGGGAEREVALERFRVIMDKYQEQPHLLDPHLEWMMNLLLDIVQDQTSPASLVHLAFKFLYIITKVRGYKTFLRLFPHEVADVEPVLDLVTIQNPKDHEAWETRYMLLLWLSVTCLIPFDFSRLDGNLLTQPGQARMSIMDRILQIAESYLIVSDKARDAAAVLVSRFITRPDVKQSKMAEFLDWSLCNLARSSFQTMQGVITMDGTLQALAQIFKHGKREDCLPYAATVLRCLDGCRLPESNQTLLRKLGVKLVQRLGLTFLKPKVAAWRYQRGCRSLAANLQLLTQGQSEQKPLILTEDDDEDDDVPEGVERVIEQLLVGLKDKDTVVRWSAAKGIGRMAGRLPRALADDVVGSVLDCFSFQETDKAWHGGCLALAELGRRGLLLPSRLVDVVAVILKALTYDEKRGACSVGTNVRDAACYVCWAFARAYEPQELKPFVTAISSALVIAAVFDRDINCRRAASAAFQENVGRQGTFPHGIDILTTADYFAVGNRSNCFLVISVFIAGFPEYTQPMIDHLVTMKISHWDGVIRELAARALHNLAQQAPEFSATQVFPRLLSMTLSPDLHMRHGSILACAEVAYALYKLAAQENRPVTDHLDEQAVQGLKQIHQQLYDRQLYRGLGGQLMRQAVCVLIEKLSLSKMPFRGDTVIDGWQWLINDTLRHLHLISSHSRQQMKDAAVSALAALCSEYYMKEPGEADPAIQEELITQYLAELRNPEEMTRCGFSLALGALPGFLLKGRLQQVLTGLRAVTHTSPEDVSFAESRRDGLKAIARICQTVGVKAGAPDEAVCGENVSQIYCALLGCMDDYTTDSRGDVGTWVRKAAMTSLMDLTLLLARSQPELIEAHTCERIMCCVAQQASEKIDRFRAHAASVFLTLLHFDSPPIPHVPHRGELEKLFPRSDVASVNWSAPSQAFPRITQLLGLPTYRYHVLLGLVVSLGGLTESTIRHSTQSLFEYMKGIQSDPQALGSFSGTLLQIFEDNLLNERVSVPLLKTLDHVLTHGCFDIFTTEEDHPFAVKLLALCKKEIKNSKDIQKLLSGIAVFCEMVQFPGDVRRQALLQLCLLLCHRFPLIRKTTASQVYETLLTYSDVVGADVLDEVVTVLSDTAWDAELAVVREQRNRLCDLLGVPRPQLVPQPGAC

SEQ ID NO: 4625 - protein, 343 aa, unidentified
MWPNGSSLGPCFRPTNITLEERRLIASPWFAASFCVVGLASNLLALSVLAGARQGGSHTRSSFLTFLCGLVLTDFLGLLVTGTIVVSQHAALFEWHAVDPGCRLCRFMGVVMIFFGLSPLLLGAAMASERYLGITRPFSRPAVASQRRAWATVGLVWAAALALGLLPLLGVGRYTVQYPGSWCFLTLGAESGDVAFGLLFSMLGGLSVGLSFLLNTVSVATLCHVYHGQEAAQQRPRDSEVEMMAQLLGIMVVASVCWLPLLVFIAQTVLRNPPAMSPAGQLSRTTEKELLIYLRVATWNQILDPWVYILFRRAVLRRLQPRLSTRPRSLSLQPQLTQRSGLQ

SEQ ID NO: 4626 - protein, 533 aa, unidentified
MEALGFLKLEVNGPMVTVALSVALLALLKWYSTSAFSRLEKLGLRHPKPSPFIGNLTFFRQGFWESQMELRKLYGPLCGYYLGRRMFIVISEPDMIKQVLVENFSNFTNRMASGLEFKSVADSVLFLRDKRWEEVRGALMSAFSPEKLNEMVPLISQACDLLLAHLKRYAESGDAFDIQRCYCNYTTDVVASVAFGTPVDSWQAPEDPFVKHCKRFFEFCIPRPILVLLLSFPSIMVPLARILPNKNRDELNGFFNKLIRNVIALRDQQAAEERRRDFLQMVLDARHSASPMGVQDFDIVRDVFSSTGCKPNPSRQHQPSPMARPLTVDEIVGQAFIFLIAGYEIITNTLSFATYLLATNPDCQEKLLREVDVFKEKHMAPEFCSLEEGLPYLDMVIAETLRMYPPAFRFTREAAQDCEVLGQRIPAGAVLEMAVGALHHDPEHWPSPETFNPERFTAEARQQHRPFTYLPFGAGPRSCLGVRLGLLEVKLTLLHVLHKFRFQACPETQVPLQLESKSALGPKNGVYIKIVSR

SEQ ID NO: 4627 - protein, 208 aa, unidentified
MDKFVIRTPRIQNSPQKKDSGGKVYKQATIESLKRVVVVEDIKRWKTMLELPDQTKENLVEALQELKKKIPSREVLKSTRIGHTVNKMRKHSDSEVASLAREVYTEWKTFTEKHSNRPSIEVRSDPKTESLRKNAQKLLSEALELKMDHLLVENIERETFHLCSRLINGPYRRTVRALVFTLKHRAEIRAQVKSGSLPVGTFVQTHKK

SEQ ID NO: 4628 - protein, 830 aa, unidentified
MGSMFRSEEVALVQLFLPTAAAYTCVSRLGELGLVEFRDLNASVSAFQRRFVVDVRRCEELEKTFTFLQEEVRRAGLVLPPPKGRLPAPPPRDLLRIQEETERLAQELRDVRGNQQALRAQLHQLQLHAAVLRQGHEPQLAAAHTDGASERTPLLQAPGGPHQDLRVNFVAGAVEPHKAPALERLLWRACRGFLIASFRELEQPLEHPVTGEPATWMTFLISYWGEQIGQKIRKITDCFHCHVFPFLQQEEARLGALQQLQQQSQELQEVLGETERFLSQVLGRVLQLLPPGQVQVHKMKAVYLALNQCSVSTTHKCLIAEAWCSVRDLPALQEALRDSSMEEGVSAVAHRIPCRDMPPTLIRTNRFTASFQGIVDAYGVGRYQEVNPAPYTIITFPFLFAVMFGDVGHGLLMFLFALAMVLAENRPAVKAAQNEIWQTFFRGRYLLLLMGLFSIYTGFIYNECFSRATSIFPSGWSVAAMANQSGWSDAFLAQHTMLTLDPNVTGVFLGPYPFGIDPIWSLAANHLSFLNSFKMKMSVILGVVHMAFGVVLGVFNHVHFGQRHRLLLETLPELTFLLGLFGYLVFLVIYKWLCVWAARAASAPSILIHFINMFLFSHSPSNRLLYPRQEVVQATLVVLALAMVPILLLGTPLHLLHRHRRRLRRRPADRQEENKAGLLDLPDASVNGWSSDEEKAGGLDDEEEAELVPSEVLMHQAIHTIEFCLGCVSNTASYLRLWALSLAHAQLSEVLWAMVMRIGLGLGREVGVAAVVLVPIFAAFAVMTVAILLVMEGLSAFLHALRLHWVEFQNKFYSGTGYKLSPFTFAATDD

SEQ ID NO: 4629 - protein, 103 aa, unidentified
MAESWSGQALQALPATVLGALGSEFLREWEAQDMRVTLFKLLLLWLVLSLLGIQLAWGFYGNTVTGLYHRPGLGGQNGSTPDGSTHFPSWEMAANEPLKTHRE

SEQ ID NO: 4630 - protein, 697 aa, unidentified
MGFQPPAALLLRLFLLQGILRLLWGDLAFIPPFIRMSGPAVSASLVGDTEGVTVSLAVLQDEAGILPIPTCGVLNNETEDWSVTVIPGAKVLEVTVRWKRGLDWCSSNETDSFSESPCILQTLLVSASHNSSCSAHLLIQVEIYANSSLTHNASENVTVIPNQVYQPLGPCPCNLTAGACDVRCCCDQECSSNLTTLFRRSCFTGVFGGDVNPPFDQLCSAGTTTRGVPDWFPFLCVQSPLANTPFLGYFYHGAVSPKQDSSFEVYVDTDAKDFADFGYKQGDPIMTVKKAYFTIPQVSLAGQCMQNAPVAFLHNFDVKCVTNLELYQERDGIINAKIKNVALGGIVTPKVIYEEATDLDKFITNTETPLNNGSTPRIVNVEEHYIFKWNNNTISEINVKIFRAEINAHQKGIMTQRFVVKFLSYNSGNEEELSGNPGYQLGKPVRALNINRMNNVTTLHLWQSAGRGLCTSATFKPILFGENVLSGCLLEVGINENCTQLRENAVERLDSLIQATHVAMRGNSDYADLSDGWLEIIRVDAPDPGADPLASSVNGMCLDIPAHLSIRILISDAGAVEGITQQEILGVETRFSSVNWQYQCGLTCEHKADLLPISASVQFIKIPAQLPHPLTRFQINYTEYDCNRNEVCWPQLLYPWTQYYQGELHSQCVAKGLLLLLFLTLALFLSNPWTRICKAYS

SEQ ID NO: 4631 - protein, 607 aa, unidentified
MRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNSNLNYFQKLQKVNATNFQALAAEFGGESFTSTFQTQSPPSFYRAGDPILTYFPKWSVISLLRQPAGVGAGGLCAESNPAGFLESKSTTCTRFFKNLASSCTLDSALNAASYYNFTVLKVPRSMTDPQNMEFQVPVILTSQANAPLLAGNTCQNVVSQVTYEIETNGTFGIQKVSVSLGQTNLTVEPGASLQQHFILRFRAFQQSTAASLTSPRSGNPGYIVGKPLLALTDDISYSMTLLQSQGNGSCSVKRHEVQFGVNAISGCKLRLKKADCSHLQQEIYQTLHGRPRPEYVAIFGNADPAQKGGWTRILNRHCSISAINCTSCCLIPVSLEIQVLWAYVGLLSNPQAHVSGVRFLYQCQSIQDSQQVTEVSLTTLVNFVDITQKPQPPRGQPKMDWKWPFDFFPFKVAFSRGVFSQKCSVSPILILCLLLLGVLNLETM

SEQ ID NO: 4632 - protein, 561 aa, unidentified
MSTERTSWTSLSTIQKIALGLGIPASATVAYILYRRYRESREERLTFVGEDDIEIEMRVPQEAVKLIIGRQGANIKQLRKQTGARIDVDTEDVGDERVLLISGFPVQVCKAKAAIHQILTENTPVSEQLSVPQRSVGRIIGRGGETIRSICKASGAKITCDKESEGTLLLSRLIKISGTQKEVAAAKHLILEKVSEDEELRKRIAHSAETRVPRKQPISVRREDMTEPGGAGEPALWKNTSSSMEPTAPLVTPPPKGGGDMAVVVSKEGSWEKPSDDSFQKSEAQAIPEMPMFEIPSPDFSFHADEYLEVYVSASEHPNHFWIQIVGSRSLQLDKLVNEMTQHYENSVPEDLTVHVGDIVAAPLPTNGSWYRARVLGTLENGNLDLYFVDFGDNGDCPLKDLRALRSDFLSLPFQAIECSLARIAPSGDQWEEEALDEFDRLTHCADWKPLVAKISSYVQTGISTWPKIYLYDTSNGKKLDIGLELVHKGYAIELPEDIEENRAVPDMLKDMATETDASLSTLLTETKKSSGEITHTLSCLSLSEAASMSGDDNLEDDYLL

SEQ ID NO: 4633 - protein, 308 aa, unidentified [sequence omitted]

SEQ ID NO: 4634 - protein, 363 aa, unidentified
MFKRHKSLASERKRALLSQRATRFILKDDMRNFHFLSKLVLSAGPLRPTPAVKHSKTTHFEIEIFDAQTRKQICILDKVTQSSTIHDVKQKFHKACPKWYPSRVGLQLECGGPFLKDYITIQSIAASSIVTLYATDLGQQVSWTTVFLAEYTGPLLIYLLFYLRIPCIYDGKESARRLRHPVVHLACFCHCIHYIRYLLETLFVHKVSAGHTPLKNLIMSCAFYWGFTSWIAYYINHPLYTPPSFGNRQITVSAINFLICEAGNHFINVMLSHPNHTGNNACFPSPNYNPFTWMFFLVSCPNYTYEIGSWISFTVMTQTLPVGIFTLLMSIQMSLWAQKKHKIYLRKFNSYIHRKSAMIPFIL

SEQ ID NO: 4635 - protein, 2155 aa, unidentified
MNYSSFLRIWVSFIFALVQHQAQPRELMYPFWQNDTKTPKVDDGSSSEIKLAIPVFFFGVPYRTVYVNNNGVVSFNVLVSQFTPESFPLTDGRAFVAPFWADVHNGIRGEIYYRETMEPAILKRATKDIRKYFKDMATFSATWVFIVTWEEVTFYGGSSTTPVNTFQAVLVSDGSYTFTLFNYYEINWTTGTASGGDPLTGLGGVMAQAGFNGGNLTNFFSLPGSRTPEIVNIQETTNVNVPGRWAFKVDGKEIDPANGCTSRGQFLRRGEVFWDDLNCTVKCRCLDFNNEIYCQEASCSPYEVCEPKGKFFYCSAVETSTCVVFGEPHYHTFDGFLFHFQGSCAYLLARQCLQTSSLPFFSVEAKNEHRRGSAVSWVKELSVEVNGYKILIPKGSYGRVKVNDLVTSLPVTLDLGTVKIYQSGISTAVETDFGLLVTFDGQHYASISVPGSYINSTCGLCGNYNKNPLDDFLRPDGRPAMSVLDLGESWRVYHADWKCDSGCVDNCTQCDAATEALYFGSDYCGFLNKTDGPLWECGTVVDPTAFVHSCVYDLCSVRDNGTLLCQAIQAYALVCQALGIPIGDWRTQTGCVSTVQCPSFSHYSVCTSSCPDTCSDLTASRNCATPCTEGCECNQGFVLSTSQCVPLHKCGCDFDGHYYTMGEFFWATANCTVQCLCEEGGDVYCFNKTCGSGEVCAVEDGYQGCFPKRETVCLLSQNQVLHTFDGASYAFPSEFSYTLLKTCPERPEYLEIDINKKKPDAGPAWLRGLRILVADQEVKIGGIGASEVKLNGQEVELPFFHPSGKLEIYRNKNSTTVESKGVVTVQYSDIGLLYIRLSTTYFNCTGGLCGFYNANASDEFCLPNGKCTDNLAVFLESWTTFEEICNGECGDLLKACNNDSELLKFYRSRSRCGIINDPSNSSFLECHGVVNVTAYYRTCLFRLCQSGGNESELCDSVARYASACKNADVEVGPWRTYDFCPLECPENSHFEECITCTETCETLTLGPICVDSCSEGCQCDEGYALLGSQCVTRSECGCNFEGHQLATNETFWVDLDCQIFCYCSGTDNRVHCETIPCKDDEYCMEEGGLYYCQARTDASCIVSGYGHYLTFDGFPFDFQTSCPLILCTTGSRPSSDSFPKFVVTAKNEDRDPSLALWVKQVDVTVFGYSIVIHRAYKHTVLVNSERLYLPLKLGQGKINIFSFGFHVVVETDFGLKVVYDWKTFLSITVPRSMQNSTYGLCGRYNGNPDDDLEMPMGLLASSVNEFGQSWVKRDTFCQVGCGDRCPSCAKVEGFSKVQQLCSLIPNQNAAFSKCHSKVNPTFFYKNCLFDSCIDGGAVQTACSWLQNYASTCQTQGITVTGWRNYTSCTVTCPPNSHYESCVSVCQPRCAAIRLKSDCSHYCVEGCHCDAGYVLNGKSCILPHSCGCYSDGKYYEPKQLFWNSDCTRRCRCFRRNVIQCDPRQCKSDEECALRNGVRGCFSTKTSYCLAAGGGVFRTFDGAFLRFPANCAFVLSTICQKLPDISFQLIINFDKWSAPNLTIISPVYFYINEEQILINDRNTVKVNGTQVNVPFITGLATKIYSSEGFLVIDTSPDIQIYYNGFNVIKISISERLQNKVCGLCGNFNGDLTDDYVTLRGKPVVSSVVLAQSWKTNGMQKRPLAPSCNELQFSQYAAMCDNVHIQKMQGDGYCLKLTDMKGFFQPCYGLLDPLPFYESCYLDGCYSHKKFQLCGSLAAYGEACRSFGILSTEWIEKENCSGVVEDPCVGADCPNRTCELGNGRELCGCIEPPPYGNNSHDIIDAEVTCKAAQMEVSISKCKLFQLGFEREGVRINDRQCTGIEGEDFISFQINNTKGNCGNIVQSNGTHIMYKNTLWIESANNTGNIITRDRTINVEFSCAYELDIKISLDSVVKPMLSVINLTVPTQEGSFITKMALYKNASYKHPYRQGEVVLTTRDVLYVGVFVVGADATHLILTLNKCYATPTRDSNDKLRYFIIEGGCQNLKDNTIGIEENAVSLTCRFHVTVFKFIGDYDEVHLHCAVSLCDSEKYSCKITCPHNSRIATDYTKEPKEQIISVGPIRRKRLDWCEDNGGCEQICTSRVDGPLCSCVTGTLQEDGKSCRASNSSMELQVWTLLLIMIQISLWHFVYKSGTTS

SEQ ID NO: 4636 - protein, 329 aa, unidentified
MVTKAFVLLAIFAEASAKSCAPNKADVILVFCYPKTIITKIPECPYGWEVHQLALGGLCYNGVHEGGYYQFVIPDLSPKNKSYCGTQSEYKPPIYHFYSHIVSNDTTVIVKNQPVNYSFSCTYHSTYLVNQAAFDQRVATVHVKNGSMGTFESQLSLNFYTNAKFSIKKEAPFVLEASEIGSDLFAGVEAKGLSIRFKVVLNSCWATPSADFMYPLQWQLINKGCPTDETVLVHENGRDHRATFQFNAFRFQNIPKLSKVWLHCETFICDSEKLSCPVTCDKRKRLLRDQTGGVLVVELSLRSRGFSSLYSFSDVLHHLIMMLGICAVL

SEQ ID NO: 4637 - protein, 273 aa, unidentified
MILKGCLLYPLCSPRNKQRCARLWKIAYGGLLKIVTGSLLTFYVVLCLDGGMVLMRKQVPSRFMYPKEWQHLTMFILLTLNGCVDFMSKNVLPQRCVGLEKGTLVLIIYELLLLMVSHVKDSEGVELHVYSLLILVVFLLLLVLTAELWAPNMCHLQLMETFLILMMGSWLMQAGFILYRPVSGYPWQDDDISDIMFVTTFFCWHVMINASFLLGIYGFSSFWYHCFRPSLKLTGPKEAPYYASTPGPLYKLLQEVEQSEKEDQALLLPKSSP

SEQ ID NO: 4638 - protein, 1124 aa, unidentified
MDSLASLVLCGVSLLLSGTVEGAMDLILINSLPLVSDAETSLTCIASGWRPHEPITIGRDFEALMNQHQDPLEVTQDVTREWAKKVVWKREKASKINGAYFCEGRVRGEAIRIRTMKMRQQASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEACHPGFYGPDCKLRCSCNNGEMCDRFQGCLCSPGWQGLQCEREGIQRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVISWTILDGYSISSITIRYKVQGKNEDQHVDVKIKNATITQYQLKGLEPETAYQVDIFAENNIGSSNPAFSHELVTLPESQAPADLGGGKMLLIAILGSAGMTCLTVLLAFLIILQLKRANVQRRMAQAFQNVREEPAVQFNSGTLALNRKVKNNPDPTIYPVLDWNDIKFQDVIGEGNFGQVLKARIKKDGLRMDAAIKRMKEYASKDDHRDFAGELEVLCKLGHHPNIINLLGACEHRGYLYLAIEYAPHGNLLDFLRKSRVLETDPAFAIANSTASTLSSQQLLHFAADVARGMDYLSQKQFIHRDLAARNILVGENYVAKIADFGLSRGQEVYVKKTMGRLPVRWMAIESLNYSVYTTNSDVWSYGVLLWEIVSLGGTPYCGMTCAELYEKLPQGYRLEKPLNCDDEVYDLMRQCWREKPYERPSFAQILVSLNRMLEERKTYVNTTLYEKFTYAGIDCSAEEAA

SEQ ID NO: 4639 - protein, 837 aa, unidentified
MEPAPSEVRLAVREAIHALSSSEDGGHIFCTLESLKRYLGEMEPPALPREKEEFASAHFSPVLRCLASRLSPAWLELLPHGRLEELWASFFLEGPADQAFLVLMETIEGAAGPSFRLMKMARLLARFLREGRLAVLMEAQCRQQTQPGFILLRETLLGKVVALPDHLGNRLQQENLAEFFPQNYFRLLGEEVVRVLQAVVDSLQGGLDSSVSFVSQVLGKACVHGRQQEILGVLVPRLAALTQGSYLHQRVCWRLVEQVPDRAMEAVLTGLVEAALGPEVLSRLLGNLVVKNKKAQFVMTQKLLFLQSRLTTPMLQSLLGHLAMDSQRRPLLLQVLKELLETWGSSSAIRHTPLPQQRHVSKAVLICLAQLGEPELRDSRDELLASMMAGVKCRLDSSLPPVRRLGMIVAEVVSARIHPEGPPLKFQYEEDELSLELLALASPQPAGDGASEAGTSLVPATAEPPAETPAEIVDGGVPQAQLAGSDSDLDSDDEFVPYDMSGDRELKSSKAPAYVRDCVEALTTSEDIERWEAALRALEGLVYRSPTATREVSVELAKVLLHLEEKTCVVGFAGLRQRALVAVTVTDPAPVADYLTSQFYALNYSLRQRMDILDVLTLAAQELSRPGCLGRTPQPGSPSPNTPCLPEAAVSQPGSAVASDWRVVVEERIRSKTQRLSKGGPRQGPAGSPSRFNSVAGHFFFPLLQRFDRPLVTFDLLGEDQLVLGRLAHTLGALMCLAVNTTVAVAMGKALLEFVWALRFHIDAYVRQGLLSAVSSVLLSLPAARLLEDLMDELLEARSWLADVAEKDPDEDCRTLALRALLLLQRLKNRLLPPASP

SEQ ID NO: 4640 - protein, 2725 aa, unidentified
MEQTDCKPYQPLPKVKHEMDLAYTSSSDESEDGRKPRQSYNSRETLHEYNQELRMNYNSQSRKRKEVEKSTQEMEFCETSHTLCSGYQTDMHSVSRHGYQLEMGSDVDTETEGAASPDHALRMWIRGMKSEHSSCLSSRANSALSLTDTDHERKSDGENGFKFSPVCCDMEAQAGSTQDVQSSPHNQFTFRPLPPPPPPPHACTCARKPPPAADSLQRRSMTTRSQPSPAAPAPPTSTQDSVHLHNSWVLNSNIPLETRHFLFKHGSGSSAIFSAASQNYPLTSNTVYSPPPRPLPRSTFSRPAFTFNKPYRCCNWKCTALSATAITVTLALLLAYVIAVHLFGLTWQLQPVEGELYANGVSKGNRGTESMDTTYSPIGGKVSDKSEKKVFQKGRAIDTGEVDIGAQVMQTIPPGLFWRFQITIHHPIYLKFNISLAKDSLLGIYGRRNIPPTHTQFDFVKLMDGKQLVKQDSKGSDDTQHSPRNLILTSLQETGFIEYMDQGPWYLAFYNDGKKMEQVFVLTTAIEIMDDCSTNCNGNGECISGHCHCFPGFLGPDCARDSCPVLCGGNGEYEKGHCVCRHGWKGPECDVPEEQCIDPTCFGHGTCIMGVCICVPGYKGEICEEEDCLDPMCSNHGICVKGECHCSTGWGGVNCETPLPVCQEQCSGHGTFLLDAGVCSCDPKWTGSDCSTELCTMECGSHGVCSRGICQCEEGWVGPTCEERSCHSHCTEHGQCKDGKCECSPGWEGDHCTIAHYLDAVRDGCPGLCFGNGRCTLDQNGWHCVCQVGWSGTGCNVVMEMLCGDNLDNDGDGLTDCVDPDCCQQSNCYISPLCQGSPDPLDLIQQSQTLFSQHTSRLFYDRIKFLIGKDSTHVIPPEVSFDSRRACVIRGQVVAIDGTPLVGVNVSFLHHSDYGFTISRQDGSFDLVAIGGISVILIFDRSPFLPEKRTLWLPWNQFIVVEKVTMQRVVSDPPSCDISNFISPNPIVLPSPLTSFGGSCPERGTIVPELQVVQEEIPIPSSFVRLSYLSSRTPGYKTLLRILLTHSTIPVGMIKVHLTVAVEGRLTQKWFPAAINLVYTFAWNKTDIYGQKVWGLAEALVSVGYEYETCPDFILWEQRTVVLQGFEMDASNLGGWSLNKHHILNPQSGIIHKGNGENMFISQQPPVISTIMGNGHQRSVACTNCNGPAHNNKLFAPVALASGPDGSVYVGDFNFVRRIFPSGNSVSILELSTSPAHKYYLAMDPVSESLYLSDTNTRKVYKLKSLVETKDLSKNFEVVAGTGDQCLPFDQSHCGDGGRASEASLNSPRGITVDRHGFIYFVDGTMIRKIDENAVITTVIGSNGLTSTQPLSCDSGMDITQVRLEWPTDLAVNPMDNSLYVLDNNIVLQISENRRVRIIAGRPIHCQVPGIDHFLVSKVAIHSTLESARAISVSHSGLLFIAETDERKVNRIQQVTTNGEIYIIAGAPTDCDCKIDPNCDCFSGDGGYAKDAKMKAPSSLAVSPDGTLYVADLGNVRIRTISRNQAHLNDMNIYEIASPADQELYQFTVNGTHLHTLNLITRDYVYNFTYNSEGDLGAITSSNGNSVHIRRDAGGMPLWLVVPGGQVYWLTISSNGVLKRVSAQGYNLALMTYPGNTGLLATKSNENGWTTVYEYDPEGHLTNATFPTGEVSSFHSDLEKLTKVELDTSNRENVLMSTNLTATSTIYILKQENTQSTYRVNPDGSLRVTFASGMEIGLSSEPHILAGAVNPTLGKCNISLPGEHNANLIEWRQRKEQNKGNVSAFERRLRAHNRNLLSIDFDHITRTGKIYDDHRKFTLRILYDQTGRPILWSPVSRYNEVNITYSPSGLVTFIQRGTWNEKMEYDQSGKIISRTWADGKIWSYTYLEKSVMLLLHSQRRYIFEYDQPDCLLSVTMPSMVRHSLQTMLSVGYYRNIYTPPDSSTSFIQDYSRDGRLLQTLHLGTGRRVLYKYTKQARLSEVLYDTTQVTLTYEESSGVIKTIHLMHDGFICTIRYRQTGPLIGRQIFRFSEEGLVNARFDYSYNNFRVTSMQAVINETPLPIDLYRYVDVSGRTEQFGKFSVINYDLNQVITTTVMKHTKIFSANGQVIEVQYEILKAIAYWMTIQYDNVGRMVICDIRVGVDANITRYFYEYDADGQLQTVSVNDKTQWRYSYDLNGNINLLSHGKSARLTPLRYDLRDRITRLGEIQYKMDEDGFLRQRGNDIFEYNSNGLLQKAYNKASGWTVQYYYDGLGRRVASKSSLGQHLQFFYADLTNPIRVTHLYNHTSSEITSLYYDLQGHLIAMELSSGEEYYVACDNTGTPLAVFSSRGQVIKEILYTPYGDIYHDTYPDFQVIIGFHGGLYDFLTKLVHLGQRDYDVVAGRWTTPNHHIWKQLNLLPKPFNLYSFENNYPVGKIQDVAKYTTDIRSWLELFGFQLHNVLPGFPKPELENLELTYELLRLQTKTQEWDPGKTILGIQCELQKQLRNFISLDQLPMTPRYNDGRCLEGGKQPRFAAVPSVFGKGIKFAIKDGIVTADIIGVANEDSRRLAAILNNAHYLENLHFTIEGRDTHYFIKLGSLEEDLVLIGNTGGRRILENGVNVTVSQMTSVLNGRTRRFADIQLQHGALCFNIRYGTTVEEEKNHVLEIARQRAVAQAWTKEQRRLQEGEEGIRAWTEGEKQQLLSTGRVQGYDGYFVLSVEQYLELSDSANNIHFMRQSEIGRR

SEQ ID NO: 4641 - protein, 2535 aa, unidentified
MVSPPLLIISVAGTIECKPDHLLWRPGSTSPQSVSFLHGKVVMESLGPPNHHSQSTLRPPLPPPHNHTLSHHHSSANSLNRNSLTNRRSQIHAPAPAPNDLATTPESVQLQDSWVLNSNVPLETRHFLFKTSSGSTPLFSSSSPGYPLTSGTVYTPPPRLLPRNTFSRKAFKLKKPSKYCSWKCAALSAIAAALLLAILLAYFIVPWSLKNSSIDSGEAEVGRRVTQEVPPGVFWRSQIHISQPQFLKFNISLGKDALFGVYIRRGLPPSHAQYDFMERLDGKEKWSVVESPRERRSIQTLVQNEAVFVQYLDVGLWHLAFYNDGKDKEMVSFNTVVLDSVQDCPRNCHGNGECVSGVCHCFPGFLGADCAKAACPVLCSGNGQYSKGTCQCYSGWKGAECDVPMNQCIDPSCGGHGSCIDGNCVCSAGYKGEHCEEVDCLDPTCSSHGVCVNGECLCSPGWGGLNCELARVQCPDQCSGHGTYLPDTGLCSCDPNWMGPDCSVEVCSVDCGTHGVCIGGACRCEEGWTGAACDQRVCHPRCIEHGTCKDGKCECREGWNGEHCTIGRQTAGTETDGCPDLCNGNGRCTLGQNSWQCVCQTGWRGPGCNVAMETSCADNKDNEGDGLVDCLDPDCCLQSACQNSLLCRGSRDPLDIIQQGQTDWPAVKSFYDRIKLLAGKDSTHIIPGENPFNSSLVSLIRGQVVTTDGTPLVGVNVSFVKYPKYGYTITRQDGTFDLIANGGASLTLHFERAPFMSQERTVWLPWNSFYAMDTLVMKTEENSIPSCDLSGFVRPDPIIISSPLSTFFSAAPGQNPIVPETQVLHEEIELPGSNVKLRYLSSRTAGYKSLLKITMTQSTVPLNLIRVHLMVAVEGHLFQKSFQASPNLAYTFIWDKTDAYGQRVYGLSDAVVSVGFEYETCPSLILWEKRTALLQGFELDPSNLGGWSLDKHHILNVKSGILHKGTGENQFLTQQPAIITSIMGNGRRRSISCPSCNGLAEGNKLLAPVALAVGIDGSLYVGDFNYIRRIFPSRNVTSILELRNNPAHKYYLAVDPVSGSLYVSDTNSRRIYRVKSLSGTKDLAGNSEVVAGTGEQCLPFDEARCGDGGKAIDATLMSPRGIAVDKNGLMYFVDATMIRKVDQNGIISTLLGSNDLTAVRPLSCDSSMDVAQVRLEWPTDLAVNPMDNSLYVLENNVILRITENHQVSIIAGRPMHCQVPGIDYSLSKLAIHSALESASAIAISHTGVLYITETDEKKINRLRQVTTNGEICLLAGAASDCDCKNDVNCNCYSGDDAYATDAILNSPSSLAVAPDGTIYIADLGNIRIRAVSKNKPVLNAFNQYEAASPGEQELYVFNADGIHQYTVSLVTGEYLYNFTYSTDNDVTELIDNNGNSLKIRRDSSGMPRHLLMPDNQIITLTVGTNGGLKVVSTQNLELGLMTYDGNTGLLATKSDETGWTTFYDYDHEGRLTNVTRPTGVVTSLHREMEKSITIDIENSNRDDDVTVITNLSSVEASYTVVQDQVRNSYQLCNNGTLRVMYANGMGISFHSEPHVLAGTITPTIGRCNISLPMENGLNSIEWRLRKEQIKGKVTIFGRKLRVHGRNLLSIDYDRNIRTEKIYDDHRKFTLRIIYDQVGRPFLWLPSSGLAAVNVSYFFNGRLAGLQRGAMSERTDIDKQGRIVSRMFADGKVWSYSYLDKSMVLLLQSQRQYIFEYDSSDRLLAVTMPSVARHSMSTHTSIGYIRNIYNPPESNASVIFDYSDDGRILKTSFLGTGRQVFYKYGKLSKLSEIVYDSTAVTFGYDETTGVLKMVNLQSGGFSCTIRYRKIGPLVDKQIYRFSEEGMVNARFDYTYHDNSFRIASIKPVISETPLPVDLYRYDEISGKVEHFGKFGVIYYDINQIITTAVMTLSKHFDTHGRIKEVQYEMFRSLMYWMTVQYDSMGRVIKRELKLGPYANTTKYTYDYDGDGQLQSVAVNDRPTWRYSYDLNGNLHLLNPGNSVRLMPLRYDLRDRITRLGDVQYKIDDDGYLCQRGSDIFEYNSKGLLTRAYNKASGWSVQYRYDGVGRRASYKTNLGHHLQYFYSDLHNPTRITHVYNHSNSEITSLYYDLQGHLFAMESSSGEEYYVASDNTGTPLAVFSINGLMIKQLQYTAYGEIYYDSNPDFQMVIGFHGGLYDPLTKLVHFTQRDYDVLAGRWTSPDYTMWKNVGKEPAPFNLYMFKSNNPLSSELDLKNYVTDVKSWLVMFGFQLSNIIPGFPRAKMYFVPPPYELSESQASENGQLITGVQQTTERHNQAFMALEGQVITKKLHASIREKAGHWFATTTPIIGKGIMFAIKEGRVTTGVSSIASEDSRKVASVLNNAYYLDKMHYSIEGKDTHYFVKIGSADGDLVTLGTTIGRKVLESGVNVTVSQPTLLVNGRTRRFTNIEFQYSTLLLSIRYGLTPDTLDEEKARVLDQARQRALGTAWAKEQQKARDGREGSRLWTEGEKQQLLSTGRVQGYEGYYVLPVEQYPELADSSSNIQFLRQNEMGKR

SEQ ID NO: 4642 - protein, 2699 aa, unidentified
MDVKERRPYCSLTKSRREKERRYTNSSADNEECRVPTQKSYSSSETLKAFDHDSSRLLYGNRVKDLVHREADEFTRQGQNFTLRQLGVCEPATRRGLAFCAEMGLPHRGYSISAGSDADTENEAVMSPEHAMRLWGRGVKSGRSSCLSSRSNSALTLTDTEHENKSDSENEQPASNQGQSTLQPLPPSHKQHSAQHHPSITSLNRNSLTNRRNQSPAPPAALPAELQTTPESVQLQDSWVLGSNVPLESRHFLFKTGTGTTPLFSTATPGYTMASGSVYSPPTRPLPRNTLSRSAFKFKKSSKYCSWKCTALCAVGVSVLLAILLSYFIAMHLFGLNWQLQQTENDTFENGKVNSDTMPTNTVSLPSGDNGKLGGFTQENNTIDSGELDIGRRAIQEIPPGIFWRSQLFIDQPQFLKFNISLQKDALIGVYGRKGLPPSHTQYDFVELLDGSRLIAREQRSLLETERAGRQARSVSLHEAGFIQYLDSGIWHLAFYNDGKNAEQVSFNTIVIESVVECPRNCHGNGECVSGTCHCFPGFLGPDCSRAACPVLCSGNGQYSKGRCLCFSGWKGTECDVPTTQCIDPQCGGRGICIMGSCACNSGYKGESCEEADCIDPGCSNHGVCIHGECHCSPGWGGSNCEILKTMCPDQCSGHGTYLQESGSCTCDPNWTGPDCSNEICSVDCGSHGVCMGGTCRCEEGWTGPACNQRACHPRCAEHGTCKDGKCECSQGWNGEHCTIEGCPGLCNSNGRCTLDQNGWHCVCQPGWRGAGCDVAMETLCTDSKDNEGDGLIDCMDPDCCLQSSCQNQPYCRGLPDPQDIISQSLQSPSQQAAKSFYDRISFLIGSDSTHVIPGESPFNKSLASVIRGQVLTADGTPLIGVNVSFFHYPEYGYTITRQDGMFDLVANGGASLTLVFERSPFLTQYHTVWIPWNVFYVMDTLVMKKEENDIPSCDLSGFVRPNPIIVSSPLSTFFRSSPEDSPIIPETQVLHEETTIPGTDLKLSYLSSRAAGYKSVLKITMTQSIIPFNLMKVHLMVAVVGRLFQKWFPASPNLAYTFIWDKTDAYNQKVYGLSEAVVSVGYEYESCLDLTLWEKRTAILQGYELDASNMGGWTLDKHHVLDVQNGILYKGNGENQFISQQPPVVSSIMGNGRRRSISCPSCNGQADGNKLLAPVALACGIDGSLYVGDFNYVRRIFPSGNVTSVLELSSNPAHRYYLATDPVTGDLYVSDTNTRRIYRPKSLTGAKDLTKNAEVVAGTGEQCLPFDEARCGDGGKAVEATLMSPKGMAVDKNGLIYFVDGTMIRKVDQNGIISTLLGSNDLTSARPLTCDTSMHISQVRLEWPTDLAINPMDNSIYVLDNNVVLQITENRQVRIAAGRPMHCQVPGVEYPVGKHAVQTTLESATAIAVSYSGVLYITETDEKKINRIRQVTTDGEISLVAGIPSECDCKNDANCDCYQSGDGYAKDAKLSAPSSLAASPDGTLYIADLGNIRIRAVSKNKPLLNSMNFYEVASPTDQELYIFDINGTHQYTVSLVTGDYLYNFSYSNDNDITAVTDSNGNTLRIRRDPNRMPVRVVSPDNQVIWLTIGTNGCLKSMTAQGLELVLFTYHGNSGLLATKSDETGWTTFFDYDSEGRLTNVTFPTGVVTNLHGDMDKAITVDIESSSREEDVSITSNLSSIDSFYTMVQDQLRNSYQIGYDGSLRIIYASGLDSHYQTEPHVLAGTANPTVAKRNMTLPGENGQNLVEWRFRKEQAQGKVNVFGRKLRVNGRNLLSVDFDRTTKTEKIYDDHRKFLLRIAYDTSGHPTLWLPSSKLMAVNVTYSSTGQIASIQRGTTSEKVDYDGQGRIVSRVFADGKTWSYTYLEKSMVLLLHSQRQYIFEYDMWDRLSAITMPSVARHTMQTIRSIGYYRNIYNPPESNASIITDYNEEGLLLQTAFLGTSRRVLFKYRRQTRLSEILYDSTRVSFTYDETAGVLKTVNLQSDGFICTIRYRQIGPLIDRQIFRFSEDGMVNARFDYSYDNSFRVTSMQGVINETPLPIDLYQFDDISGKVEQFGKFGVIYYDINQIISTAVMTYTKHFDAHGRIKEIQYEIFRSLMYWITIQYDNMGRVTKREIKIGPFANTTKYAYEYDVDGQLQTVYLNEKIMWRYNYDLNGNLHLLNPSNSARLTPLRYDLRDRITRLGDVQYRLDEDGFLRQRGTEIFEYSSKGLLTRVYSKGSGWTVIYRYDGLGRRVSSKTSLGQHLQFFYADLTYPTRITHVYNHSSSEITSLYYDLQGHLFAMEISSGDEFYIASDNTGTPLAVFSSNGLMLKQIQYTAYGEIYFDSNIDFQLVIGFHGGLYDPLTKLIHFGERDYDILAGRWTTPDIEIWKRIGKDPAPFNLYMFRNNNPASKIHDVKDYITDVNSWLVTFGFHLHNAIPGFPVPKFDLTEPSYELVKSQQWDDIPPIFGVQQQVARQAKAFLSLGKMAEVQVSRRRAGGAQSWLWFATVKSLIGKGVMLAVSQGRVQTNVLNIANEDCIKVAAVLNNAFYLENLHFTIEGKDTHYFIKTTTPESDLGTLRLTSGRKALENGINVTVSQSTTVVNGRTRRFADVEMQFGALALHVRYGMTLDEEKARILEQARQRALARAWAREQQRVRDGEEGARLWTEGEKRQLLSAGKVQGYDGYYVLSVEQYPELADSANNIQFLRQSEIGRR

SEQ ID NO: 4643 - protein, 2769 aa, unidentified
MDVKERKPYRSLTRRRDAERRYTSSSADSEEGKAPQKSYSSSETLKAYDQDARLAYGSRVKDIVPQEAEEFCRTGANFTLRELGLEEVTPPHGTLYRTDIGLPHCGYSMGAGSDADMEADTVLSPEHPVRLWGRSTRSGRSSCLSSRANSNLTLTDTEHENTETDHPGGLQNHARLRTPPPPLSHAHTPNQHHAASINSLNRGNFTPRSNPSPAPTDHSLSGEPPAGGAQEPAHAQENWLLNSNIPLETRNLGKQPFLGTLQDNLIEMDILGASRHDGAYSDGHFLFKPGGTSPLFCTTSPGYPLTSSTVYSPPPRPLPRSTFARPAFNLKKPSKYCNWKCAALSAIVISATLVILLAYFVAMHLFGLNWHLQPMEGQMYEITEDTASSWPVPTDVSLYPSGGTGLETPDRKGKGTTEGKPSSFFPEDSFIDSGEIDVGRRASQKIPPGTFWRSQVFIDHPVHLKFNVSLGKAALVGIYGRKGLPPSHTQFDFVELLDGRRLLTQEARSLEGTPRQSRGTVPPSSHETGFIQYLDSGIWHLAFYNDGKESEVVSFLTTAIESVDNCPSNCYGNGDCISGTCHCFLGFLGPDCGRASCPVLCSGNGQYMKGRCLCHSGWKGAECDVPTNQCIDVACSNHGTCITGTCICNPGYKGESCEEVDCMDPTCSGRGVCVRGECHCSVGWGGTNCETPRATCLDQCSGHGTFLPDTGLCSCDPSWTGHDCSIEICAADCGGHGVCVGGTCRCEDGWMGAACDQRACHPRCAEHGTCRDGKCECSPGWNGEHCTIAHYLDRVVKEGCPGLCNGNGRCTLDLNGWHCVCQLGWRGAGCDTSMETACGDSKDNDGDGLVDCMDPDCCLQPLCHINPLCLGSPNPLDIIQETQVPVSQQNLHSFYDRIKFLVGRDSTHIIPGENPFDGGHACVIRGQVMTSDGTPLVGVNISFVNNPLFGYTISRQDGSFDLVTNGGISIILRFERAPFITQEHTLWLPWDRFFVMETIIMRHEENEIPSCDLSNFARPNPVVSPSPLTSFASSCAEKGPIVPEIQALQEEISISGCKMRLSYLSSRTPGYKSVLRISLTHPTIPFNLMKVHLMVAVEGRLFRKWFAAAPDLSYYFIWDKTDVYNQKVFGLSEAFVSVGYEYESCPDLILWEKRTTVLQGYEIDASKLGGWSLDKHHALNIQSGILHKGNGENQFVSQQPPVIGSIMGNGRRRSISCPSCNGLADGNKLLAPVALTCGSDGSLYVGDFNYIRRIFPSGNVTNILELRNKDFRHSHSPAHKYYLATDPMSGAVFLSDSNSRRVFKIKSTVVVKDLVKNSEVVAGTGDQCLPFDDTRCGDGGKATEATLTNPRGITVDKFGLIYFVDGTMIRRIDQNGIISTLLGSNDLTSARPLSCDSVMDISQVHLEWPTDLAINPMDNSLYVLDNNVVLQISENHQVRIVAGRPMHCQVPGIDHFLLSKVAIHATLESATALAVSHNGVLYIAETDEKKINRIRQVTTSGEISLVAGAPSGCDCKNDANCDCFSGDDGYAKDAKLNTPSSLAVCADGELYVADLGNIRIRFIRKNKPFLNTQNMYELSSPIDQELYLFDTTGKHLYTQSLPTGDYLYNFTYTGDGDITLITDNNGNMVNVRRDSTGMPLWLVVPDGQVYWVTMGTNSALKSVTTQGHELAMMTYHGNSGLLATKSNENGWTTFYEYDSFGRLTNVTFPTGQVSSFRSDTDSSVHVQVETSSKDDVTITTNLSASGAFYTLLQDQVRNSYYIGADGSLRLLLANGMEVALQTEPHLLAGTVNPTVGKRNVTLPIDNGLNLVEWRQRKEQARGQVTVFGRRLRVHNRNLLSLDFDRVTRTEKIYDDHRKFTLRILYDQAGRPSLWSPSSRLNGVNVTYSPGGYIAGIQRGIMSERMEYDQAGRITSRIFADGKTWSYTYLEKSMVLLLHSQRQYIFEFDKNDRLSSVTMPNVARQTLETIRSVGYYRNIYQPPEGNASVIQDFTEDGHLLHTFYLGTGRRVIYKYGKLSKLAETLYDTTKVSFTYDETAGMLKTINLQNEGFTCTIRYRQIGPLIDRQIFRFTEEGMVNARFDYNYDNSFRVTSMQAVINETPLPIDLYRYDDVSGKTEQFGKFGVIYYDINQIITTAVMTHTKHFDAYGRMKEVQYEIFRSLMYWMTVQYDNMGRVVKKELKVGPYANTTRYSYEYDADGQLQTVSINDKPLWRYSYDLNGNLHLLSPGNSARLTPLRYDIRDRITRLGDVQYKMDEDGFLRQRGGDIFEYNSAGLLIKAYNRAGSWSVRYRYDGLGRRVSSKSSHSHHLQFFYADLTNPTKVTHLYNHSSSEITSLYYDLQGHLFAMELSSGDEFYIACDNIGTPLAVFSGTGLMIKQILYTAYGEIYMDTNPNFQIIIGYHGGLYDPLTKLVHMGRRDYDVLAGRWTSPDHELWKHLSSSNVMPFNLYMFKNNNPISNSQDIKCFMTDVNSWLLTFGFQLHNVIPGYPKPDMDAMEPSYELIHTQMKTQEWDNSKSILGVQCEVQKQLKAFVTLERFDQLYGSTITSCQQAPKTKKFASSGSVFGKGVKFALKDGRVTTDIISVANEDGRRVAAILNHAHYLENLHFTIDGVDTHYFVKPGPSEGDLAILGLSGGRRTLENGVNVTVSQINTVLNGRTRRYTDIQLQYGALCLNTRYGTTLDEEKARVLELARQRAVRQAWAREQQRLREGEEGLRAWTEGEKQQVLSTGRVQGYDGFFVISVEQYPELSDSANNIHFMRQSEMGRR

SEQ ID NO: 4644 - protein, 1132 aa, unidentified
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 4645 - protein, 929 aa, unidentified
MTKKRKRQHDFQKVKLKVGKKKPKLQNATPTNFKTKTIHLPEQLKEDGTLPTNNRKLNIKDLLSQMHHYNAGVKQSALLGLKDLLSQYPFIIDAHLSNILSEVTAVFTDKDANVRLAAVQLLQFLAPKIRAEQISPFFPLVSAHLSSAMTHITEGIQEDSLKVLDILLEQYPALITGRSSILLKNFVELISHQQLSKGLINRDRSQSWILSVNPNRRLTSQQWRLKVLVRLSKFLQALADGSSRLRESEGLQEQKENPHATSNSIFINWKEHANDQQHIQVYENGGSQPNVSSQFRLRYLVGGLSGVDEGLSSTENLKGFIEIIIPLLIECWVEAVPPQLATPVGNGIEREPLQVMQQVLNIISLLWKLSKQQDETHKLESWLRKNYLIDFKHHFMSRFPYVLKEITKHKRKEPNKSIKHCTVLSNNIDHLLLNLTLSDIMVSLANASTLQKDCSWIEMIRKFVTETLEDGSRLNSKQLNRLLGVSWRLMQIQPNREDTETLIKAVYTLYQQRGLILPVRTLLLKFFSKIYQTEELRSCRFRYRSKVLSRWLAGLPLQLAHLGSRNPELSTQLIDIIHTAAARANKELLKSLQATALRIYDPQEGAVVVLPADSQQRLVQLVYFLPSLPADLLSRLSRCCIMGRLSSSLAAMLIGILHMRSSFSGWKYSAKDWLMSDVDYFSFLFSTLTGFSKEELTWLQSLRGVPHVIQTQLSPVLLYLTDLDQFLHHWDVTEAVFHSLLVIPARSQNFDILQSAISKHLVGLTVIPDSTAGCVFGVICKLLDHTCVVSETLLPFLASCCYSLLYFLLTIEKGEAEHLRKRDKLWGVCVSILALLPRVLRLMLQSLRVNRVGPEELPVVGQLLRLLLQHAPLRTHMLTNAILVQQIIKNITTLKSGSVQEQWLTDLHYCFNVYITGHPQGPSALATVY

SEQ ID NO: 4646 - protein, 249 aa, unidentified
MGTPRIQHLLILLVLGASLLTSGLELYCQKGLSMTVEADPANMFNWTTEEVETCDKGALCQETILIIKAGTETAILATKGCIPEGEEAITIVQHSSPPGLIVTSYSNYCEDSFCNDKDSLSQFWEFSETTASTVSTTLHCPTCVALGTCFSAPSLPCPNGTTRCYQGKLEITGGGIESSVEVKGCTAMIGCRLMSGILAVGPMFVREACPHQLLTQPRKTENGATCLPIPVWGLQLLLPLLLPSFIHFS

SEQ ID NO: 4647 - protein, 1127 aa, unidentified
MTSLYGRHAEKTTDMPKPSAPKVHVQRSVSRDTIAIHFSASGEEEEEEEEEFREYFEEGLDDQSIVTGLEAKEDLYLEPQVGHDPAGPAASPVLADGLSVSQAPAILPVSKNTVKLLESPVPAAQVLSTVPLAVSPGSSSSGPLASSPSVSSLSEQKTSSSSPLSSPSKSPILSSSASTSTLSSAKPFMSLVKSLSTEVEPKESPHPARHRHLMKTLVKSLSTDTSRQESDTVSYKPPDSKLNLHLFKQFTQPRNTGGDSKTAPSSPLTSPSDTRSFFKVPEMEAKIEDTKRRLSEVIYEPFQLLSKIIGEESGSHRPKALSSSASELSNLSSLNGHLESNNNYSIKEEECDSEGDGYGSDSNIPRSDHPKSTGEPTREIELKSSQGSSLKDLGLKTSSLVLEKCSLSALVSKEDEEFCELYTEDFDLETEGESKVDKLSDIPLKPEVLAEDGVVLDSEDEVDSAVQHPELPVKTLGFFIMCVYVYLILPLPHYVSGLFLGIGLGFMTAVCVIWFFTPPSAHKYHKLHKNLRHWNTRSLDIKEPEILKGWMNEIYNYDPETYHATLTHSVFVRLEGGTLRLSKPNKNISRRASYNEPKPEVTYISQKIYDLSDSKIYLVPKTLARKRIWNKKYPICIELGQQDDFMSKAQTDKETSEEKPPAEGSEDPKKPPRPQEGTRSSQRDQILYLFGRTGREKEEWFRRFILASKLKSEIKKSSGVSGGKPGLLPAHSRHNSPSGHLTHSRSSSKGSVEEIMSQPKQKELAGSVRQKMLLDYSVYMGRCVPQESRSPQRSPLQSAESSPTAGKKLPEVPPSEEEEQEAWVNALLGRIFWDFLGEKYWSDLVSKKIQMKLSKIKLPYFMNELTLTELDMGVAVPKILQAFKPYVDHQGLWIDLEMSYNGSFLMTLETKMNLTKLGKEPLVEALKVGEIGKEGCRPRAFCLADSDEESSSAGSSEEDDAPEPSGGDKQLLPGAEGYVGGHRTSKIMRFVDKITKSKYFQKATETEFIKKKIEEVSNTPLLLTVEVQECRGTLAVNIPPPPTDRVWYGFRKPPHVELKARPKLGEREVTLVHVTDWIEKKLEQEFQKVFVMPNMDDVYITIMHSAMDPRSTSCLLKDPPVEAADQP

SEQ ID NO: 4648 - protein, 196 aa, unidentified
MWFMYLLSWLSLFIQVAFITLAVAAGLYYLAELIEEYTVATSRIIKYMIWFSTAVLIGLYVFERFPTSMIGVGLFTNLVYFGLLQTFPFIMLTSPNFILSCGLVVVNHYLAFQFFAEEYYPFSEVLAYFTFCLWIIPFAFFVSLSAGENVLPSTMQPGDDVVSNYFTKGKRGKRLGILVVFSFIKEAILPSRQKIY

SEQ ID NO: 4649 - protein, 313 aa, unidentified
MSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGEESPSPELIDLYQKFGFKVFSFPAPSHVVTATFPYTTILSIWLATRRVHPALDTYIKERKLCAYPRLEIYQEDQIHFMCPLARQGDFYVPEMKETEWKWRGLVEAIDTQVDGTGADTMSDTSSVSLEVSPGSRETSAATLSPGASSRGWDDGDTRSEHSYSESGASGSSFEELDLEGEGPLGESRLDPGTEPLGTTKWLWEPTAPEKGKE

SEQ ID NO: 4650 - protein, 151 aa, unidentified
MEYVLEVKNSPRHLLKQFTVCDVPLYDICDYNVSRDRCQELGCCFYEGVCYKKAVPIYIHVFSALIVIIAGAFVITIIYRVIQESRKEKAIPVDVALPQKSSEKAELASSSSKLGLKPASPGPPSAGPSMKSDEDKDDVTGTITEAEETED

SEQ ID NO: 4651 - protein, 206 aa, unidentified
MDSQQEDLRFPGMWVSLYFGILGLCSVITGGCIIFLHWRKNLRREEHAQQWVEVMRAATFTYSPLLYWINKRRRYGMNAAINTGPAPAVTKTETEVQNPDVLWDLDIPEGRSHADQDSNPKAEAPAPLQPALQLAPQQPQARSPFPLPIFQEVPFAPPLCNLPPLLNHSVSYPLATCPERNVLFHSLLNLAQEDHSFNAKPFPSEL

SEQ ID NO: 4652 - protein, 801 aa, unidentified
MERLWGLFQRAQQLSPRSSQTVYQRVEGPRKGHLEEEEEDGEEGAETLAHFCPMELRGPEPLGSRPRQPNLIPWAAAGRRAAPYLVLTALLIFTGAFLLGYVAFRGSCQACGDSVLVVSEDVNYEPDLDFHQGRLYWSDLQAMFLQFLGEGRLEDTIRQTSLRERVAGSAGMAALTQDIRAALSRQKLDHVWTDTHYVGLQFPDPAHPNTLHWVDEAGKVGEQLPLEDPDVYCPYSAIGNVTGELVYAHYGRPEDLQDLRARGVDPVGRLLLVRVGVISFAQKVTNAQDFGAQGVLIYPEPADFSQDPPKPSLSSQQAVYGHVHLGTGDPYTPGFPSFNQTQFPPVASSGLPSIPAQPISADIASRLLRKLKGPVAPQEWQGSLLGSPYHLGPGPRLRLVVNNHRTSTPINNIFGCIEGRSEPDHYVVIGAQRDAWGPGAAKSAVGTAILLELVRTFSSMVSNGFRPRRSLLFISWDGGDFGSVGSTEWLEGYLSVLHLKAVVYVSLDNAVLGDDKFHAKTSPLLTSLIESVLKQVDSPNHSGQTLYEQVVFTNPSWDAEVIRPLPMDSSAYSFTAFVGVPAVEFSFMEDDQAYPFLHTKEDTYENLHKVLQGRLPAVAQAVAQLAGQLLIRLSHDRLLPLDFGRYGDVVLRHIGNLNEFSGDLKARGLTLQWVYSARGDYIRAAEKLRQEIYSSEERDERLTRMYNVRIMRVEFYFLSQYVSPADSPFRHIFMGRGDHTLGALLDHLRLLRSNSSGTPGATSSTGFQESRFRRQLALLTWTLQGAANALSGDVWNIDNNF

SEQ ID NO: 4653 - protein, 760 aa, unidentified
MMDQARSAFSNLFGGEPLSYTRFSLARQVDGDNSHVEMKLAVDEEENADNNTKANVTKPKRCSGSICYGTIAVIVFFLIGFMIGYLGYCKGVEPKTECERLAGTESPVREEPGEDFPAARRLYWDDLKRKLSEKLDSTDFTGTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGQFLYQDSNWASKVEKLTLDNAAFPFLAYSGIPAVSFCFCEDTDYPYLGTTMDTYKELIERIPELNKVARAAAEVAGQFVIKLTHDVELNLDYERYNSQLLSFVRDLNQYRADIKEMGLSLQWLYSARGDFFRATSRLTTDFGNAEKTDRFVMKKLNDRVMRVEYHFLSPYVSPKESPFRHVFWGSGSHTLPALLENLKLRKQNNGAFNETLFRNQLALATWTIQGAANALSGDVWDIDNEF

SEQ ID NO: 4654 - protein, 160 aa, unidentified
MVPSAGQLALFALGIVLAACQALENSTSPLSADPPVAAAVVSHFNDCPDSHTQFCFHGTCRFLVQEDKPACVCHSGYVGARCEHADLLAVVAASQKKQAITALVVVSIVALAVLIITCVLIHCCQVRKHCEWCRALICRHEKPSALLKGRTACCHSETVV

SEQ ID NO: 4655 - protein, 503 aa, unidentified
MEAAVAAPRPRLLLLVLAAAAAAAAALLPGATALQCFCHLCTKDNFTCVTDGLCFVSVTETTDKVIHNSMCIAEIDLIPRDRPFVCAPSSKTGSVTTTYCCNQDHCNKIELPTTVKSSPGLGPVELAAVIAGPVCFVCISLMLMVYICHNRTVIHHRVPNEEDPSLDRPFISEGTTLKDLIYDMTTSGSGSGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 4656 - protein, 567 aa, unidentified
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 4657 - protein, 851 aa, unidentified
MTSHYVIAIFALMSSCLATAGPEPGALCELSPVSASHPVQALMESFTVLSGCASRGTTGLPQEVHVLNLRTAGQGPGQLQREVTLHLNPISSVHIHHKSVVFLLNSPHPLVWHLKTERLATGVSRLFLVSEGSVVQFSSANFSLTAETEERNFPHGNEHLLNWARKEYGAVTSFTELKIARNIYIKVGEDQVFPPKCNIGKNFLSLNYLAEYLQPKAAEGCVMSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNAEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKEKGPSMKEPNPISPPIFHGLDTLTVMGIAFAAFVIGALLTGALWYIYSHTGETAGRQQVPTSPPASENSSAAHSIGSTQSTPCSSSSTA

SEQ ID NO: 4658 - protein, 316 aa, unidentified
MGESAAATASLFQRRRRGRGGRVTFPGGLKGSARFLSFGPPFPAPPAPPFPAAPGPWLRRPLFSLKLSDTEDVFPRRAGPLEVPADSRVFVQAALARPSPRWGLALHRCSVTPSSRPAPGPALALLREGCPADTSVAFPPPPPPSPGAARPARFSFRLRPVFNASVQFLHCQLSRCRRLRGVRRAPAPLTPPPPPPPSRCLPQDEACADTGSGSAEGLAADGPHLHTLTQPIVVTVPRPPPRPPKSVPGRAVRPEPPAPAPAALEPAPVVALVLAAFVLGAALAAGLGLVCAHSAPHAPGPPARASPSGPQPRRSQ

SEQ ID NO: 4659 - protein, 437 aa, unidentified
MRFVVALVLLNVAAAGAVPLLATESVKQEEAGVRPSAGNVSTHPSLSQRPGGSTKSHPEPQTPKDSPSKSSAEAQTPEDTPNKSGAEAKTQKDSSNKSGAEAKTQKGSTSKSGSEAQTTKDSTSKSHPELQTPKDSTGKSGAEAQTPEDSPNRSGAEAKTQKDSPSKSGSEAQTTKDVPNKSGADGQTPKDGSSKSGAEDQTPKDVPNKSGAEKQTPKDGSNKSGAEEQGPIDGPSKSGAEEQTSKDSPNKVVPEQPSRKDHSKPISNPSDNKELPKADTNQLADKGKLSPHAFKTESGEETDLISPPQEEVKSSEPTEDVEPKEAEDDDTGPEEGSPPKEEKEKMSGSASSENREGTLSDSTGSEKDDLYPNGSGNGSAESSHFFAYLVTAAILVAVLYIAHHNKRKIIAFVLEGKRSKVTRRPKASDYQRLDQKS

SEQ ID NO: 4660 - protein, 761 aa, unidentified
MPNFCAAPNCTRKSTQSDLAFFRFPRDPARCQKWVENCRRADLEDKTPDQLNKHYRLCAKHFETSMICRTSPYRTVLRDNAIPTIFDLTSHLNNPHSRHRKRIKELSEDEIRTLKQKKIDETSEQEQKHKETNNSNAQNPSEEEGEGQDEDILPLTLEEKENKEYLKSLFEILILMGKQNIPLDGHEADEIPEGLFTPDNFQALLECRINSGEEVLRKRFETTAVNTLFCSKTQQRQMLEICESCIREETLREVRDSHFFSIITDDVVDIAGEEHLPVLVRFVDESHNLREEFIGFLPYEADAEILAVKFHTMITEKWGLNMEYCRGQAYIVSSGFSSKMKVVASRLLEKYPQAIYTLCSSCALNMWLAKSVPVMGVSVALGTIEEVCSFFHRSPQLLLELDNVISVLFQNSKERGKELKEICHSQWTGRHDAFEILVELLQALVLCLDGINSDTNIRWNNYIAGRAFVLCSAVSDFDFIVTIVVLKNVLSFTRAFGKNLQGQTSDVFFAAGSLTAVLHSLNEVMENIEVYHEFWFEEATNLATKLDIQMKLPGKFRRAHQGNLESQLTSESYYKETLSVPTVEHIIQELKDIFSEQHLKALKCLSLVPSVMGQLKFNTSEEHHADMYRSDLPNPDTLSAELHCWRIKWKHRGKDIELPSTIYEALHLPDIKFFPNVYALLKVLCILPVMKVENERYENGRKRLKAYLRNTLTDQRSSNLALLNINFDIKHDLDLMVDTYIKLYTSKSELPTDNSETVENT

SEQ ID NO: 4661 - protein, 577 aa, unidentified
MVICCAAVNCSNRQGKGEKRAVSFHRFPLKDSKRLIQWLKAVQRDNWTPTKYSFLCSEHFTKDSFSKRLEDQHRLLKPTAVPSIFHLTEKKRGAGGHGRTRRKDASKATGGVRGHSSAATSRGAAGWSPSSSGNPMAKPESRRLKQAALQGEATPRAAQEAASQEQAQQALERTPGDGLATMVAGSQGKAEASATDAGDESATSSIEGGVTDKSGISMDDFTPPGSGACKFIGSLHSYSFSSKHTRERPSVPREPIDRKRLKKDVEPSCSGSSLGPDKGLAQSPPSSSLTATPQKPSQSPSAPPADVTPKPATEAVQSEHSDASPMSINEVILSASGACKLIDSLHSYCFSSRQNKSQVCCLREQVEKKNGELKSLRQRVSRSDSQVRKLQEKLDELRRVSVPYPSSLLSPSREPPKMNPVVEPLSWMLGTWLSDPPGAGTYPTLQPFQYLEEVHISHVGQPMLNFSFNSFHPDTRKPMHRECGFIRLKPDTNKVAFVSAQNTGVVEVEEGEVNGQELCIASHSIARISFAKEPHVEQITRKFRLNSEGKLEQTVSMATTTQPMTQHLHVTYKKVTP

SEQ ID NO: 4662 - protein, 575 aa, unidentified
MLGVLVLGALALAGLGFPAPAEPQPGGSQCVEHDCFALYPGPATFLNASQICDGLRGHLMTVRSSVAADVISLLLNGDGGVGRRRLWIGLQLPPGCGDPKRLGPLRGFQWVTGDNNTSYSRWARLDLNGAPLCGPLCVAVSAAEATVPSEPIWEEQQCEVKADGFLCEFHFPATCRPLAVEPGAAAAAVSITYGTPFAARGADFQALPVGSSAAVAPLGLQLMCTAPPGAVQGHWAREAPGAWDCSVENGGCEHACNAIPGAPRCQCPAGAALQADGRSCTASATQSCNDLCEHFCVPNPDQPGSYSCMCETGYRLAADQHRCEDVDDCILEPSPCPQRCVNTQGGFECHCYPNYDLVDGECVEPVDPCFRANCEYQCQPLNQTSYLCVCAEGFAPIPHEPHRCQMFCNQTACPADCDPNTQASCECPEGYILDDGFICTDIDECENGGFCSGVCHNLPGTFECICGPDSALARHIGTDCDSGKVDGGDSGSGEPPPSPTPGSTLTPPAVGLVHSGLLIGISIASLCLVVALLALLCHLRKKQGAARAKMEYKCAAPSKEVVLQHVRTERTPQRL

SEQ ID NO: 4663 - protein, 657 aa, unidentified
MSPTPPLFSLPEARTRFTKSTREALNNKNIKPLLSTFSQVPGSENEKKCTLDQAFRGILEEEIINHSSCENVLAIISLAIGGVTEGICTASTPFVLLGDVLDCLPLDQCDTIFTFVEKNVATWKSNTFYSAGKNYLLRMCNDLLRRLSKSQNTVFCGRIQLFLARLFPLSEKSGLNLQSQFNLENVTVFNTNEQESTLGQKHTEDREEGMDVEEGEMGDEEAPTTCSIPIDYNLYRKFWSLQDYFRNPVQCYEKISWKTFLKYSEEVLAVFKSYKLDDTQASRKKMEELKTGGEHVYFAKFLTSEKLMDLQLSDSNFRRHILLQYLILFQYLKGQVKFKSSNYVLTDEQSLWIEDTTKSVYQLLSENPPDGERFSKMVEHILNTEENWNSWKNEGCPSFVKERTSDTKPTRIIRKRTAPEDFLGKGPTKKILMGNEELTRLWNLCPDNMEACKSETREHMPTLEEFFEEAIEQADPENMVENEYKAVNNSNYGWRALRLLARRSPHFFQPTNQQFKSLPEYLENMVIKLAKELPPPSEEIKTGEDEDEEDNDALLKENESPDVRRDKPVTGEQIEVFANKLGEQWKILAPYLEMKDSEIRQIECDSEDMKMRAKQLLVAWQDQEGVHATPENLINALNKSGLSDLAESLTNDNETNS

SEQ ID NO: 4664 - protein, 852 aa, unidentified
MKPMLKDFSNLLLVVLCDYVLGEAEYLLLREPGHVALSNDTVYVDFQYFDGANGTLRNVSVLLLEANTNQTVTTKYLLTNQSQGTLKFECFYFKEAGDYWFTMTPEATDNSTPFPWWEKSAFLKVEWPVFHVDLNRSAKAAEGTFQVGLFTSQPLCPFPVDKPNIVVDVIFTNSLPEARRNSRQPLEIRTSKRTELAQGQWVEFGCAPLGPEAYVTVVLKLLGRDSVITSTGPIDLAQKFGYKLVMVPELTCESGVEVTVLPPPCTFVQGVVTVFKEAPRYPGKRTIHLAENSLPLGERRTIFNCTLFDMGKNKYCFDFGISSRSHFSAKEECMLIQRNTETWGLWQPWSQCSATCGDGVRERRRVCLTSFPSSPVCPGMSLEASLCSLEECAAFQPSSPSPLQPQGPVKSNNIVTVTGISLCLFIIIATVLITLWRRFGRPAKCSTPARHNSIHSPSFRKNSDEENICELSEQRGSFSDGGDGPTGSPGDTGIPLTYRRSGPVPPEDDASGSESFQSNAQKIIPPLFSYRLAQQQLKEMKKKGLTETTKVYHVSQSPLTDTAIDAAPSAPLDLESPEEAAANKFRIKSPFPEQPAVSAGERPPSRLDLNVTQASCAISPSQTLIRKSQARHVGSRGGPSERSHARNAHFRRTASFHEARQARPFRERSMSTLTPRQAPAYSSRTRTCEQAEDRFRPQSRGAHLFPEKLEHFQEASGTRGPLNPLPKSYTLGQPLRKPDLGDHQAGLVAGIERTEPHRARRGPSPSHKSVSRKQSSPISPKDNYQRVSSLSPSQCRKDKCQSFPTHPEFAFYDNTSFGLTEAEQRMLDLPGYFGSNEEDETTSTLSVEKLVI

SEQ ID NO: 4665 - protein, 1018 aa, unidentified
MVSHFMGSLSVLCFLLLLGFQFVCPQPSTQHRKVPQRMAAEGAPEDDGGGGAPGVWGAWGPWSACSRSCSGGVMEQTRPCLPRSYRLRGGQRPGAPARAFADHVVSAVRTSVPLHRSRDETPALAGTDASRQGPTVLRGSRHPQPQGLEVTGDRRSRTRGTIGPGKYGYGKAPYILPLQTDTAHTPQRLRRQKLSSRHSRSQGASSARHGYSSPAHQVPQHGPLYQSDSGPRSGLQAAEAPIYQLPLTHDQGYPAASSLFHSPETSNNHGVGTHGATQSFSQPARSTAISCIGAYRQYKLCNTNVCPESSRSIREVQCASYNNKPFMGRFYEWEPFAEVKGNRKCELNCQAMGYRFYVRQAEKVIDGTPCDQNGTAICVSGQCKSIGCDDYLGSDKVVDKCGVCGGDNTGCQVVSGVFKHALTSLGYHRVVEIPEGATKINITEMYKSNNYLALRSRSGRSIINGNWAIDRPGKYEGGGTMFTYKRPNEISSTAGESFLAEGPTNEILDVYMIHQQPNPGVHYEYVIMGTNAISPQVPPHRRPGEPFNGQMVTEGRSQEEGEQKGRNEEKEDLRGEAPEMFTSESAQTFPVRHPDRFSPHRPDNLVPPAPQPPRRSRDHNWKQLGTTECSTTCGKGSQYPIFRCVHRSTHEEAPESYCDSSMKPTPEEEPCNIFPCPAFWDIGEWSECSKTCGLGMQHRQVLCRQVYANRSLTVQPYRCQHLEKPETTSTCQLKICSEWQIRTDWTSCSVPCGVGQRTRDVKCVSNIGDVVDDEECNMKLRPNDIENCDMGPCAKSWFLTEWSERCSAECGAGVRTRSVVCMTNHVSSLPLEGCGNNRPAEATPCDNGPCTGKVEWFAGSWSQCSIECGSGTQQREVICVRKNADTFEVLDPSECSFLEKPPSQQSCHLKPCGAKWFSTEWSMCSKSCQGGFRVREVRCLSDDMTLSNLCDPQLKPEERESCNPQDCVPEVDENCKDKYYNCNVVVQARLCVYNYYKTACCASCTRVANRQTGFLGSR

SEQ ID NO: 4666 - protein, 1657 aa, unidentified
MGLQARRWASGSRGAAGPRRGVLQLLPLPLPLPLLLLLLLRPGAGRAAAQGEAEAPTLYLWKTGPWGRCMGDECGPGGIQTRAVWCAHVEGWTTLHTNCKQAERPNNQQNCFKVCDWHKELYDWRLGPWNQCQPVISKSLEKPLECIKGEEGIQVREIACIQKDKDIPAEDIICEYFEPKPLLEQACLIPCQQDCIVSEFSAWSECSKTCGSGLQHRTRHVVAPPQFGGSGCPNLTEFQVCQSSPCEAEELRYSLHVGPWSTCSMPHSRQVRQARRRGKNKEREKDRSKGVKDPEARELIKKKRNRNRQNRQENKYWDIQIGYQTREVMCINKTGKAADLSFCQQEKLPMTFQSCVITKECQVSEWSEWSPCSKTCHDMVSPAGTRVRTRTIRQFPIGSEKECPEFEEKEPCLSQGDGVVPCATYGWRTTEWTECRVDPLLSQQDKRRGNQTALCGGGIQTREVYCVQANENLLSQLSTHKNKEASKPMDLKLCTGPIPNTTQLCHIPCPTECEVSPWSAWGPCTYENCNDQQGKKGFKLRKRRITNEPTGGSGVTGNCPHLLEAIPCEEPACYDWKAVRLGNCEPDNGKECGPGTQVQEVVCINSDGEEVDRQLCRDAIFPIPVACDAPCPKDCVLSTWSTWSSCSHTCSGKTTEGKQIRARSILAYAGEEGGIRCPNSSALQEVRSCNEHPCTVYHWQTGPWGQCIEDTSVSSFNTTTTWNGEASCSVGMQTRKVICVRVNVGQVGPKKCPESLRPETVRPCLLPCKKDCIVTPYSDWTSCPSSCKEGDSSIRKQSRHRVIIQLPANGGRDCTDPLYEEKACEAPQACQSYRWKTHKWRRCQLVPWSVQQDSPGAQEGCGPGRQARAITCRKQDGGQAGIHECLQYAGPVPALTQACQIPCQDDCQLTSWSKFSSCNGDCGAVRTRKRTLVGKSKKKEKCKNSHLYPLIETQYCPCDKYNAQPVGNWSDCILPEGKVEVLLGMKVQGDIKECGQGYRYQAMACYDQNGRLVETSRCNSHGYIEEACIIPCPSDCKLSEWSNWSRCSKSCGSGVKVRSKWLREKPYNGGRPCPKLDHVNQAQVYEVVPCHSDCNQYLWVTEPWSICKVTFVNMRENCGEGVQTRKVRCMQNTADGPSEHVEDYLCDPEEMPLGSRVCKLPCPEDCVISEWGPWTQCVLPCNQSSFRQRSADPIRQPADEGRSCPNAVEKEPCNLNKNCYHYDYNVTDWSTCQLSEKAVCGNGIKTRMLDCVRSDGKSVDLKYCEALGLEKNWQMNTSCMVECPVNCQLSDWSPWSECSQTCGLTGKMIRRRTVTQPFQGDGRPCPSLMDQSKPCPVKPCYRWQYGQWSPCQVQEAQCGEGTRTRNISCVVSDGSADDFSKVVDEEFCADIELIIDGNKNMVLEESCSQPCPGDCYLKDWSSWSLCQLTCVNGEDLGFGGIQVRSRPVIIQELENQHLCPEQMLETKSCYDGQCYEYKWMASAWKGSSRTVWCQRSDGINVTGGCLVMSQPDADRSCNPPCSQPHSYCSETKTCHCEEGYTEVMSSNSTLEQCTLIPVVVLPTMEDKRGDVKTSRAVHPTQPSSNPAGRGRTWFLQPFGPDGRLKTWVYGVAAGAFVLLIFIVSMIYLACKKPKKPQRRQNNRLKPLTLAYDGDADM

SEQ ID NO: 4667 - protein, 161 aa, unidentified
MNLAISIALLLTVLQVSRGQKVTSLTACLVDQSLRLDCRHENTSSSPIQYEFSLTRETKKHVLFGTVGVPEHTYRSRTNFTSKYNMKVLYLSAFTSKDEGTYTCALHHSGHSPPISSQNVTVLRDKLVKCEGISLLAQNTSWLLLLLLSLSLLQATDFMSL

SEQ ID NO: 4668 - protein, 1138 aa, unidentified
MVWRVPPFLLPILFLASHVGAAVDLTLLANLRLTDPQRFFLTCVSGEAGAGRGSDAWGPPLLLEKDDRIVRTPPGPPLRLARNGSHQVTLRGFSKPSDLVGVFSCVGGAGARRTRVIYVHNSPGAHLLPDKVTHTVNKGDTAVLSARVHKEKQTDVIWKSNGSYFYTLDWHEAQDGRFLLQLPNVQPPSSGIYSATYLEASPLGSAFFRLIVRGCGAGRWGPGCTKECPGCLHGGVCHDHDGECVCPPGFTGTRCEQACREGRFGQSCQEQCPGISGCRGLTFCLPDPYGCSCGSGWRGSQCQEACAPGHFGADCRLQCQCQNGGTCDRFSGCVCPSGWHGVHCEKSDRIPQILNMASELEFNLETMPRINCAAAGNPFPVRGSIELRKPDGTVLLSTKAIVEPEKTTAEFEVPRLVLADSGFWECRVSTSGGQDSRRFKVNVKVPPVPLAAPRLLTKQSRQLVVSPLVSFSGDGPISTVRLHYRPQDSTMDWSTIVVDPSENVTLMNLRPKTGYSVRVQLSRPGEGGEGAWGPPTLMTTDCPEPLLQPWLEGWHVEGTDRLRVSWSLPLVPGPLVGDGFLLRLWDGTRGQERRENVSSPQARTALLTGLTPGTHYQLDVQLYHCTLLGPASPPAHVLLPPSGPPAPRHLHAQALSDSEIQLTWKHPEALPGPISKYVVEVQVAGGAGDPLWIDVDRPEETSTIIRGLNASTRYLFRMRASIQGLGDWSNTVEESTLGNGLQAEGPVQESRAAEEGLDQQLILAVVGSVSATCLTILAALLTLVCIRRSCLHRRRTFTYQSGSGEETILQFSSGTLTLTRRPKLQPEPLSYPVLEWEDITFEDLIGEGNFGQVIRAMIKKDGLKMNAAIKMLKEYASENDHRDFAGELEVLCKLGHHPNIINLLGACKNRGYLYIAIEYAPYGNLLDFLRKSRVLETDPAFAREHGTASTLSSRQLLRFASDAANGMQYLSEKQFIHRDLAARNVLVGENLASKIADFGLSRGEEVYVKKTMGRLPVRWMAIESLNYSVYTTKSDVWSFGVLLWEIVSLGGTPYCGMTCAELYEKLPQGYRMEQPRNCDDEVYELMRQCWRDRPYERPPFAQIALQLGRMLEARKAYVNMSLFENFTYAGIDATAEEA

SEQ ID NO: 4669 - protein, 244 aa, unidentified
MRWCLLLIWAQGLRQAPLASGMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 4670 - protein, 378 aa, unidentified
MSKEPLILWLMIEFWWLYLTPVTSETVVTEVLGHRVTLPCLYSSWSHNSNSMCWGKDQCPYSGCKEALIRTDGMRVTSRKSAKYRLQGTIPRGDVSLTILNPSESDSGVYCCRIEVPGWFNDVKINVRLNLQRASTTTHRTATTTTRRTTTTSPTTTRQMTTTPAALPTTVVTTPDLTTGTPLQMTTIAVFTTANTCLSLTPSTLPEEATGLLTPEPSKEGPILTAESETVLPSDSWSSVESTSADTVLLTSKESKVWDLPSTSHVSMWKTSDSVSSPQPGASDTAVPEQNKTTKTGQMDGIPMSMKNEMPISQLLMIIAPSLGFVLFALFVAFLLRGKLMETYCSQKHTRLDYIGDSKNVLNDVQHGREDEDGLFTL

SEQ ID NO: 4671 - protein, 171 aa, unidentified
MEEYAREPCPWRIVDDCGGAFTMGTIGGGIFQAIKGFRNSPVGVNHRLRGSLTAIKTRAPQLGGSFAVWGGLFSMIDCSMVQVRGKEDPWNSITSGALTGAILAARNGPVAMVGSAAMGGILLALIEGAGILLTRFASAQFPNGPQFAEDPSQLPSTQLPSSPFGDYRQYQ

SEQ ID NO: 4672 - protein, 172 aa, unidentified
MEEYAREPCPWRIVDDCGGAFTMGVIGGGVFQAIKGFRNAPVGIRHRLRGSANAVRIRAPQIGGSFAVWGGLFSTIDCGLVRLRGKEDPWNSITSGALTGAVLAARSGPLAMVGSAMMGGILLALIEGVGILLTRYTAQQFRNAPPFLEDPSQLPPKDGTPAPGYPSYQQYH

SEQ ID NO: 4673 - protein, 248 aa, unidentified
MICTFLRAVQYTEKLHRSSAKRLLLPYIVLNKACLKTEPSLRCGLQYQKKTLRPRCILGVTQKTIWTQGPSPRKAKEDGSKQVSVHRSQRGGTAVPTSQKVKEAGRDFTYLIVVLFGISITGGLFYTIFKELFSSSSPSKIYGRALEKCRSHPEVIGVFGESVKGYGEVTRRGRRQHVRFTEYVKDGLKHTCVKFYIEGSEPGKQGTVYAQVKENPGSGEYDFRYIFVEIESYPRRTIIIEDNRSQDD

SEQ ID NO: 4674 - protein, 194 aa, unidentified
MAAAAPNAGGSAPETAGSAEAPLQYSLLLQYLVGDKRQPRLLEPGSLGGIPSPAKSEEQKMIEKAMESCAFKAALACVGGFVLGGAFGVFTAGIDTNVGFDPKDPYRTPTAKEVLKDMGQRGMSYAKNFAIVGAMFSCTECLIESYRGTSDWKNSVISGCITGGAIGFRAGLKAGAIGCGGFAAFSAAIDYYLR

SEQ ID NO: 4675 - protein, 353 aa, unidentified
MAASAAVFSRLRSGLRLGSRGLCTRLATPPRRAPDQAAEIGSRGSTKAQGPQQQPGSEGPSYAKKVALWLAGLLGAGGTVSVVYIFGNNPVDENGAKIPDEFDNDPILVQQLRRTYKYFKDYRQMIIEPTSPCLLPDPLQEPYYQPPYTLVLELTGVLLHPEWSLATGWRFKKRPGIETLFQQLAPLYEIVIFTSETGMTAFPLIDSVDPHGFISYRLFRDATRYMDGHHVKDISCLNRDPARVVVVDCKKEAFRLQPYNGVALRPWDGNSDDRVLLDLSAFLKTIALNGVEDVRTVLEHYALEDDPLAAFKQRQSRLEQEEQQRLAELSKSNKQNLFLGSLTSRLWPRSKQP

SEQ ID NO: 4676 - protein, 285 aa, unidentified
MEVPPPAPRSFLCRALCLFPRVFAAEAVTADSEVLEERQKRLPYVPEPYYPESGWDRLRELFGKDEQQRISKDLANICKTAATAGIIGWVYGGIPAFIHAKQQYIEQSQAEIYHNRFDAVQSAHRAATRGFIRYGWRWGWRTAVFVTIFNTVNTSLNVYRNKDALSHFVIAGAVTGSLFRINVGLRGLVAGGIIGALLGTPVGGLLMAFQKYSGETVQERKQKDRKALHELKLEEWKGRLQVTEHLPEKIESSLQEDEPENDAKKIEALLNLPRNPSVIDKQDKD

SEQ ID NO: 4677 - protein, 264 aa, unidentified
MAPTGLLVAGASFLAFRGLHWGLRRLPTPESAARDRWQWWNLCVSLAHSLLSGTGALLGLSLYPQMAADPIHGHPRWALVLVAVSVGYFLADGADLLWNQTLGKTWDLLCHHLVVVSCLSTAVLSGHYVGFSMVSLLLELNSACLHLRKLLLLSRQAPSLAFSVTSWASLATLALFRLVPLGWMSLWLFRQHHQVPLALVTLGGIGLVTVGIMSIILGIRILVNDVLQSRPHPPSPGHEKTRGTRTRRDNGPVTSNSSTLSLKD

SEQ ID NO: 4678 - protein, 786 aa, unidentified
MTSIFHFAIIFMLILQIRIQLSEESEFLVDRSKNGLIHVPKDLSQKTTILNISQNYISELWTSDILSLSKLRILIISHNRIQYLDISVFKFNQELEYLDLSHNKLVKISCHPTVNLKHLDLSFNAFDALPICKEFGNMSQLKFLGLSTTHLEKSSVLPIAHLNISKVLLVLGETYGEKEDPEGLQDFNTESLHIVFPTNKEFHFILDVSVKTVANLELSNIKCVLEDNKCSYFLSILAKLQTNPKLSNLTLNNIETTWNSFIRILQLVWHTTVWYFSISNVKLQGQLDFRDFDYSGTSLKALSIHQVVSDVFGFPQSYIYEIFSNMNIKNFTVSGTRMVHMLCPSKISPFLHLDFSNNLLTDTVFENCGHLTELETLILQMNQLKELSKIAEMTTQMKSLQQLDISQNSVSYDEKKGDCSWTKSLLSLNMSSNILTDTIFRCLPPRIKVLDLHSNKIKSIPKQVVKLEALQELNVAFNSLTDLPGCGSFSSLSVLIIDHNSVSHPSADFFQSCQKMRSIKAGDNPFQCTCELGEFVKNIDQVSSEVLEGWPDSYKCDYPESYRGTLLKDFHMSELSCNITLLIVTIVATMLVLAVTVTSLCSYLDLPWYLRMVCQWTQTRRRARNIPLEELQRNLQFHAFISYSGHDSFWVKNELLPNLEKEGMQICLHERNFVPGKSIVENIITCIEKSYKSIFVLSPNFVQSEWCHYELYFAHHNLFHEGSNSLILILLEPIPQYSIPSSYHKLKSLMARRTYLEWPKEKSKRGLFWANLRAAINIKLTEQAKK

SEQ ID NO: 4679 - protein, 811 aa, unidentified
MRLIRNIYIFCSIVMTAEGDAPELPEERELMTNCSNMSLRKVPADLTPATTTLDLSYNLLFQLQSSDFHSVSKLRVLILCHNRIQQLDLKTFEFNKELRYLDLSNNRLKSVTWYLLAGLRYLDLSFNDFDTMPICEEAGNMSHLEILGLSGAKIQKSDFQKIAHLHLNTVFLGFRTLPHYEEGSLPILNTTKLHIVLPMDTNFWVLLRDGIKTSKILEMTNIDGKSQFVSYEMQRNLSLENAKTSVLLLNKVDLLWDDLFLILQFVWHTSVEHFQIRNVTFGGKAYLDHNSFDYSNTVMRTIKLEHVHFRVFYIQQDKIYLLLTKMDIENLTISNAQMPHMLFPNYPTKFQYLNFANNILTDELFKRTIQLPHLKTLILNGNKLETLSLVSCFANNTPLEHLDLSQNLLQHKNDENCSWPETVVNMNLSYNKLSDSVFRCLPKSIQILDLNNNQIQTVPKETIHLMALRELNIAFNFLTDLPGCSHFSRLSVLNIEMNFILSPSLDFVQSCQEVKTLNAGRNPFRCTCELKNFIQLETYSEVMMVGWSDSYTCEYPLNLRGTRLKDVHLHELSCNTALLIVTIVVIMLVLGLAVAFCCLHFDLPWYLRMLGQCTQTWHRVRKTTQEQLKRNVRFHAFISYSEHDSLWVKNELIPNLEKEDGSILICLYESYFDPGKSISENIVSFIEKSYKSIFVLSPNFVQNEWCHYEFYFAHHNLFHENSDHIILILLEPIPFYCIPTRYHKLKALLEKKAYLEWPKDRRKCGLFWANLRAAINVNVLATREMYELQTFTELNEESRGSTISLMRTDCL

SEQ ID NO: 4680 - protein, 784 aa, unidentified
MPHTLWMVWVLGVIISLSKEESSNQASLSCDRNGICKGSSGSLNSIPSGLTEAVKSLDLSNNRITYISNSDLQRCVNLQALVLTSNGINTIEEDSFSSLGSLEHLDLSYNYLSNLSSSWFKPLSSLTFLNLLGNPYKTLGETSLFSHLTKLQILRVGNMDTFTKIQRKDFAGLTFLEELEIDASDLQSYEPKSLKSIQNVSHLILHMKQHILLLEIFVDVTSSVECLELRDTDLDTFHFSELSTGETNSLIKKFTFRNVKITDESLFQVMKLLNQISGLLELEFDDCTLNGVGNFRASDNDRVIDPGKVETLTIRRLHIPRFYLFYDLSTLYSLTERVKRITVENSKVFLVPCLLSQHLKSLEYLDLSENLMVEEYLKNSACEDAWPSLQTLILRQNHLASLEKTGETLLTLKNLTNIDISKNSFHSMPETCQWPEKMKYLNLSSTRIHSVTGCIPKTLEILDVSNNNLNLFSLNLPQLKELYISRNKLMTLPDASLLPMLLVLKISRNAITTFSKEQLDSFHTLKTLEAGGNNFICSCEFLSFTQEQQALAKVLIDWPANYLCDSPSHVRGQQVQDVRLSVSECHRTALVSGMCCALFLLILLTGVLCHRFHGLWYMKMMWAWLQAKRKPRKAPSRNICYDAFVSYSERDAYWVENLMVQELENFNPPFKLCLHKRDFIPGKWIIDNIIDSIEKSHKTVFVLSENFVKSEWCKYELDFSHFRLFDENNDAAILILLEPIEKKAIPQRFCKLRKIMNTKTYLEWPMDEAQREGFWVNLRAAIKS

SEQ ID NO: 4681 - protein, 904 aa, unidentified
MRQTLPCIYFWGGLLPFGMLCASSTTKCTVSHEVADCSHLKLTQVPDDLPTNITVLNLTHNQLRRLPAANFTRYSQLTSLDVGFNTISKLEPELCQKLPMLKVLNLQHNELSQLSDKTFAFCTNLTELHLMSNSIQKIKNNPFVKQKNLITLDLSHNGLSSTKLGTQVQLENLQELLLSNNKIQALKSEELDIFANSSLKKLELSSNQIKEFSPGCFHAIGRLFGLFLNNVQLGPSLTEKLCLELANTSIRNLSLSNSQLSTTSNTTFLGLKWTNLTMLDLSYNNLNVVGNDSFAWLPQLEYFFLEYNNIQHLFSHSLHGLFNVRYLNLKRSFTKQSISLASLPKIDDFSFQWLKCLEHLNMEDNDIPGIKSNMFTGLINLKYLSLSNSFTSLRTLTNETFVSLAHSPLHILNLTKNKISKIESDAFSWLGHLEVLDLGLNEIGQELTGQEWRGLENIFEIYLSYNKYLQLTRNSFALVPSLQRLMLRRVALKNVDSSPSPFQPLRNLTILDLSNNNIANINDDMLEGLEKLEILDLQHNNLARLWKHANPGGPIYFLKGLSHLHILNLESNGFDEIPVEVFKDLFELKIIDLGLNNLNTLPASVFNNQVSLKSLNLQKNLITSVEKKVFGPAFRNLTELDMRFNPFDCTCESIAWFVNWINETHTNIPELSSHYLCNTPPHYHGFPVRLFDTSSCKDSAPFELFFMINTSILLIFIFIVLLIHFEGWRISFYWNVSVHRVLGFKEIDRQTEQFEYAAYIIHAYKDKDWVWEHFSSMEKEDQSLKFCLEERDFEAGVFELEAIVNSIKRSRKIIFVITHHLLKDPLCKRFKVHHAVQQAIEQNLDSIILVFLEEIPDYKLNHALCLRRGMFKSHCILNWPVQKERIGAFRHKLQVALGSKNSVH

SEQ ID NO: 4682 - protein, 839 aa, unidentified
MMSASRLAGTLIPAMAFLSCVRPESWEPCVEVVPNITYQCMELNFYKIPDNLPFSTKNLDLSFNPLRHLGSYSFFSFPELQVLDLSRCEIQTIEDGAYQSLSHLSTLILTGNPIQSLALGAFSGLSSLQKLVAVETNLASLENFPIGHLKTLKELNVAHNLIQSFKLPEYFSNLTNLEHLDLSSNKIQSIYCTDLRVLHQMPLLNLSLDLSLNPMNFIQPGAFKEIRLHKLTLRNNFDSLNVMKTCIQGLAGLEVHRLVLGEFRNEGNLEKFDKSALEGLCNLTIEEFRLAYLDYYLDDIIDLFNCLTNVSSFSLVSVTIERVKDFSYNFGWQHLELVNCKFGQFPTLKLKSLKRLTFTSNKGGNAFSEVDLPSLEFLDLSRNGLSFKGCCSQSDFGTTSLKYLDLSFNGVITMSSNFLGLEQLEHLDFQHSNLKQMSEFSVFLSLRNLIYLDISHTHTRVAFNGIFNGLSSLEVLKMAGNSFQENFLPDIFTELRNLTFLDLSQCQLEQLSPTAFNSLSSLQVLNMSHNNFFSLDTFPYKCLNSLQVLDYSLNHIMTSKKQELQHFPSSLAFLNLTQNDFACTCEHQSFLQWIKDQRQLLVEVERMECATPSDKQGMPVLSLNITCQMNKTIIGVSVLSVLVVSVVAVLVYKFYFHLMLLAGCIKYGRGENIYDAFVIYSSQDEDWVRNELVKNLEEGVPPFQLCLHYRDFIPGVAIAANIIHEGFHKSRKVIVVVSQHFIQSRWCIFEYEIAQTWQFLSSRAGIIFIVLQKVEKTLLRQQVELYRLLSRNTYLEWEDSVLGRHIFWRRLRKALLDGKSWNPEGTVGTGCNWQEATSI

SEQ ID NO: 4683 - protein, 858 aa, unidentified [sequence omitted]

SEQ ID NO: 4684 - protein, 796 aa, unidentified
MTKDKEPIVKSFHFVCLMIIIVGTRIQFSDGNEFAVDKSKRGLIHVPKDLPLKTKVLDMSQNYIAELQVSDMSFLSELTVLRLSHNRIQLLDLSVFKFNQDLEYLDLSHNQLQKISCHPIVSFRHLDLSFNDFKALPICKEFGNLSQLNFLGLSAMKLQKLDLLPIAHLHLSYILLDLRNYYIKENETESLQILNAKTLHLVFHPTSLFAIQVNISVNTLGCLQLTNIKLNDDNCQVFIKFLSELTRGSTLLNFTLNHIETTWKCLVRVFQFLWPKPVEYLNIYNLTIIESIREEDFTYSKTTLKALTIEHITNQVFLFSQTALYTVFSEMNIMMLTISDTPFIHMLCPHAPSTFKFLNFTQNVFTDSIFEKCSTLVKLETLILQKNGLKDLFKVGLMTKDMPSLEILDVSWNSLESGRHKENCTWVESIVVLNLSSNMLTDSVFRCLPPRIKVLDLHSNKIKSVPKQVVKLEALQELNVAFNSLTDLPGCGSFSSLSVLIIDHNSVSHPSADFFQSCQKMRSIKAGDNPFQCTCELREFVKNIDQVSSEVLEGWPDSYKCDYPESYRGSPLKDFHMSELSCNITLLIVTIGATMLVLAVTVTSLCIYLDLPWYLRMVCQWTQTRRRARNIPLEELQRNLQFHAFISYSEHDSAWVKSELVPYLEKEDIQICLHERNFVPGKSIVENIINCIEKSYKSIFVLSPNFVQSEWCHYELYFAHHNLFHEGSNNLILILLEPIPQNSIPNKYHKLKALMTQRTYLQWPKEKSKRGLFWANIRAAFNMKLTLVTENNDVKS

SEQ ID NO: 4685 - protein, 1049 aa, unidentified
MVFPMWTLKRQILILFNIILISKLLGARWFPKTLPCDVTLDVPKNHVIVDCTDKHLTEIPGGIPTNTTNLTLTINHIPDISPASFHRLDHLVEIDFRCNCVPIPLGSKNNMCIKRLQIKPRSFSGLTYLKSLYLDGNQLLEIPQGLPPSLQLLSLEANNIFSIRKENLTELANIEILYLGQNCYYRNPCYVSYSIEKDAFLNLTKLKVLSLKDNNVTAVPTVLPSTLTELYLYNNMIAKIQEDDFNNLNQLQILDLSGNCPRCYNAPFPCAPCKNNSPLQIPVNAFDALTELKVLRLHSNSLQHVPPRWFKNINKLQELDLSQNFLAKEIGDAKFLHFLPSLIQLDLSFNFELQVYRASMNLSQAFSSLKSLKILRIRGYVFKELKSFNLSPLHNLQNLEVLDLGTNFIKIANLSMFKQFKRLKVIDLSVNKISPSGDSSEVGFCSNARTSVESYEPQVLEQLHYFRYDKYARSCRFKNKEASFMSVNESCYKYGQTLDLSKNSIFFVKSSDFQHLSFLKCLNLSGNLISQTLNGSEFQPLAELRYLDFSNNRLDLLHSTAFEELHKLEVLDISSNSHYFQSEGITHMLNFTKNLKVLQKLMMNDNDISSSTSRTMESESLRTLEFRGNHLDVLWREGDNRYLQLFKNLLKLEELDISKNSLSFLPSGVFDGMPPNLKNLSLAKNGLKSFSWKKLQCLKNLETLDLSHNQLTTVPERLSNCSRSLKNLILKNNQIRSLTKYFLQDAFQLRYLDLSSNKIQMIQKTSFPENVLNNLKMLLLHHNRFLCTCDAVWFVWWVNHTEVTIPYLATDVTCVGPGAHKGQSVISLDLYTCELDLTNLILFSLSISVSLFLMVMMTASHLYFWDVWYIYHFCKAKIKGYQRLISPDCCYDAFIVYDTKDPAVTEWVLAELVAKLEDPREKHFNLCLEERDWLPGQPVLENLSQSIQLSKKTVFVMTDKYAKTENFKIAFYLSHQRLMDEKVDVIILIFLEKPFQKSKFLQLRKRLCGSSVLEWPTNPQAHPYFWQCLKNALATDNHVAYSQVFKETV

SEQ ID NO: 4686 - protein, 1041 aa, unidentified
MENMFLQSSMLTCIFLLISGSCELCAEENFSRSYPCDEKKQNDSVIAECSNRRLQEVPQTVGKYVTELDLSDNFITHITNESFQGLQNLTKINLNHNPNVQHQNGNPGIQSNGLNITDGAFLNLKNLRELLLEDNQLPQIPSGLPESLTELSLIQNNIYNITKEGISRLINLKNLYLAWNCYFNKVCEKTNIEDGVFETLTNLELLSLSFNSLSHVPPKLPSSLRKLFLSNTQIKYISEEDFKGLINLTLLDLSGNCPRCFNAPFPCVPCDGGASINIDRFAFQNLTQLRYLNLSSTSLRKINAAWFKNMPHLKVLDLEFNYLVGEIASGAFLTMLPRLEILDLSFNYIKGSYPQHINISRNFSKLLSLRALHLRGYVFQELREDDFQPLMQLPNLSTINLGINFIKQIDFKLFQNFSNLEIIYLSENRISPLVKDTRQSYANSSSFQRHIRKRRSTDFEFDPHSNFYHFTRPLIKPQCAAYGKALDLSLNSIFFIGPNQFENLPDIACLNLSANSNAQVLSGTEFSAIPHVKYLDLTNNRLDFDNASALTELSDLEVLDLSYNSHYFRIAGVTHHLEFIQNFTNLKVLNLSHNNIYTLTDKYNLESKSLVELVFSGNRLDILWNDDDNRYISIFKGLKNLTRLDLSLNRLKHIPNEAFLNLPASLTELHINDNMLKFFNWTLLQQFPRLELLDLRGNKLLFLTDSLSDFTSSLRTLLLSHNRISHLPSGFLSEVSSLKHLDLSSNLLKTINKSALETKTTTKLSMLELHGNPFECTCDIGDFRRWMDEHLNVKIPRLVDVICASPGDQRGKSIVSLELTTCVSDVTAVILFFFTFFITTMVMLAALAHHLFYWDVWFIYNVCLAKVKGYRSLSTSQTFYDAYISYDTKDASVTDWVINELRYHLEESRDKNVLLCLEERDWDPGLAIIDNLMQSINQSKKTVFVLTKKYAKSWNFKTAFYLALQRLMDENMDVIIFILLEPVLQHSQYLRLRQRICKSSILQWPDNPKAEGLFWQTLRNVVLTENDSRYNNMYVDSIKQY

SEQ ID NO: 4687 - protein, 1032 aa, unidentified
MGFCRSALHPLSLLVQAIMLAMTLALGTLPAFLPCELQPHGLVNCNWLFLKSVPHFSMAAPRGNVTSLSLSSNRIHHLHDSDFAHLPSLRHLNLKWNCPPVGLSPMHFPCHMTIEPSTFLAVPTLEELNLSYNNIMTVPALPKSLISLSLSHTNILMLDSASLAGLHALRFLFMDGNCYYKNPCRQALEVAPGALLGLGNLTHLSLKYNNLTVVPRNLPSSLEYLLLSYNRIVKLAPEDLANLTALRVLDVGGNCRRCDHAPNPCMECPRHFPQLHPDTFSHLSRLEGLVLKDSSLSWLNASWFRGLGNLRVLDLSENFLYKCITKTKAFQGLTQLRKLNLSFNYQKRVSFAHLSLAPSFGSLVALKELDMHGIFFRSLDETTLRPLARLPMLQTLRLQMNFINQAQLGIFRAFPGLRYVDLSDNRISGASELTATMGEADGGEKVWLQPGDLAPAPVDTPSSEDFRPNCSTLNFTLDLSRNNLVTVQPEMFAQLSHLQCLRLSHNCISQAVNGSQFLPLTGLQVLDLSHNKLDLYHEHSFTELPRLEALDLSYNSQPFGMQGVGHNFSFVAHLRTLRHLSLAHNNIHSQVSQQLCSTSLRALDFSGNALGHMWAEGDLYLHFFQGLSGLIWLDLSQNRLHTLLPQTLRNLPKSLQVLRLRDNYLAFFKWWSLHFLPKLEVLDLAGNQLKALTNGSLPAGTRLRRLDVSCNSISFVAPGFFSKAKELRELNLSANALKTVDHSWFGPLASALQILDVSANPLHCACGAAFMDFLLEVQAAVPGLPSRVKCGSPGQLQGLSIFAQDLRLCLDEALSWDCFALSLLAVALGLGVPMLHHLCGWDLWYCFHLCLAWLPWRGRQSGRDEDALPYDAFVVFDKTQSAVADWVYNELRGQLEECRGRWALRLCLEERDWLPGKTLFENLWASVYGSRKTLFVLAHTDRVSGLLRASFLLAQQRLLEDRKDVVVLVILSPDGRRSRYVRLRQRLCRQSVLLWPHQPSGQRSFWAQLGMALTRDNHHFYNRNFCQGPTAE

SEQ ID NO: 4688 - protein, 207 aa, unidentified
MAAAWPSGPSAPEAVTARLVGVLWFVSVTTGPWGAVATSAGGEESLKCEDLKVGQYICKDPKINDATQEPVNCTNYTAHVSCFPAPNITCKDSSGNETHFTGNEVGFFKPISCRNVNGYSYKVAVALSLFLGWLGADRFYLGYPALGLLKFCTVGFCGIGSLIDFILISMQIVGPSDGSSYIIDYYGTRLTRLSITNETFRKTQLYP

SEQ ID NO: 4689 - protein, 214 aa, unidentified
MVLGGCPVSYLLLCGQAALLLGNLLLLHCVSRSHSQNATAEPELTSAGAAQPEGPGGAASWEYGDPHSPVILCSYLPDEFIECEDPVDHVGNATASQELGYGCLKFGGQAYSDVEHTSVQCHALDGIECASPRTFLRENKPCIKYTGHYFITTLLYSFFLGCFGVDRFCLGHTGTAVGKLLTLGGLGIWWFVDLILLITGGLMPSDGSNWCTVY

SEQ ID NO: 4690 - protein, 247 aa, unidentified
MAGGVLPLRGLRALCRVLLFLSQFCILSGGEQSQALAQSIKDPGPTRTFTVVPRAAESTEIPPYVMKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLGNRTFPKMLYCNWTGGYKWSTALALSITLGGFGADRFYLGQWREGLGKLFSFGGLGIWTLIDVLLIGVGYVGPADGSLYI

SEQ ID NO: 4691 - protein, 202 aa, unidentified
MCYGKCARCIGHSLVGLALLCIAANILLYFPNGETKYASENHLSRFVWFFSGIVGGGLLMLLPAFVFIGLEQDDCCGCCGHENCGKRCAMLSSVLAALIGIAGSGYCVIVAALGLAEGPLCLDSLGQWNYTFASTEGQYLLDTSTWSECTEPKHIVEWNVSLFSILLALGGIEFILCLIQVINGVLGGICGFCCSHQQQYDC

SEQ ID NO: 4692 - protein, 201 aa, unidentified
MGSRKCGGCLSCLLIPLALWSIIVNILLYFPNGQTSYASSNKLTNYVWYFEGICFSGIMMLIVTTVLLVLENNNNYKCCQSENCSKKYVTLLSIIFSSLGIAFSGYCLVISALGLVQGPYCRTLDGWEYAFEGTAGRFLTDSSIWIQCLEPAHVVEWNIILFSILITLSGLQVIICLIRVVMQLSKILCGSYSVIFQPGII

SEQ ID NO: 4693 - protein, 209 aa, unidentified
MVSSPCTQASSRTCSRILGLSLGTAALFAAGANVALLLPNWDVTYLLRGLLGRHAMLGTGLWGGGLMVLTAAILISLMGWRYGCFSKSGLCRSVLTALLSGGLALLGALICFVTSGVALKDGPFCMFDVSSFNQTQAWKYGYPFKDLHSRNYLYDRSLWNSVCLEPSAAVVWHVSLFSALLCISLLQLLLVVVHVINSLLGLFCSLCEK

SEQ ID NO: 4694 - protein, 229 aa, unidentified
MTCCEGWTSCNGFSLLVLLLLGVVLNAIPLIVSLVEEDQFSQNPISCFEWWFPGIIGAGLMAIPATTMSLTARKRACCNNRTGMFLSSLFSVITVIGALYCMLISIQALLKGPLMCNSPSNSNANCEFSLKNISDIHPESFNLQWFFNDSCAPPTGFNKPTSNDTMASGWRASSFHFDSEENKHRLIHFSVFLGLLLVGILEVLFGLSQIVIGFLGCLCGVSKRRSQIV

SEQ ID NO: 4695 - protein, 202 aa, unidentified
MCTGGCARCLGGTLIPLAFFGFLANILLFFPGGKVIDDNDHLSQEIWFFGGILGSGVLMIFPALVFLGLKNNDCCGCCGNEGCGKRFAMFTSTIFAVVGFLGAGYSFIISAISINKGPKCLMANSTWGYPFHDGDYLNDEALWNKCREPLNVVPWNLTLFSILLVVGGIQMVLCAIQVVNGLLGTLCGDCQCCGCCGGDGPV

SEQ ID NO: 4696 - protein, 197 aa, unidentified
MCTGKCARCVGLSLITLCLVCIVANALLLVPNGETSWTNTNHLSLQVWLMGGFIGGGLMVLCPGIAAVRAGGKGCCGAGCCGNRCRMLRSVFSSAFGVLGAIYCLSVSGAGLRNGPRCLMNGEWGYHFEDTAGAYLLNRTLWDRCEAPPRVVPWNVTLFSLLVAASCLEIVLCGIQLVNATIGVFCGDCRKKQDTPH

SEQ ID NO: 4697 - protein, 370 aa, unidentified
MSASAATGVFVLSLSAIPVTYVFNHLAAQHDSWTIVGVAALILFLVALLARVLVKRKPPRDPLFYVYAVFGFTSVVNLIIGLEQDGIIDGFMTHYLREGEPYLNTAYGHMICYWDGSAHYLMYLVMVAAIAWEETYRTIGLYWVGSIIMSVVVFVPGNIVGKYGTRICPAFFLSIPYTCLPVWAGFRIYNQPSENYNYPSKVIQEAQAKDLLRRPFDLMLVVCLLLATGFCLFRGLIALDCPSELCRLYTQFQEPYLKDPAAYPKIQMLAYMFYSVPYFVTALYGLVVPGCSWMPDITLIHAGGLAQAQFSHIGASLHARTAYVYRVPEEAKILFLALNIAYGVLPQLLAYRCIYKPEFFIKTKAEEKVE

SEQ ID NO: 4698 - protein, 377 aa, unidentified
MDIPPLAGKIAALSLSALPVSYALNHVSALSHPLWVALMSALILGLLFVAVYSLSHGEVSYDPLYAVFAVFAFTSVVDLIIALQEDSYVVGFMEFYTKEGEPYLRTAHGVFICYWDGTVHYLLYLAMAGAICRRKRYRNFGLYWLGSFAMSILVFLTGNILGKYSSEIRPAFFLTIPYLLVPCWAGMKVFSQPRALTRCTANMVQEEQRKGLLQRPADLALVIYLILAGFFTLFRGLVVLDCPTDACFVYIYQYEPYLRDPVAYPKVQMLMYMFYVLPFCGLAAYALTFPGCSWLPDWALVFAGGIGQAQFSHMGASMHLRTPFTYRVPEDTWGCFFVCNLLYALGPHLLAYRCLQWPAFFHQPPPSDPLALHKKQH

SEQ ID NO: 4699 - protein, 418 aa, unidentified
MAPTQGPRAPLEFGGPLGAAALLLLLPATMFHLLLAARSGPARLLGPPASLPGLEVLWSPRALLLWLAWLGLQAALYLLPARKVAEGQELKDKSRLRYPINGFQALVLTALLVGLGMSAGLPLGALPEMLLPLAFVATLTAFIFSLFLYMKAQVAPVSALAPGGNSGNPIYDFFLGRELNPRICFFDFKYFCELRPGLIGWVLINLALLMKEAELRGSPSLAMWLVNGFQLLYVGDALWHEEAVLTTMDITHDGFGFMLAFGDMAWVPFTYSLQAQFLLHHPQPLGLPMASVICLINATGYYIFRGANSQKNTFRKNPSDPRVAGLETISTATGRKLLVSGWWGMVRHPNYLGDLIMALAWSLPCGVSHLLPYFYLLYFTALLVHREARDERQCLQKYGLAWQEYCRRVPYRIMPYIY

SEQ ID NO: 4700 - protein, 570 aa, unidentified
MGFLQLLVVAVLASEHRVAGAAEVFGNSSEGLIEFSVGKFRYFELNRPFPEEAILHDISSNVTFLIFQIHSQYQNTTVSFSPTLLSNSSETGTASGLVFILRPEQSTCTWYLGTSGIQPVQNMAILLSYSERDPVPGGCNLEFDLDIDPNIYLEYNFFETTIKFAPANLGYARGVDPPPCDAGTDQDSRWRLQYDVYQYFLPENDLTEEMLLKHLQRMVSVPQVKASALKVVTLTANDKTSVSFSSLPGQGVIYNVIVWDPFLNTSAAYIPAHTYACSFEAGEGSCASLGRVSSKVFFTLFALLGFFICFFGHRFWKTELFFIGFIIMGFFFYILITRLTPIKYDVNLILTAVTGSVGGMFLVAVWWRFGILSICMLCVGLVLGFLISSVTFFTPLGNLKIFHDDGVFWVTFSCIAILIPVVFMGCLRILNILTCGVIGSYSVVLAIDSYWSTSLSYITLNVLKRALNKDFHRAFTNVPFQTNDFIILAVWGMLAVSGITLQIRRERGRPFFPPHPYKLWKQERERRVTNILDPSYHIPPLRERLYGRLTQIKGLFQKEQPAGERTPLLL

SEQ ID NO: 4701 - protein, 606 aa, unidentified
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVILMRVLRNDLARYNLDEETTSAGSGDDFDQGDNGWKIIHTDVFRFPPYRGLLCAVLGVGAQFLALGTGIIVMALLGMFNVHRHGAINSAAILLYALTCCISGYVSSHFYRQIGGERWVWNIILTTSLFSVPFFLTWSVVNSVHWANGSTQALPATTILLLLTVWLLVGFPLTVIGGIFGKNNASPFDAPCRTKNIAREIPPQPWYKSTVIHMTVGGFLPFSAISVELYYIFATVWGREQYTLYGILFFVFAILLSVGACISIALTYFQLSGEDYRWWWRSVLSVGSTGLFIFLYSVFYYARRSNMSGAVQTVEFFGYSLLTGYVFFLMLGTISFFSSLKFIRYIYVNLKMD

SEQ ID NO: 4702 - protein, 663 aa, unidentified
MSARLPVLSPPRWPRLLLLSLLLLGAVPGPRRSGAFYLPGLAPVNFCDEEKKSDECKAEIELFVNRLDSVESVLPYEYTAFDFCQASEGKRPSENLGQVLFGERIEPSPYKFTFNKKETCKLVCTKTYHTEKAEDKQKLEFLKKSMLLNYQHHWIVDNMPVTWCYDVEDGQRFCNPGFPIGCYITDKGHAKDACVISSDFHERDTFYIFNHVDIKIYYHVVETGSMGARLVAAKLEPKSFKHTHIDKPDCSGPPMDISNKASGEIKIAYTYSVSFEEDDKIRWASRWDYILESMPHTHIQWFSIMNSLVIVLFLSGMVAMIMLRTLHKDIARYNQMDSTEDAQEEFGWKLVHGDIFRPPRKGMLLSVFLGSGTQILIMTFVTLFFACLGFLSPANRGALMTCAVVLWVLLGTPAGYVAARFYKSFGGEKWKTNVLLTSFLCPGIVFADFFIMNLILWGEGSSAAIPFGTLVAILALWFCISVPLTFIGAYFGFKKNAIEHPVRTNQIPRQIPEQSFYTKPLPGIIMGGILPFGCIFIQLFFILNSIWSHQMYYMFGFLFLVFIILVITCSEATILLCYFHLCAEDYHWQWRSFLTSGFTAVYFLIYAVHYFFSKLQITGTASTILYFGYTMIMVLIFFLFTGTIGFFACFWFVTKIYSVVKVD

SEQ ID NO: 4703 - protein, 589 aa, unidentified
MRPLPGALGVAAAAALWLLLLLLPRTRADEHEHTYQDKEEVVLWMNTVGPYHNRQETYKYFSLPFCVGSKKSISHYHETLGEALQGVELEFSGLDIKFKDDVMPATYCEIDLDKEKRDAFVYAIKNHYWYQMYIDDLPIWGIVGEADENGEDYYLWTYKKLEIGFNGNRIVDVNLTSEGKVKLVPNTKIQMSYSVKWKKSDVKFEDRFDKYLDPSFFQHRIHWFSIFNSFMMVIFLVGLVSMILMRTLRKDYARYSKEEEMDDMDRDLGDEYGWKQVHGDVFRPSSHPLIFSSLIGSGCQIFAVSLIVIIVAMIEDLYTERGSMLSTAIFVYAATSPVNGYFGGSLYARQGGRRWIKQMFIGAFLIPAMVCGTAFFINFIAIYYHASRAIPFGTMVAVCCICFFVILPLNLVGTILGRNLSGQPNFPCRVNAVPRPIPEKKWFMEPAVIVCLGGILPFGSIFIEMYFIFTSFWAYKIYYVYGFMMLVLVILCIVTVCVTIVCTYFLLNAEDYRWQWTSFLSAASTAIYVYMYSFYYYFFKTKMYGLFQTSFYFGYMAVFSTALGIMCGAIGYMGTSAFVRKIYTNVKID

SEQ ID NO: 4704 - protein, 642 aa, unidentified
MATAMDWLPWSLLLFSLMCETSAFYVPGVAPINFHQNDPVEIKAVKLTSSRTQLPYEYYSLPFCQPSKITYKAENLGEVLRGDRIVNTPFQVLMNSEKKCEVLCSQSNKPVTLTVEQSRLVAERITEDYYVHLIADNLPVATRLELYSNRDSDDKKKEKDVQFEHGYRLGFTDVNKIYLHNHLSFILYYHREDMEEDQEHTYRVVRFEVIPQSIRLEDLKADEKSSCTLPEGTNSSPQEIDPTKENQLYFTYSVHWEESDIKWASRWDTYLTMSDVQIHWFSIINSVVVVFFLSGILSMIIIRTLRKDIANYNKEDDIEDTMEESGWKLVHGDVFRPPQYPMILSSLLGSGIQLFCMILIVIFVAMLGMLSPSSRGALMTTACFLFMFMGVFGGFSAGRLYRTLKGHRWKKGAFCTATLYPGVVFGICFVLNCFIWGKHSSGAVPFPTMVALLCMWFGISLPLVYLGYYFGFRKQPYDNPVRTNQIPRQIPEQRWYMNRFVGILMAGILPFGAMFIELFFIFSAIWENQFYYLFGFLFLVFIILVVSCSQISIVMVYFQLCAEDYRWWWRNFLVSGGSAFYVLVYAIFYFVNKLDIVEFIPSLLYFGYTALMVLSFWLLTGTIGFYAAYMFVRKIYAAVKID

SEQ ID NO: 4705 - protein, 311 aa, unidentified
MSNPSAPPPYEDRNPLYPGPPPPGGYGQPSVLPGGYPAYPGYPQPGYGHPAGYPQPMPPTHPMPMNYGPGHGYDGEERAVSDSFGPGEWDDRKVRHTFIRKVYSIISVQLLITVAIIAIFTFVEPVSAFVRRNVAVYYVSYAVFVVTYLILACCQGPRRRFPWNIILLTLFTFAMGFMTGTISSMYQTKAVIIAMIITAVVSISVTIFCFQTKVDFTSCTGLFCVLGIVLLVTGIVTSIVLYFQYVYWLHMLYAALGAICFTLFLAYDTQLVLGNRKHTISPEDYITGALQIYTDIIYIFTFVLQLMGDRN

SEQ ID NO: 4706 - protein, 238 aa, unidentified
MADPDPRYPRSSIEDDFNYGSSVASATVHIRMAFLRKVYSILSLQVLLTTVTSTVFLYFESVRTFVHESPALILLFALGSLGLIFALILNRHKYPLNLYLLFGFTLLEALTVAVVVTFYDVYIILQAFILTTTVFFGLTVYTLQSKKDFSKFGAGLFALLWILCLSGFLKFFFYSEIMELVLAAAGALLFCGFIIYDTHSLMHKLSPEEYVLAAISLYLDIINLFLHLLRFLEAVNKK

SEQ ID NO: 4707 - protein, 237 aa, unidentified
MNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTLSALYARRRSYLFLGGILMSALSLLLLSSLGNVFFGSIWLFQANLYVGLVVMCGFVLFDTQLIIEKAEHGDQDYIWHCIDLFLDFITVFRKLMMILAMNEKDKKKEKK

SEQ ID NO: 4708 - protein, 760 aa, unidentified
MSPKKVQIKVEEKEDETEESSSEEEEEVEDKLPRRESLRPKRKRTRDVINEDDPEPEPEDEETRKAREKERRRRLKRGAEEEEIDEEELERLKAELDEKRQIIATVKCKPWKMEKKIEVLKEAKKFVSENEGALGKGKGKRWFAFKMMMAKKWAKFLRDFENFKAACVPWENKIKAIESQFGSSVASYFLFLRWMYGVNMVLFILTFSLIMLPEYLWGLPYGSLPRKTVPRAEEASAANFGVLYDFNGLAQYSVLFYGYYDNKRTIGWMNFRLPLSYFLVGIMCIGYSFLVVLKAMTKNIGDDGGGDDNTFNFSWKVFTSWDYLIGNPETADNKFNSITMNFKEAITEEKAAQVEENVHLIRFLRFLANFFVFLTLGGSGYLIFWAVKRSQEFAQQDPDTLGWWEKNEMNMVMSLLGMFCPTLFDLFAELEDYHPLIALKWLLGRIFALLLGNLYVFILALMDEINNKIEEEKLVKANITLWEANMIKAYNASFSENSTGPPFFVHPADVPRGPCWETMVGQEFVRLTVSDVLTTYVTILIGDFLRACFVRFCNYCWCWDLEYGYPSYTEFDISGNVLALIFNQGMIWMGSFFAPSLPGINILRLHTSMYFQCWAVMCCNVPEARVFKASRSNNFYLGMLLLILFLSTMPVLYMIVSLPPSFDCGPFSGKNRMFEVIGETLEHDFPSWMAKILRQLSNPGLVIAVILVMVLAIYYLNATAKGQKAANLDLKKKMKMQALENKMRNKKMAAARAAAAAGRQ

SEQ ID NO: 4709 - protein, 906 aa, unidentified
MSHQVKGLKEEARGGVKGRVKSGSPHTGDRLGRRSSSKRALKAEGTPGRRGAQRSQKERAGGSPSPGSPRRKQTGRRRHREELGEQERGEAERTCEGRRKRDERASFQERTAAPKREKEIPRREEKSKRQKKPRSSSLASSASGGESLSEEELAQILEQVEEKKKLIATMRSKPWPMAKKLTELREAQEFVEKYEGALGKGKGKQLYAYKMLMAKKWVKFKRDFDNFKTQCIPWEMKIKDIESHFGSSVASYFIFLRWMYGVNLVLFGLIFGLVIIPEVLMGMPYGSIPRKTVPRAEEEKAMDFSVLWDFEGYIKYSALFYGYYNNQRTIGWLRYRLPMAYFMVGVSVFGYSLIIVIRSMASNTQGSTGEGESDNFTFSFKMFTSWDYLIGNSETADNKYASITTSFKESIVDEQESNKEENIHLTRFLRVLANFLIICCLCGSGYLIYFVVKRSQQFSKMQNVSWYERNEVEIVMSLLGMFCPPLFETIAALENYHPRTGLKWQLGRIFALFLGNLYTFLLALMDDVHLKLANEETIKNITHWTLFNYYNSSGWNESVPRPPLHPADVPRGSCWETAVGIEFMRLTVSDMLVTYITILLGDFLRACFVRFMNYCWCWDLEAGFPSYAEFDISGNVLGLIFNQGMIWMGSFYAPGLVGINVLRLLTSMYFQCWAVMSSNVPHERVFKASRSNNFYMGLLLLVLFLSLLPVAYTIMSLPPSFDCGPFSGKNRMYDVLQETIENDFPTFLGKIFAFLANPGLIIPAILLMFLAIYYLNSVSKSLSRANAQLRKKIQVLREVEKSHKSVKGKATARDSEDTPKSSSKNATQLQLTKEETTPPSASQSQAMDKKAQGPGTSNSASRTTLPASGHLPISRPPGIGPDSGHAPSQTHPWRSASGKSAQRPPH

SEQ ID NO: 4710 - protein, 1100 aa, unidentified
MKTSKASQRYRGIRRNASQCYLYQESLLLSNLDDSFSADETGDSNDPEQIFQNIQFQKDLMANIRCRPWTMGQKLRALRQAKNIVLKFEGRLTRTRGYQAAGAELWRKFARLACNFVVIFIPWEMRIKKIESHFGSGVASYFIFLRWLFGINIVLTIMTGAFIVIPELIAGQPFGSTARKTIPKEQVSSAQDLDTVWSLGGYLQYSVLFYGYYGRERKIGRAGYRLPLAYFLVGMAVFAYSFIILLKKMAKNSRTSLASASNENYTFCWRVFCAWDYLIGNPEAAESKTAAIVNSIREAILEEQEKKKSKNLAVTICLRIIANILVLLSLAGSIYLIYFVVDRSQKLEQSKKELTLWEKNEVSVVVSLVTMIAPSAFDLIAALEMYHPRTTLRFQLARVLVLYLGNLYSLIIALLDKVNSMSIEEMATKNNTSHWIDSTTFFATRTAPEEEKWSTSRPGMGLRRNNTWALEETSISAYTMPLIKANKTSLHTQSPQDQCWETYVGQEMLKLSIIDMLFTVASILLIDFFRGLFVRYLSDYWCWDLESKFPEYGEFKIAENVLHLVYNQGMIWMGAFFSPCLPAFNVLKLIGLMYLRSWAVLTCNVPHQQVFRASRSNNFYLAMLLFMLFLCMLPTIFAIVRYKPSLNCGPFSGQEKIYDIVSETIEKDFPVWFGSVVGHISSPVVILPAVLLLFMLIYYLQSIARSLKLSNHQLKMQIQNARSEDKKKVAQMVEARIQTQEESTKKLPNDSDLTSQLSSAHSGTPQNNGNVAHFDSGSSKSGRIETVAQSMPQSPRPGDRAPSSPLPGVPKSRLEHETNRYLHGLCASTSDLHRNRSRTPMTFTTHIEDVHSEPLFRKDFQQINPPHRGPQASTLLAQGPRPHAPRYYVINECDSYKKKHLNVWPERHFKIDASGDIVELYPRNVRQYASRVPRQPPSPQLSEEEEETPSRDWIKRSLPPRSLIDLRRAPHFYIGERSESQTRDPEHQGRVHYKSWNEDFEGHLERPAYVPRKPRSRNFQYPQPPLKPRGKPRFEPSLTESDSVSAASSSDQQNSSADQYLQVTHSQGRFPRSVGQPSRRKAKSGQELTVDLDDLICSDV

SEQ ID NO: 4711 - protein, 712 aa, unidentified
MEENPTLESEAWGSSRGWLAPREARGAPCSSPGPSLSSVLNELPSAATLRYRDPGVLPWGALEEEEEDGGRSRKAFTEVTQTELQDPHPSRELPWPMQARRAHRQRNASRDQVVYGSGTKTDRWARLLRRSKEKTKEGLRSLQPWAWTLKRIGGQFGAGTESYFSLLRFLLLLNVLASVLMACMTLLPTWLGGAPPGPPGPDISSPCGSYNPHSQGLVTFATQLFNLLSGEGYLEWSPLFYGFYPPRPRLAVTYLCWAFAVGLICLLLILHRSVSGLKQTLLAESEALTSYSHRVFSAWDFGLCGDVHVRLRQRIILYELKVELEETVVRRQAAVRTLGQQARVWLVRVLLNLLVVALLGAAFYGVYWATGCTVELQEMPLVQELPLLKLGVNYLPSIFIAGVNFVLPPVFKLIAPLEGYTRSRQIVFILLRTVFLRLASLVVLLFSLWNQITCGGDSEAEDCKTCGYNYKQLPCWETVLGQEMYKLLLFDLLTVLAVALLIQFPRKLLCGLCPGALGRLAGTQEFQVPDEVLGLIYAQTVVWVGSFFCPLLPLLNTVKFLLLFYLKKLTLFSTCSPAARTFRASAANFFFPLVLLLGLAISSVPLLYSIFLIPPSKLCGPFRGQSSIWAQIPESISSLPETTQNFLFFLGTQAFAVPLLLISSILMAYTVALANSYGRLISELKRQRQTEAQNKVFLARRAVALTSTKPAL

SEQ ID NO: 4712 - protein, 1006 aa, unidentified
MSAYYRNNWSEEDPDYPDYSGSQNRTQGYLKTQGYPDVPGPLNNPDYPGTRSNPYSVASRTRPDYPGSLAEPNYPRSLSNPDYSGTRSNAYSAASRTSPDHPTSLPEPDYSEFQSHPYHRASSRQPDYPGSQRNPDFAGSSSSGNYAGSRTHPDHFGSLEPDYPGAQSNSDHPGPRANLNHPGSRKNLEHTSFRINPYADSLGKPDYPGADIQPNSPPFFGEPDYPSAEDNQNLPSTWREPDYSDAENGHDYGSSETPKMTRGVLSRTSSIQPSFRHRSDDPVGSLWGENDYPEGIEMASMEMANSYGHSLPGAPGSGYVNPAYVGESGPVHAYGNPPLSECDWHKSPQGQKLIASLIPMTSRDRIKAIRNQPRTMEEKRNLRKIVDKEKSKQTHRILQLNCCIQCLNSISRAYRRSKNSLSEILNSISLWQKTLKIIGGKFGTSVLSYFNFLRWLLKFNIFSFILNFSFIIIPQFTVAKKNTLQFTGLEFFTGVGYFRDTVMYYGFYTNSTIQHGNSGASYNMQLAYIFTIGACLTTCFFSLLFSMAKYFRNNFINPHIYSGGITKLIFCWDFTVTHEKAVKLKQKNLSTEIRENLSELRQENSKLTFNQLLTRFSAYMVAWVVSTGVAIACCAAVYYLAEYNLEFLKTHSNPGAVLLLPFVVSCINLAVPCIYSMFRLVERYEMPRHEVYVLLIRNIFLKISIIGILCYYWLNTVALSGEECWETLIGQDIYRLLLMDFVFSLVNSFLGEFLRRIIGMQLITSLGLQEFDIARNVLELIYAQTLVWIGIFFCPLLPFIQMIMLFIMFYSKNISLMMNFQPPSKAWRASQMMTFFIFLLFFPSFTGVLCTLAITIWRLKPSADCGPFRGLPLFIHSIYSWIDTLSTRPGYLWVVWIYRNLIGSVHFFFILTLIVLIITYLYWQITEGRKIMIRLLHEQIINEGKDKMFLIEKLIKLQDMEKKANPSSLVLERREVEQQGFLHLGEHDGSLDLRSRRSVQEGNPRA

SEQ ID NO: 4713 - protein, 805 aa, unidentified
MAQPLAFILDVPETPGDQGQGPSPYDESEVHDSFQQLIQEQSQCTAQEGLELQQREREVTGSSQQTLWRPEGTQSTATLRILASMPSRTIGRSRGAIISQYYNRTVQLRCRSSRPLLGNFVRSAWPSLRLYDLELDPTALEEEEKQSLLVKELQSLAVAQRDHMLRGMPLSLAEKRSLREKSRTPRGKWRGQPGSGGVCSCCGRLRYACVLALHSLGLALLSALQALMPWRYALKRIGGQFGSSVLSYFLFLKTLLAFNALLLLLLVAFIMGPQVAFPPALPGPAPVCTGLELLTGAGCFTHTVMYYGHYSNATLNQPCGSPLDGSQCTPRVGGLPYNMPLAYLSTVGVSFFITCITLVYSMAHSFGESYRVGSTSGIHAITVFCSWDYKVTQKRASRLQQDNIRTRLKELLAEWQLRHSPRSVCGRLRQAAVLGLVWLLCLGTALGCAVAVHVFSEFMIQSPEAAGQEAVLLVLPLVVGLLNLGAPYLCRVLAALEPHDSPVLEVYVAICRNLILKLAILGTLCYHWLGRRVGVLQGQCWEDFVGQELYRFLVMDFVLMLLDTLFGELVWRIISEKKLKRRRKPEFDIARNVLELIYGQTLTWLGVLFSPLLPAVQIIKLLLVFYVKKTSLLANCQAPRRPWLASHMSTVFLTLLCFPAFLGAAVFLCYAVWQVKPSSTCGPFRTLDTMYEAGRVWVRHLEAAGPRVSWLPWVHRYLMENTFFVFLVSALLLAVIYLNIQVVRGQRKVICLLKEQISNEGEDKIFLINKLHSIYERKEREERSRVGTTEEAAAPPALLTDEQDA

SEQ ID NO: 4714 - protein, 723 aa, unidentified
MSESSGSALQPGRPSRQPAVHPENLSLDSSCFSSPPVNFLQELPSYRSIARRRTTVHSRDKQSGTLLKPTDSYSSQLEDRIAENLSSHSLRNYALNISEKRRLRDIQETQMKYLSEWDQWKRYSSKSWKRFLEKAREMTTHLELWREDIRSIEGKFGTGIQSYFSFLRFLVLLNLVIFLIIFMLVLLPVLLTKYKITNSSFVLIPFKDMDKQCTVYPVSSSGLIYFYSYIIDLLSGTGFLEETSLFYGHYTIDGVKFQNFTYDLPLAYLLSTIASLALSLLWIVKRSVEGFKINLIRSEEHFQSYCNKIFAGWDFCITNRSMADLKHSSLRYELRADLEEERMRQKIAERTSEETIRIYSLRLFLNCIVLAVLGACFYAIYVATVFSQEHMKKEIDKMVFGENLFILYLPSIVITLANFITPMIFAKIIRYEDYSPGFEIRLTILRCVFMRLATICVLVFTLGSKITSCDDDTCDLCGYNQKLYPCWETQVGQEMYKLMIFDFIIILAVTLFVDFPRKLLVTYCSSCKLIQCWGQQEFAIPDNVLGIVYGQTICWIGAFFSPLLPAIATLKFIIIFYVKEWSLLYTCRPSPRPFRASNSNFFFLLVLLIGLCLAIIPLTISISRIPSSKACGPFTNFNTTWEVIPKTVSTFPSSLQSFIHGVTSEAFAVPFFMIICLIMFYFIALAGAHKRVVIQLREQLSLESRDKCYLIQKLTEAQRDMRN

SEQ ID NO: 4715 - protein, 726 aa, unidentified
MLLPRSVSSERAPGVPEPEELWEAEMERLRGSGTPVRGLPYAMMDKRLIWQLREPAGVQTLRWQRWQRRRQTVERRLREAAQRLARGLGLWEGALYEIGGLFGTGIRSYFTFLRFLLLLNLLSLLLTASFVLLPLVWLRPPDPGPTLNLTLQCPGSRQSPPGVLRFHNQLWHVLTGRAFTNTYLFYGAYRVGPESSSVYSIRLAYLLSPLACLLLCFCGTLRRMVKGLPQKTLLGQGYQAPLSAKVFSSWDFCIRVQEAATIKKHEISNEFKVELEEGRRFQLMQQQTRAQTACRLLSYLRVNVLNGLLVVGAISAIFWATKYSQDNKEESLFLLLQYLPPGVIALVNFLGPLLFTFLVQLENYPPNTEVNLTLIWCVVLKLASLGMFSVSLGQTILCIGRDKSSCESYGYNVCDYQCWENSVGEELYKLSIFNFLLTVAFAFLVTLPRRLLVDRFSGRFWAWLEREEFLVPKNVLDIVAGQTVTWMGLFYCPLLPLLNSVFLFLTFYIKKYTLLKNSRASSRPFRASSSTFFFQLVLLLGLLLAAVPLGYVVSSIHSSWDCGLFTNYSAPWQVVPELVALGLPPIGQRALHYLGSHAFSFPLLIMLSLVLTVCVSQTQANARAIHRLRKQLVWQVQEKWHLVEDLSRLLPEPGPSDSPGPKYPASQASRPQSFCPGCPCPGSPGHQAPRPGPSVVDAAGLRSPCPGQHGAPASARRFRFPSGAEL

SEQ ID NO: 4716 - protein, 653 aa, unidentified
MEPSGSEQLFEDPDPGGKSQDAEARKQTESEQKLSKMTHNALENINVIGQGLKHLFQHQRRRSSVSPHDVQQIQADPEPEMDLESQNACAEIDGVPTHPTALNRVLQQIRVPPKMKRGTSLHSRRGKPEAPKGSPQINRKSGQEMTAVMQSGRPRSSSTTDAPTSSAMMEIACAAAAAAAACLPGEEGTAERIERLEVSSLAQTSSAVASSTDGSIHTDSVDGTPDPQRTKAAIAHLQQKILKLTEQIKIAQTARDDNVAEYLKLANSADKQQAARIKQVFEKKNQKSAQTILQLQKKLEHYHRKLREVEQNGIPRQPKDVFRDMHQGLKDVGAKVTGFSEGVVDSVKGGFSSFSQATHSAAGAVVSKPREIASLIRNKFGSADNIPNLKDSLEEGQVDDAGKALGVISNFQSSPKYGSEEDCSSATSGSVGANSTTGGIAVGASSSKTNTLDMQSSGFDALLHEIQEIRETQARLEESFETLKEHYQRDYSLIMQTLQEERYRCERLEEQLNDLTELHQNEILNLKQELASMEEKIAYQSYERARDIQEALEACQTRISKMELQQQQQQVVQLEGLENATARNLLGKLINILLAVMAVLLVFVSTVANCVVPLMKTRNRTFSTLFLVVFIAFLWKHWDALFSYVERFFSSPR

SEQ ID NO: 4717 - protein, 709 aa, unidentified
MKRCRSDELQQQQGEEDGAGLEDAASHLPGADLRPGETTGANSAGGPTSDAGAAAAPNPGPRSKPPDLKKIQQLSEGSMFGHGLKHLFHSRRRSREREHQTSQDSQQHQQQQGMSDHDSPDEKERSPEMHRVSYAMSLHDLPARPTAFNRVLQQIRSRPSIKRGASLHSSSGGGSSGSSSRRTKSSSLEPQRGSPHLLRKAPQDSSLAAILHQHQCRPRSSSTTDTALLLADGSNVYLLAEEAEGIGDKVDKGDLVALSLPAGHGDTDGPISLDVPDGAPDPQRTKAAIDHLHQKILKITEQIKIEQEARDDNVAEYLKLANNADKQQVSRIKQVFEKKNQKSAQTIAQLHKKLEHYRRRLKEIEQNGPSRQPKDVLRDMQQGLKDVGANVRAGISGFGGGVVEGVKGSLSGLSQATHTAVVSKPREFASLIRNKFGSADNIAHLKDPLEDGPPEEAARALSGSATLVSSPKYGSDDECSSASASSAGAGSNSGAGPGGALGSPKSNALYGAPGNLDALLEELREIKEGQSHLEDSMEDLKTQLQRDYTYMTQCLQEERYRYERLEEQLNDLTELHQNEMTNLKQELASMEEKVAYQSYERARDIQEAVESCLTRVTKLELQQQQQQVVQLEGVENANARALLGKFINVILALMAVLLVFVSTIANFITPLMKTRLRITSTTLLVLVLFLLWKHWDSLTYLLEHVLLPS

SEQ ID NO: 4718 - protein, 477 aa, unidentified
MPGSDTALTVDRTYSYPGRHHRCKSRVERHDMNTLSLPLNIRRGGSDTNLNFDVPDGILDFHKVKLTADSLKQKILKVTEQIKIEQTSRDGNVAEYLKLVNNADKQQAGRIKQVFEKKNQKSAHSIAQLQKKLEQYHRKLREIEQNGASRSSKDISKDHLKDIHRSLKDAHVKSRTAPHCMESSKSGMPGVSLTPPVFVFNKSREFANLIRNKFGSADNIAHLKNSLEEFRPEASARAYGGSATIVNKPKYGSDDECSSGTSGSADSNGNQSFGAGGASTLDSQGKLAVILEELREIKDTQAQLAEDIEALKVQFKREYGFISQTLQEERYRYERLEDQLHDLTDLHQHETANLKQELASIEEKVAYQAYERSRDIQEALESCQTRISKLELHQQEQQALQTDTVNAKVLLGRCINVILAFMTVILVCVSTIAKFVSPMMKSRCHILGTFFAVTLLAIFCKNWDHILCAIERMIIPR

SEQ ID NO: 4719 - protein, 239 aa, unidentified
MPRKRKCDLRAVRVGLLLGGGGVYGSRFRFTFPGCRALSPWRVRVQRRRCEMSTMFADTLLIVFISVCTALLAEGITWVLVYRTDKYKRLKAEVEKQSKKLEKKKETITESAGRQQKKKIERQEEKLKNNNRDLSMVRMKSMFAIGFCFTALMGMFNSIFDGRVVAKLPFTPLSYIQGLSHRNLLGDDTTDCSFIFLYILCTMSIRQNIQKILGLAPSRAATKQAGGFLGPPPPSGKFS

SEQ ID NO: 4720 - protein, 182 aa, unidentified
MSTSSSSSWDNLLESLSLSTVWNWIQASFLGETSAPQQTSLGLLDNLAPAVQIILRISFLILLGIGIYALWKRSIQSIQKTLLFVITLYKLYKKGSHIFEALLANPEGSGLRIQDNNNLFLSLGLQEKILKKLKTVENKMKNLEGIIVAQKPATKRDCSSEPYCSCSDCQSPLSTSGFTSPI

SEQ ID NO: 4721 - protein, 677 aa, unidentified
MKVLGRSFFWVLFPVLPWAVQAVEHEEVAQRVIKLHRGRGVAAMQSRQWVRDSCRKLSGLLRQKNAVLNKLKTAIGAVEKDVGLSDEEKLFQVHTFEIFQKELNESENSVFQAVYGLQRALQGDYKDVVNMKESSRQRLEALREAAIKEETEYMELLAAEKHQVEALKNMQHQNQSLSMLDEILEDVRKAADRLEEEIEEHAFDDNKSVKGVNFEAVLRVEEEEANSKQNITKREVEDDLGLSMLIDSQNNQYILTKPRDSTIPRADHHFIKDIVTIGMLSLPCGWLCTAIGLPTMFGYIICGVLLGPSGLNSIKSIVQVETLGEFGVFFTLFLVGLEFSPEKLRKVWKISLQGPCYMTLLMIAFGLLWGHLLRIKPTQSVFISTCLSLSSTPLVSRFLMGSARGDKEGDIDYSTVLLGMLVTQDVQLGLFMAVMPTLIQAGASASSSIVVEVLRILVLIGQILFSLAAVFLLCLVIKKYLIGPYYRKLHMESKGNKEILILGISAFIFLMLTVTELLDVSMELGCFLAGALVSSQGPVVTEEIATSIEPIRDFLAIVFFASIGLHVFPTFVAYELTVLVFLTLSVVVMKFLLAALVLSLILPRSSQYIKWIVSAGLAQVSEFSFVLGSRARRAGVISREVYLLILSVTTLSLLLAPVLWRAAITRCVPRPERRSSL

SEQ ID NO: 4722 - protein, 634 aa, unidentified
MAMWNRPCQRLPQQPLVAEPTAEGEPHLPTGRELTEANRFAYAALCGISLSQLFPEPEHSSFCTEFMAGLVQWLELSEAVLPTMTAFASGLGGEGADVFVQILLKDPILKDDPTVITQDLLSFSLKDGHYDARARVLVCHMTSLLQVPLEELDVLEEMFLESLKEIKEEESEMAEASRKKKENRRKWKRYLLIGLATVGGGTVIGVTGGLAAPLVAAGAATIIGSAGAAALGSAAGIAIMTSLFGAAGAGLTGYKMKKRVGAIEEFTFLPLTEGRQLHITIAVTGWLASGKYRTFSAPWAALAHSREQYCLAWEAKYLMELGNALETILSGLANMVAQEALKYTVLSGIVAALTWPASLLSVANVIDNPWGVCLHRSAEVGKHLAHILLSRQQGRRPVTLIGFSLGARVIYFCLQEMAQEKDCQGIIEDVILLGAPVEGEAKHWEPFRKVVSGRIINGYCRGDWLLSFVYRTSSVQLRVAGLQPVLLQDRRVENVDLTSVVSGHLDYAKQMDAILKAVGIRTKPGWDEKGLLLAPGCLPSEEPRQAAAAASSGETPHQVGQTQGPISGDTSKLAMSTDPSQAQVPVGLDQSEGASLPAAASPERPPICSHGMDPNPLGCPDCACKTQGPSTGLD

SEQ ID NO: 4723 - protein, 288 aa, unidentified
MEISRLAQSKRNIISLNMDLERDTQRIDEANQKLLLKIQEREDKIQRLESEIIQTRGLVEDEEWEKENRTTMERERALQELEEETARLERKNKTLVHSITELQQKLTRKSQKITNCEQSSPDGALEETKVKLQQLEASYACQEKELLKVMKEYAFVTQLCEDQALYIKKYQETLKKIEEELEALFLEREVSKLVSMNPVEKEHTSQNNEGTPTQKTARLFSKKIFCCLFFITLFFIRLLSYMFFHVRFINPDLLVNVLPKVLGRSTLWKLRCFFFPSLTLETEDMLPH

SEQ ID NO: 4724 - protein, 227 aa, unidentified
MMAAGAALALALWLLMPPVEVGGAGPPPIQDGEFTFLLPAGRKQCFYQSAPANASLETEYQVIGGAGLDVDFTLESPQGVLLVSESRKADGVHTVEPTEAGDYKLCFDNSFSTISEKLVFFELIFDSLQDDEEVEGWAEAVEPEEMLDVKMEDIKESIETMRTRLERSIQMLTLLRAFEARDRNLQEGNLERVNFWSAVNVAVLLLVAVLQVCTLKRFFQDKRPVPT

SEQ ID NO: 4725 - protein, 219 aa, unidentified
MSGLSGPPARRGPFPLALLLLFLLGPRLVLAISFHLPINSRKCLREEIHKDLLVTGAYEISDQSGGAGGLRSHLKITDSAGHILYSKEDATKGKFAFTTEDYDMFEVCFESKGTGRIPDQLVILDMKHGVEAKNYEEIAKVEKLKPLEVELRRLEDLSESIVNDFAYMKKREEEMRDTNESTNTRVLYFSIFSMFCLIGLATWQVFYLRRFFKAKKLIE

SEQ ID NO: 4726 - protein, 201 aa, unidentified
MVTLAELLVLLAALLATVSGYFVSIDAHAEECFFERVTSGTKMGLIFEVAEGGFLDIDVEITGPDNKGIYKGDRESSGKYTFAAHMDGTYKFCFSNRMSTMTPKIVMFTIDIGEAPKGQDMETEAHQNKLEEMINELAVAMTAVKHEQEYMEVRERIHRAINDNTNSRVVLWSFFEALVLVAMTLGQIYYLKRFFEVRRVV

SEQ ID NO: 4727 - protein, 217 aa, unidentified
MGSTVPRSASVLLLLLLLRRAEQPCGAELTFELPDNAKQCFHEEVEQGVKFSLDYQVITGGHYDVDCYVEDPQGNTIYRETKKQYDSFTYRAEVKGVYQFCFSNEFSTFSHKTVYFDFQVGDEPPILPDMGNRVTALTQMESACVTIHEALKTVIDSQTHYRLREAQDRARAEDLNSRVSYWSVGETIALFVVSFSQVLLLKSFFTEKRPISRAVHS

SEQ ID NO: 4728 - protein, 227 aa, unidentified
MAGVGAGPLRAMGRQALLLLALCATGAQGLYFHIGETEKRCFIEEIPDETMVIGNYRTQMWDKQKEVFLPSTPGLGMHVEVKDPDGKVVLSRQYGSEGRFTFTSHTPGDHQICLHSNSTRMALFAGGKLRVHLDIQVGEHANNYPEIAAKDKLTELQLRARQLLDQVEQIQKEQDYQRYREERFRLTSESTNQRVLWWSIAQTVILILTGIWQMRHLKSFFEAKKLV

SEQ ID NO: 4729 - protein, 229 aa, unidentified
MGDKIWLPFPVLLLAALPPVLLPGAAGFTPSLDSDFTFTLPAGQKECFYQPMPLKASLEIEYQVLDGAGLDIDFHLASPEGKTLVFEQRKSDGVHTVETEVGDYMFCFDNTFSTISEKVIFFELILDNMGEQAQEQEDWKKYITGTDILDMKLEDILESINSIKSRLSKSGHIQTLLRAFEARDRNIQESNFDRVNFWSMVNLVVMVVVSAIQVYMLKSLFEDKRKSRT

SEQ ID NO: 4730 - protein, 240 aa, unidentified
MSPLLFGAGLVVLNLVTSARSQKTEPLSGSGDQPLFRGADRYDFAIMIPPGGTECFWQFAHQTGYFYFSYEVQRTVGMSHDRHVAATAHNPQGFLIDTSQGVRGQINFSTQETGFYQLCLSNQHNHFGSVQVYLNFGVFYEGPETDHKQKERKQLNDTLDAIEDGTQKVQNNIFHMWRYYNFARMRKMADFFLIQSNYNYVNWWSTAQSLVIILSGILQLYFLKRLFNVPTTTDTKKPRC

SEQ ID NO: 4731 - protein, 224 aa, unidentified
MPRPGSAQRWAAVAGRWGCRLLALLLLVPGPGGASEITFELPDNAKQCFYEDIAQGTKCTLEFQVITGGHYDVDCRLEDPDGKVLYKEMKKQYDSFTFTASKNGTYKFCFSNEFSTFTHKTVYFDFQVGEDPPLFPSENRVSALTQMESACVSIHEALKSVIDYQTHFRLREAQGRSRAEDLNTRVAYWSVGEALILLVVSIGQVFLLKSFFSDKRTTTTRVGS

SEQ ID NO: 4732 - protein, 235 aa, unidentified
MAVELGVLLVRPRPGTGLGRVMRTLLLVLWLATRGSALYFHIGETEKKCFIEEIPDETMVIGNYRTQLYDKQREEYQPATPGLGMFVEVKDPEDKVILARQYGSEGRFTFTSHTPGEHQICLHSNSTKFSLFAGGMLRVHLDIQVGEHANDYAEIAAKDKLSELQLRVRQLVEQVEQIQKEQNYQRWREERFRQTSESTNQRVLWWSILQTLILVAIGVWQMRHLKSFFEAKKLV

SEQ ID NO: 4733 - protein, 380 aa, unidentified
MGAAAAEAPLRLPAAPPLAFCCYTSVLLLFAFSLPGSRASNQPPGGGGGSGGDCPGGKGKSINCSELNVRESDVRVCDESSCKYGGVCKEDGDGLKCACQFQCHTNYIPVCGSNGDTYQNECFLRRAACKHQKEITVIARGPCYSDNGSGSGEGEEEGSGAEVHRKHSKCGPCKYKAECDEDAENVGCVCNIDCSGYSFNPVCASDGSSYNNPCFVREASCIKQEQIDIRHLGHCTDTDDTSLLGKKDDGLQYRPDVKDASDQREDVYIGNHMPCPENLNGYCIHGKCEFIYSTQKASCRCESGYTGQHCEKTDFSILYVVPSRQKLTHVLIAAIIGAVQIAIIVAIVMCITRKCPKNNRGRRQKQNLGHFTSDTSSRMV

SEQ ID NO: 4734 - protein, 374 aa, unidentified
MVLWESPRQCSSWTLCEGFCWLLLLPVMLLIVARPVKLAAFPTSLSDCQTPTGWNCSGYDDRENDLFLCDTNTCKFDGECLRIGDTVTCVCQFKCNNDYVPVCGSNGESYQNECYLRQAACKQQSEILVVSEGSCATDAGSGSGDGVHEGSGETSQKETSTCDICQFGAECDEDAEDVWCVCNIDCSQTNFNPLCASDGKSYDNACQIKEASCQKQEKIEVMSLGRCQDNTTTTTKSEDGHYARTDYAENANKLEESAREHHIPCPEHYNGFCMHGKCEHSINMQEPSCRCDAGYTGQHCEKKDYSVLYVVPGPVRFQYVLIAAVIGTIQIAVICVVVLCITRKCPRSNRIHRQKQNTGHYSSDNTTRASTRLI

SEQ ID NO: 4735 - protein, 134 aa, unidentified
MTEEPIKEILGAPKAHMAATMEKSPKSEVVITTVPLVSEIQLMAATGGTELSCYRCIIPFAVVVFIAGIVVTAVAYSFNSHGSIISIFGLVVLSSGLFLLASSALCWKVRQRSKKAKRRESQTALVANQRSLFA

SEQ ID NO: 4736 - protein, 257 aa, unidentified
MASKIGSRRWMLQLIMQLGSVLLTRCPFWGCFSQLMLYAERAEARRKPDIPVPYLYFDMGAAVLCASFMSFGVKRRWFALGAALQLAISTYAAYIGGYVHYGDWLKVRMYSRTVAIIGGFLVLASGAGELYRRKPRSRSLQSTGQVFLGIYLICVAYSLQHSKEDRLAYLNHLPGGELMIQLFFVLYGILALAFLSGYYVTLAAQILAVLLPPVMLLIDGNVAYWHNTRRVEFWNQMKLLGESVGIFGTAVILATDG

SEQ ID NO: 4737 - protein, 496 aa, unidentified
MAGEITETGELYSSYVGLVYMFNLIVGTGALTMPKAFATAGWLVSLVLLVFLGFMSFVTTTFVIEAMAAANAQLHWKRMENLKEEEDDDSSTASDSDVLIRDNYERAEKRPILSVQRRGSPNPFEITDRVEMGQMASMFFNKVGVNLFYFCIIVYLYGDLAIYAAAVPFSLMQVTCSATGNDSCGVEADTKYNDTDRCWGPLRRVDAYRIYLAIFTLLLGPFTFFDVQKTKYLQILTSLMRWIAFAVMIVLALIRIGHGQGEGHPPLADFSGVRNLFGVCVYSFMCQHSLPSLITPVSSKRHLTRLVFLDYVLILAFYGLLSFTAIFCFRGDSLMDMYTLNFARCDVVGLAAVRFFLGLFPVFTISTNFPIIAVTLRNNWKTLFHREGGTYPWVVDRVVFPTITLVPPVLVAFCTHDLESLVGITGAYAGTGIQYVIPAFLVYHCRRDTQLAFGCGVSNKHRSPFRHTFWVGFVLLWAFSCFIFVTANIILSETKL

SEQ ID NO: 4738 - protein, 129 aa, unidentified
MLLKVRRASLKPPATPHQGAFRAGNVIGQLIYLLTWSLFTAWLRPPTLLQGPRTSPQGSPPRSPWGDCAEPSCLCEMKIRRRRHEGPAWGQSGFLAGGLHLVPSSLSLAACGVVRMKGLWGRGAGIRGR

SEQ ID NO: 4739 - protein, 262 aa, unidentified
MGKTFSQLGSWREDENKSILSSKPAIGSKAVNYSSTGSSKSFCSCVPCEGTADASFVTCPTCQGSGKIPQELEKQLVALIPYGDQRLKPKHTKLFVFLAVLICLVTSSFIVFFLFPRSVIVQPAGLNSSTVAFDEADIYLNITNILNISNGNYYPIMVTQLTLEVLHLSLVVGQVSNNLLLHIGPLASEQMFYAVATKIRDENTYKICTWLEIKVHHVLLHIQGTLTCSYLSHSEQLVFQSYEYVDCRGNASVPHQLTPHPP

SEQ ID NO: 4740 - protein, 274 aa, unidentified
MGKSLSHLPLHSSKEDAYDGVTSENMRNGLVNSEVHNEDGRNGDVSQFPYVEFTGRDSVTCPTCQGTGRIPRGQENQLVALIPYSDQRLRPRRTKLYVMASVFVCLLLSGLAVFFLFPRSIDVKYIGVKSAYVSYDVQKRTIYLNITNTLNITNNNYYSVEVENITAQVQFSKTVIGKARLNNITIIGPLDMKQIDYTVPTVIAEEMSYMYDFCTLISIKVHNIVLMMQVTVTTTYFGHSEQISQERYQYVDCGRNTTYQLGQSEYLNVLQPQQ

SEQ ID NO: 4741 - protein, 250 aa, unidentified
MGSQHSAAARPSSCRRKQEDDRDGLLAEREQEEAIAQFPYVEFTGRDSITCLTCQGTGYIPTEQVNELVALIPHSDQRLRPQRTKQYVLLSILLCLLASGLVVFFLFPHSVLVDDDGIKVVKVTFNKQDSLVILTIMATLKIRNSNFYTVAVTSLSSQIQYMNTVVSTYVTTNVSLIPPRSEQLVNFTGKAEMGGPFSYVYFFCTVPEILVHNIVIFMRTSVKISYIGLMTQSSLETHHYVDCGGNSTAI

SEQ ID NO: 4742 - protein, 140 aa, unidentified
MGRVSGLVPSRFLTLLAHLVVVITLFWSRDSNIQACLPLTFTPEEYDKQDIQLVAALSVTLGLFAVELAGFLSGVSMFNSTQSLISIGAHCSASVALSFFIFERWECTTYWYIFVFCSALPAVTEMALFVTVFGLKKKPF

SEQ ID NO: 4743 - protein, 575 aa, unidentified
MKRSLQALYCQLLSFLLILALTEALAFAIQEPSPRESLQVLPSGTPPGTMVTAPHSSTRHTSVVMLTPNPDGPPSQAAAPMATPTPRAEGHPPTHTISTIAATVTAPHSESSLSTGPAPAAMATTSSKPEGRPRGQAAPTILLTKPPGATSRPTTAPPRTTTRRPPRPPGSSRKGAGNSSRPVPPAPGGHSRSKEGQRGRNPSSTPLGQKRPLGKIFQIYKGNFTGSVEPEPSTLTPRTPLWGYSSSPQPQTVAATTVPSNTSWAPTTTSLGPAKDKPGLRRAAQGGGSTFTSQGGTPDATAASGAPVSPQAAPVPSQRPHHGDPQDGPSHSDSWLTVTPGTSRPLSTSSGVFTAATGPTPAAFDTSVSAPSQGIPQGASTTPQAPTHPSRVSESTISGAKEETVATLTMTDRVPSPLSTVVSTATGNFLNRLVPAGTWKPGTAGNISHVAEGDKPQHRATICLSKMDIAWVILAISVPISSCSVLLTVCCMKRKKKTANPENNLSYWNNTITMDYFNRHAVELPREIQSLETSEDQLSEPRSPANGDYRDTGMVLVNPFCQETLFVGNDQVSEI

SEQ ID NO: 4744 - protein, 243 aa, unidentified
MAASSISSPWGKHVFKAILMVLVALILLHSALAQSRRDFAPPGQQKREAPVDVLTQIGRSVRGTLDAWIGPETMHLVSESSSQVLWAISSAISVAFFALSGIAAQLLNALGLAGDYLAQGLKLSPGQVQTFLLWGAGALVVYWLLSLLLGLVLALLGRILWGLKLVIFLAGFVALMRSVPDPSTRALLLLALLILYALLSRLTGSRASGAQLEAKVRGLERQVEELRWRQRRAAKGARSVEEE

SEQ ID NO: 4745 - protein, 192 aa, unidentified
MAAWGRRRLGPGSSGGSARERVSLSATDCYIVHEIYNGENAQDQFEYELEQALEAQYKYIVIEPTRIGDETARWITVGNCLHKTAVLAGTACLFTPLALPLDYSHYISLPAGVLSLACCTLYGISWQFDPCCKYQVEYDAYKLSRLPLHTLTSSTPVVLVRKDDLHRKRLHNTIALAALVYCVKKIYELYAV

SEQ ID NO: 4746 - protein, 294 aa, unidentified
MQGPAGNASRGLPGGPPSTVASGAGRCESGALMHSFGIFLQGLLGVVAFSTLMLKRFREPKHERRPWRIWFLDTSKQAIGMLFIHFANVYLADLTEEDPCSLYLINFLLDATVGMLLIYVGVRAVSVLVEWQQWESLRFGEYGDPLQCGAWVGQCALYIVIMIFEKSVVFIVLLILQWKKVALLNPIENPDLKLAIVMLIVPFFVNALMFWVVDNFLMRKGKTKAKLEERGANQDSRNGSKVRYRRAASHEESESEILISADDEMEESDVEEDLRRLTPLKPVKKKKHRFGLPV

SEQ ID NO: 4747 - protein, 372 aa, unidentified
MQGPAGNASRGLPGGPPSTVASGAGRCESGALMHSFGIFLQGLLGVVAFSTLMLKRFREPKHERRPWRIWFLDTSKQAIGMLFIHFANVYLADLTEEDPCSLYLINFLLDATVGMLLIYVGVRAVSVLVEWQQWESLRFGEYGDPLQCGAWVGQCALYIVIMIFEKSVVFIVLLILQWKKVALLNPIENPDLKLAIVMLIVPFFVNALMFWVVDNFLMRKGKTKAKLEERGANQDSRNGSKVRYRRAASHEESESEILISADDEMEESDVEEDLRRLTPLKPVKKKKHRFGLPAGAQEAPIKKKRPPVKDEDLKGARGNLTKNQEIKSKTYQVMRECEQAGSAAPSVFSRTRTGTETVFEKPKAGPTKSVFG

SEQ ID NO: 4748 - protein, 351 aa, unidentified
MQRALPGARQHLGAILASASVVVKALCAAVLFLYLLSFAVDTGCLAVTPGYLFPPNFWIWTLATHGLMEQHVWDVAISLTTVVVAGRLLEPLWGALELLIFFSVVNVSVGLLGAFAYLLTYMASFNLVYLFTVRIHGALGFLGGVLVALKQTMGDCVVLRVPQVRVSVMPMLLLALLLLLRLATLLQSPALASYGFGLLSSWVYLRFYQRHSRGRGDMADHFAFATFFPEILQPVVGLLANLVHSLLVKVKICQKTVKRYDVGAPSSITISLPGTDPQDAERRRQLALKALNERLKRVEDQSIWPSMDDDEEESGAKVDSPLPSDKAPTPPGKGAAPESSLITFEAAPPTL

SEQ ID NO: 4749 - protein, 245 aa, unidentified
MKHTQSGQSTSPLVIDYTCRVCQMAFVFSSLIPLLLMTPVFCLGNTSECFQNFSQSHKCILMHSPPSAMAELPPSANTSVCSTLYFYGIAIFLGSFVLSLLTIMVLLIRAQTLYKKFVKSTGFLGSEQWAVIHIVDQRVRFYPVAFFCCWGPAVILMIIKLTKPQDTKLHMALYVLQALTATSQGLLNCGVYGWTQHKFHQLKQEARRDADTQTPLLCSQKRFYSRGLNSLESTLTFPASTSTIF

SEQ ID NO: 4750 - protein, 514 aa, unidentified
MGKDFRYYFQHPWSRMIVAYLVIFFNFLIFAEDPVSHSQTEANVIVVGNCFSFVTNKYPRGVGWRILKVLLWLLAILTGLIAGKFLFHQRLFGQLLRLKMFREDHGSWMTMFFSTILFLFIFSHIYNTILLMDGNMGAYIITDYMGIRNESFMKLAAVGTWMGDFVTAWMVTDMMLQDKPYPDWGKSARAFWKKGNVRITLFWTVLFTLTSVVVLVITTDWISWDKLNRGFLPSDEVSRAFLASFILVFDLLIVMQDWEFPHFMGDVDVNLPGLHTPHMQFKIPFFQKIFKEEYRIHITGKWFNYGIIFLVLILDLNMWKNQIFYKPHEYGQYIGPGQKIYTVKDSESLKDLNRTKLSWEWRSNHTNPRTNKTYVEGDMFLHSRFIGASLDVKCLAFVPSLIAFVWFGFFIWFFGRFLKNEPRMENQDKTYTRMKRKSPSEHSKDMGITRENTQASVEDPLNDPSLVCIRSDFNEIVYKSSHLTSENLSSQLNESTSATEADQDPTTSKSTPTN

SEQ ID NO: 4751 - protein, 283 aa, unidentified
MVSAAAPSLLILLLLLLGSVPATDARSVPLKATFLEDVAGSGEAEGSSASSPSLPPPWTPALSPTSMGPQPITLGGPSPPTNFLDGIVDFFRQYVMLIAVVGSLAFLLMFIVCAAVITRQKQKASAYYPSSFPKKKYVDQSDRAGGPRAFSEVPDRAPDSRPEEALDSSRQLQADILAATQNLKSPTRAALGGGDGARMVEGRGAEEEEKGSQEGDQEVQGHGVPVETPEAQEEPCSGVLEGAVVAGEGQGELEGSLLLAQEAQGPVGPPESPCACSSVHPSV

SEQ ID NO: 4752 - protein, 339 aa, unidentified
MSGQLERCEREWHELEGEFQELQETHRIYKQKLEELAALQTLCSSSISKQKKHLKDLKLTLQRCKRHASREEAELVQQMAANIKERQDVFFDMEAYLPKKNGLYLNLVLGNVNVTLLSNQAKFAYKDEYEKFKLYLTIILLLGAVACRFVLHYRVTDEVFNFLLVWYYCTLTIRESILISNGSRIKGWWVSHHYVSTFLSGVMLTWPNGPIYQKFRNQFLAFSIFQSCVQFLQYYYQRGCLYRLRALGERNHLDLTVEGFQSWMWRGLTFLLPFLFCGHFWQLYNAVTLFELSSHEECREWQVFVLAFTFLILFLGNFLTTLKVVHAKLQKNRGKTKQP

SEQ ID NO: 4753 - protein, 319 aa, unidentified
MVLPPPDRRHVCLTTLVIMGSMAVMDAYLVEQNQGPRKIGVCIIVLVGDVCFLLVLRYVAVWVGAEVRTAKRGYAMILWFLYIFVLEIKLYFIFQNYKAARRGAADPVARKALTLLLSVCVPGLFLLLVALDRMEYVRTFRKREDLRGRLFWVALDLLDLLDMQASLWEPPRSGLPLWAEGLTFFYCYMLLLVLPCVALSEVSMQGEHIAPQKMMLYPVLSLATVNVVAVLARAANMALFRDSRVSAIFVGKNVVALATKACTFLEYRRQVRDFPPPALSLELQPPPPQRNSVPPPPPPLHGPPGRPHMSSPTRDPLDT

SEQ ID NO: 4754 - protein, 208 aa, unidentified
MGLGARGAWAALLLGTLQVLALLGAAHESAAMAASANIENSGLPHNSSANSTETLQHVPSDHTNETSNSTVKPPTSVASDSSNTTVTTMKPTAASNTTTPGMVSTNMTSTTLKSTPKTTSVSQNTSQISTSTMTVTHNSSVTSAASSVTITTTMHSEAKKGSKFDTGSFVGGIVLTLGVLSILYIGCKMYYSRRGIRYRTIDEHDAII

SEQ ID NO: 4755 - protein, 219 aa, unidentified
MSEQEAQAPGGRGLPPDMLAEQVELWWSQQPRRSALCFVVAVGLVAGCGAGGVALLSTTSSRSGEWRLATGTVLCLLALLVLVKQLMSSAVQDMNCIRQAHHVALLRSGGGADALVVLLSGLVLLVTGLTLAGLAAAPAPARPLAAMLSVGIALAALGSLLLLGLLLYQVGVSGHCPSICMATPSTHSGHGGHGSIFSISGQLSAGRRHETTSSIASLI

SEQ ID NO: 4756 - protein, 195 aa, unidentified
MENHKSNNKENITIVDISRKINQLPEAERNLLENGSVYVGLNAALCGLIANSLFRRILNVTKARIAAGLPMAGIPFLTTDLTYRCFVSFPLNTGDLDCETCTITRSGLTGLVIGGLYPVFLAIPVNGGLAARYQSALLPHKGNILSYWIRTSKPVFRKMLFPILLQTMFSAYLGSEQYKLLIKALQLSEPGKEIH

SEQ ID NO: 4757 - protein, 230 aa, unidentified
MVVFGYEAGTKPRDSGVVPVGTEEAPKVFKMAASMHGQPSPSLEDAKLRRPMVIEIIEKNFDYLRKEMTQNIYQMATFGTTAGFSGIFSNFLFRRCFKVKHDALKTYASLATLPFLSTVVTDKLFVIDALYSDNISKENCVFRSSLIGIVCGVFYPSSLAFTKNGRLATKYHTVPLPPKGRVLIHWMTLCQTQMKLMAIPLVFQIMFGILNGLYHYAVFEETLEKTIHEE

SEQ ID NO: 4758 - protein, 238 aa, unidentified
MYAPGGAGLPGGRRRRSPGGSALPKQPERSLASALPGALSITALCTALAEPAWLHIHGGTCSRQELGVSDVLGYVHPDLLKDFCMNPQTVLLLRVIAAFCFLGILCSLSAFLLDVFGPKHPALKITRRYAFAHILTVLQCATVIGFSYWASELILAQQQQHKKYHGSQVYVTFAVSFYLVAGAGGASILATAANLLRHYPTEEEEQALELLSEMEENEPYPAEYEVINQFQPPPAYTP

SEQ ID NO: 4759 - protein, 362 aa, unidentified
MDSPEVTFTLAYLVFAVCFVFTPNEFHAAGLTVQNLLSGWLGSEDAAFVPFHLRRTAATLLCHSLLPLGYYVGMCLAASEKRLHALSQAPEAWRLFLLLAVTLPSIACILIYYWSRDRWACHPLARTLALYALPQSGWQAVASSVNTEFRRIDKFATGAPGARVIVTDTWVMKVTTYRVHVAQQQDVHLTVTESRQHELSPDSNLPVQLLTIRVASTNPAVQAFDIWLNSTEYGELCEKLRAPIRRAAHVVIHQSLGDLFLETFASLVEVNPAYSVPSSQELEACIGCMQTRASVKLVKTCQEAATGECQQCYCRPMWCLTCMGKWFASRQDPLRPDTWLASRVPCPTCRARFCILDVCTVR

SEQ ID NO: 4760 - protein, 435 aa, unidentified
MAQAVWSRLGRILWLACLLPWAPAGVAAGLYELNLTTDSPATTGAVVTISASLVAKDNGSLALPADAHLYRFHWIHTPLVLTGKMEKGLSSTIRVVGHVPGEFPVSVWVTAADCWMCQPVARGFVVLPITEFLVGDLVVTQNTSLPWPSSYLTKTVLKVSFLLHDPSNFLKTALFLYSWDFGDGTQMVTEDSVVYYNYSIIGTFTVKLKVVAEWEEVEPDATRAVKQKTGDFSASLKLQETLRGIQVLGPTLIQTFQKMTVTLNFLGSPPLTVCWRLKPECLPLEEGECHPVSVASTAYNLTHTFRDPGDYCFSIRAENIISKTHQYHKIQVWPSRIQPAVFAFPCATLITVMLAFIMYMTLRNATQQKDMVEVADFDFSPMSDKNPEPPSGVRCCCQMCCGPFLLETPSEYLEIVRENHGLLPPLYKSVKTYTV

SEQ ID NO: 4761 - protein, 1883 aa, unidentified
MGKRAGGGATGATTAAVSTSAGAGLEPAAARSGGPRSAAAGLLGALHLVMTLVVAAARAEKEAFVQSESIIEVLRFDDGGLLQTETTLGLSSYQQKSISLYRGNCRPIRFEPPMLDFHEQPVGMPKMEKVYLHNPSSEETITLVSISATTSHFHASFFQNRKILPGGNTSFDVVFLARVVGNVENTLFINTSNHGVFTYQVFGVGVPNPYRLRPFLGARVPVNSSFSPIINIHNPHSEPLQVVEMYSSGGDLHLELPTGQQGGTRKLWEIPPYETKGVMRASFSSREADNHTAFIRIKTNASDSTEFIILPVEVEVTTAPGIYSSTEMLDFGTLRTQDLPKVLNLHLLNSGTKDVPITSVRPTPQNDAITVHFKPITLKASESKYTKVASISFDASKAKKPSQFSGKITVKAKEKSYSKLEIPYQAEVLDGYLGFDHAATLFHIRDSPADPVERPIYLTNTFSFAILIHDVLLPEEAKTMFKVHNFSKPVLILPNESGYIFTLLFMPSTSSMHIDNNILLITNASKFHLPVRVYTGFLDYFVLPPKIEERFIDFGVLSATEASNILFAIINSNPIELAIKSWHIIGDGLSIELVAVERGNRTTIISSLPEFEKSSLSDQSSVTLASGYFAVFRVKLTAKKLEGIHDGAIQITTDYEILTIPVKAVIAVGSLTCFPKHVVLPPSFPGKIVHQSLNIMNSFSQKVKIQQIRSLSEDVRFYYKRLRGNKEDLEPGKKSKIANIYFDPGLQCGDHCYVGLPFLSKSEPKVQPGVAMQEDMWDADWDLHQSLFKGWTGIKENSGHRLSAIFEVNTDLQKNIISKITAELSWPSILSSPRHLKFPLTNTNCSSEEEITLENPADVPVYVQFIPLALYSNPSVFVDKLVSRFNLSKVAKIDLRTLEFQVFRNSAHPLQSSTGFMEGLSRHLILNLILKPGEKKSVKVKFTPVHNRTVSSLIIVRNNLTVMDAVMVQGQGTTENLRVAGKLPGPGSSLRFKITEALLKDCTDSLKLREPNFTLKRTFKVENTGQLQIHIETIEISGYSCEGYGFKVVNCQEFTLSANASRDIIILFTPDFTASRVIRELKFITTSGSEFVFILNASLPYHMLATCAEALPRPNWELALYIIISGIMSALFLLVIGTAYLEAQGIWEPFRRRLSFEASNPPFDVGRPFDLRRIVGISSEGNLNTLSCDPGHSRGFCGAGGSSSRPSAGSHKQCGPSVHPHSSHSNRNSADVENVRAKNSSSTSSRTSAQAASSQSANKTSPLVLDSNTVTQGHTAGRKSKGAKQSQHGSQHHAHSPLEQHPQPPLPPPVPQPQEPQPERLSPAPLAHPSHPERASSARHSSEDSDITSLIEAMDKDFDHHDSPALEVFTEQPPSPLPKSKGKGKPLQRKVKPPKKQEEKEKKGKGKPQEDELKDSLADDDSSSTTTETSNPDTEPLLKEDTEKQKGKQAMPEKHESEMSQVKQKSKKLLNIKKEIPTDVKPSSLELPYTPPLESKQRRNLPSKIPLPTAMTSGSKSRNAQKTKGTSKLVDNRPPALAKFLPNSQELGNTSSSEGEKDSPPPEWDSVPVHKPGSSTDSLYKLSLQTLNADIFLKQRQTSPTPASPSPPAAPCPFVARGSYSSIVNSSSSSDPKIKQPNGSKHKLTKAASLPGKNGNPTFAAVTAGYDKSPGGNGFAKVSSNKTGFSSSLGISHAPVDSDGSDSSGLWSPVSNPSSPDFTPLNSFSAFGNSFNLTGEVFSKLGLSRSCNQASQRSWNEFNSGPSYLWESPATDPSPSWPASSGSPTHTATSVLGNTSGLWSTTPFSSSIWSSNLSSALPFTTPANTLASIGLMGTENSPAPHAPSTSSPADDLGQTYNPWRIWSPTIGRRSSDPWSNSHFPHEN

SEQ ID NO: 4762 - protein, 1023 aa, unidentified
MCARMAGRTTAAPRGPYGPWLCLLVALALDVVRVDCGQAPLDPVYLPAALELLDAPEHFRVQQVGHYPPANSSLSSRSETFLLLQPWPRAQPLLRASYPPFATQQVVPPRVTEPHQRPVPWDVRAVSVEAAVTPAEPYARVLFHLKGQDWPPGSGSLPCARLHATHPAGTAHQACRFQPSLGACVVELELPSHWFSQASTTRAELAYTLEPAAEGPGGCGSGEENDPGEQALPVGGVELRPADPPQYQEVPLDEAVTLRVPDMPVRPGQLFSATLLLRHNFTASLLTLRIKVKKGLHVTAARPAQPTLWTAKLDRFKGSRHHTTLITCHRAGLTEPDSSPLELSEFLWVDFVVENSTGGGVAVTRPVTWQLEYPGQAPEAEKDKMVWEILVSERDIRALIPLAKAEELVNTAPLTGVPQHVPVRLVTVDGGGALVEVTEHVGCESANTQVLQVSEACDAVFVAGKESRGARGVRVDFWWRRLRASLRLTVWAPLLPLRIELTDTTLEQVRGWRVPGPAEGPAEPAAEASDEAERRARGCHLQYQRAGVRFLAPFAAHPLDGGRRLTHLLGPDWLLDVSHLVAPHARVLDSRVASLEGGRVVVGREPGVTSIEVRSPLSDSILGEQALAVTDDKVSVLELRVQPVMGISLTLSRGTAHPGEVTATCWAQSALPAPKQEVALSLWLSFSDHTVAPAELYDRRDLGLSVSAEEPGAILPAEEQGAQLGVVVSGAGAEGLPLHVALHPPEPCRRGRHRVPLASGTAWLGLPPASTPAPALPSSPAWSPPATEATMGGKRQVAGSVGGNTGVRGKFERAEEEARKEETEAREEEEEEEEEMVPAPQHVTELELGMYALLGVFCVAIFIFLVNGVVFVLRYQRKEPPDSATDPTSPQPHNWVWLGTDQEELSRQLDRQSPGPPKGEGSCPCESGGGGEAPTLAPGPPGGTTSSSSTLARKEAGGRRKRVEFVTFAPAPPAQSPEEPVGAPAVQSILVAGEEDIRWVCEDMGLKDPEELRNYMERIRGSS

SEQ ID NO: 4763 - protein, 1078 aa, unidentified
MFGAASRMDTTAVCTGGVTESRGIVDSLQKFSSLPAYLPTNLHISNAEESFFLKEANQDLTRNSSLQARVEPFFIYRARTPPIINASYGPFSVEKIIPQELLLTSTAFGNMDKFPFNWKLKSHILDSSIYSNRPKVQTLFYVTGMGWDDSDLTEDLPCVKMFAFPEAREVAASCRLQGAPGLCVAELELLPEWFSSGLDLEPEEEIPALLGGTTMELFFTLYPADKAGQCPLEEEGKWENNIHSGLESPQQAFPARERIGSVVVYPTQDDLKWSLVSLDENVVISVPLNLVREGDTATFLVSLTSSSVADQFTLRIKAAAGVKITAVRVSSEDQWAVQEEIDNGSTQTSATLTCMGHRPDTQSRVNGSFYEILQVDFGIDNSSDLAGAQQITWQVEYPIEDSMSELVVSEIFVSQTTFVGIVPLAMDTEVLNTAILTGKPVSVPVKVVGVQEDGSVVDVSESVECKSADEDVIKVSNNCDSIFVNGKEMKSKVDTIVNFTHQHFTSQFEVTVWAPRLPLQIEISDTELSQIKGWRIPVAANRRPTRESDDEDDEEKKGRGCSLQYQHATVRVLTQFVAESPDLGQLTYMLGPDWQFDITDLVTEFMKVEEPKIAQLQDGRTLAGREPGITTVQVLSPLSDSILAEKTVIVLDDRVTIAELGVQLVAGMSLSLQPHRADKRAIVSTAAALDVLQSPQQEAIVSSWILFSDGSVTPLDIYDPKDYSVTVSSLDEMVVSVQANLESKWPIVVAEGEGQGPLIKLEMMISEPCQKTKRKSVLAVGKGNVKVKFEPSSDEHQGGSNDIEGINREYKDHLSNSIEREGNQERAVQEWFHRGTPVGQEESTNKSTTPQSPMEGKNKLLKSGGPDAFTSFPTQGKSPDPNNPSDLTVTSRGLTDLEIGMYALLCVFCLAILVFLINCVAFAWKYRHKRFAVSEQGNIPHSHDWVWLGNEVELLENPVDITLPSEECTTMIDRGLQFEERNFLLNGSSQKTFHSQLLRPSDYVYEKEIKNEPMNSSGPKRKRVKFTSYTTILPEDGGPYTNSILFDSDDNIKWVCQDMGLGDSQDFRDYMESLQDQM

SEQ ID NO: 4764 - protein, 1108 aa, unidentified
MRSEGAAPGPAAPLCGALSLLLGALLGKVIEGHGVTDNIQRFSSLPPYLPVSYHILRAETSFFLKEANQDLLRNSSLQARVESFFTYKTRQPPVLNASYGPFSVEKVVPLDLMLTSNFLGPTNKFSFDWKLKAHILRDKVYLSRPKVQVLFHIMGRDWDDHGAGEKLPCLRVFAFRETREVRGSCRLKGDLGLCVAELELLSSWFSAPTVGAGRKKSMDQPEGTPVELYYTVHPGNERGDCAGGDFRKGNAIRPGKDGLEETTSHLQRIGTVGLYRAQDSAQLSELRLDGNVVIWLPSRPVKQGEVVTAYVTISSNSSVDLFILRAKVKKGVNILSAQTREPRQWGVKQEVGSGGKHVTATVACQRLGPSPRNRSSSLFNEVVQMNFEIASFSSLSGTQPITWQVEYPRKGTTDIAVSEIFVSQKDLVGIVPLAMDTEILNTAVLTGKTVAMPIKVVSVEENSAVMDISESVECKSTDEDVIKVSERCDYIFVNGKEIKGKMDAVVNFTYQYLSAPLCVTVWVPRLPLQIEVSDTELSQIKGWRVPIVTNKRPTRESEDEDEEERRGRGCALQYQHATVRVLTQFVSEGAGPWGQPNYLLSPNWQFDITHLVADFMKLEEPHVATLQDSRVLVGREVGMTTIQVLSPLSDSILAEKTITVLDDKVSVTDLAIQLVAGLSVALYPNAENSKAVTAVVTAEEVLRTPKQEAVFSTWLQFSDGSVTPLDIYDTKDFSLAATSQDEAVVSVPQPRSPRWPVVVAEGEGQGPLIRVDMTIAEACQKSKRKSILAVGVGNVRVKFGQNDADSSPGGDYEEDEIKNHASDRRQKGQHHERTGQDGHLYGSSPVEREEGALRRATTTARSLLDNKVVKNSRADGGRLAGEGQLQNIPIDFTNFPAHVDLPKAGSGLEENDLVQTPRGLSDLEIGMYALLGVFCLAILVFLINCATFALKYRHKQVPLEGQASMTHSHDWVWLGNEAELLESMGDAPPPQDEHTTIIDRGPGACEESNHLLLNGGSHKHVQSQIHRSADSGGRQGREQKQDPLHSPTSKRKKVKFTTFTTIPPDDSCPTVNSIVSSNDEDIKWVCQDVAVGAPKELRNYLEKLKDKA

SEQ ID NO: 4765 - protein, 1099 aa, unidentified
MCPSEMGTLWHHWSPVLISLAALFSKVTEGRGILESIQRFSLLPTYLPVTYHINNADVSFFLKEANQDIMRNSSLQSRVESFLIYKSRRLPVLNASYGPFSIEQVVPQDLMLPSNPFGFTNKFSLNWKLKAHILRDKVYLSRPKVQVLFHIMGRDWDDRSAGEKLPCLRVFAFRETREVRGSCRLQGDLGLCVAELELLSSWFSPPTVVAGRRKSVDQPEGTPVELYYTVHPGGERGDCVREDARRSNGIRTGHSDIDESGPPLQRIGSIFLYQTHRKPSLRELRLDNSVAIHYIPKTVRKGDVLTFPVSISRNSTEDRFTLRAKVKKGVNIIGVRASSPSIWDVKERTDYTGKYAPAVIVCQKKAAGSENSADGASYEVMQIDVEVEEPGDLPATQLVTWQVEYPGEITSDLGVSKIYVSPKDLIGVVPLAMEAEILNTAILTGKTVAVPVKVVSVEDDGTVTELLESVECRSSDEDVIKVSDRCDYVFVNGKEMKGKVNVVVNFTYQHLSSPLEMTVWVPRLPLQIEVSDTELNQIKGWRVPIVSSRRPAGDSEEEEDDERRGRGCTLQYQHAMVRVLTQFVAEAAGPGGHLAHLLGSDWQVDITELINDFMQVEEPRIAKLQGGQILMGQELGMTTIQILSPLSDTILAEKTITVLDEKVTITDLGVQLVTGLSLSLQLSPGSNRAIFATAVAQELLQRPKQEAAISCWVQFSDGSVTPLDIYDGKDFSLMATSLDEKVVSIHQDPKFKWPIIAAETEGQGTLVKVEMVISESCQKSKRKSVLAVGTANIKVKFGQNDANPNTSDSRHTGAGVHMENNVSDRRPKKPSQEWGSQEGQYYGSSSMGLMEGRGTTTDRSILQKKKGQESLLDDNSHLQTIPSDLTSFPAQVDLPRSNGEMDGNDLMQASKGLSDLEIGMYALLGVFCLAILVFLINCVTFALKYRHKQVPFEEQEGMSHSHDWVGLSNRTELLENHINFASSQDEQITAIDRGMDFEESKYLLSTNSQKSINGQLFKPLGPIIIDGKDQKSEPPTSPTSKRKRVKFTTFTAVSSDDEYPTRNSIVMSSEDDIKWVCQDLDPGDCKELHNYMERLHENV

SEQ ID NO: 4766 - protein, 1074 aa, unidentified
MAPGMSGRGGAALLCLSALLAHASGRSHPASPSPPGPQASPVLPVSYRLSHTRLAFFLREARPPSPAVANSSLQRSEPFVVFQTKELPVLNVSLGPFSTSQVVARELLQPSSTLDIPERLTVNWKVRAFIVRSHVPASQPVVQVLFYVAGRDWDDFGVTERLPCVRLHAFRDAREVKSSCRLSGGLATCLVRAELPLAWFGPPAPAAPPTARRKSPDGLEPEATGESQQAELYYTLHAPDASGGCGGSRRGAGPGVGARAESPTQHPLLRIGSISLFRPPPRRTLQEHRLDSNLMIRLPDRPLKPGEVLSILLYLAPNSSSPSSPSVEHFTLRVKAKKGVTLLGTKSRSGQWHVTSELLTGAKHSTATVDVAWAQSTPLPPREGQGPLEILQLDFEMENFTSQSVKRRIMWHIDYRGHGALPDLERAVTELTVIQRDVQAILPLAMDTEIINTAILTGRTVAIPVKVIAIEVNGLVLDISALVECESDNEDIIKVSSSCDYVFVSGKESRGSMNARVTFRYDVLNAPLEMTVWVPKLPLHIELSDARLSQVKGWRVPILPDRRSVRESEDEDEEEEERRQSASRGCTLQYQHATLQVFTQFHTTSSEGTDQVVTMLGPDWLVEVTDLVSDFMRVGDPRVAHMVDSSTLAGLEPGTTPFKVVSPLTEAVLGETLLTVTEEKVSITQLQAQVVASLALSLRPSPGSSHTILATTAAQQTLSFLKQEALLSLWLSYSDGTTAPLSLYSPRDYGLLVSSLDEHVATVTQDRAFPLVVAEAEGSGELLRAELTIAESCQKTKRKSVLATTPVGLRVHFGRDEEDPTYDYPGPSQPGPGGGEDEARGAGPPGSALPAPEAPGPGTASPVVPPTEDFLPLPTGFLQVPRGLTDLEIGMYALLGVFCLAILVFLINCIVFVLRYRHKRIPPEGQTSMDHSHHWVFLGNGQPLRVQGELSPPAGNPLETVPAFCHGDHHSSGSSQTSVQSQVHGRGDGSSGGSARDQAEDPASSPTSKRKRVKFTTFTTLPSEELAYDSVPAGEEDEEEEEDLGWGCPDVAGPTRPTAPPDLHNYMRRIKEIA

SEQ ID NO: 4767 - protein, 195 aa, unidentified
MSAARPQFSIDDAFELSLEDGGPGPESSGVARFGPLHFERRARFEVADEDKQSRLRYQNLENDEDGAQASPEPDGGVGTRDSSRTSIRSSQWSFSTISSSTQRSYNTCCSWTQHPLIQKNRRVVLASFLLLLLGLVLILVGVGLEATPSPGVSSAIFFVPGFLLLVPGVYHVIFIYCAVKGHRGFQFFYLPYFEK

SEQ ID NO: 4768 - protein, 458 aa, unidentified
MAALSKSIPHNCYEIGHTWHPSCRVSFLQITGGALEESLKIYAPLYLIAAILRKRKLDYYLHKLLPEILQSASFLTANGALYMAFFCILRKILGKFYSWTPGFGAALPASYVAILIERKSRRGLLTIYMANLATETLFRMGVARGTITTLRNGEVLLFCITAAMYMFFFRCKDGLKGFTFSALRFIVGKEEIPTHSFSPEAAYAKVEQKREQHEEKPGRMNMIGLVRKFVDSICKHGPRHRCCKHYEDNCISYCIKGFIRMFSVGYLIQCCLRIPSAFRHLFTQPSRLLSLFYNKENFQLGAFLGSFVSIYKGTSCFLRWIRNLDDELHAIIAGFLAGISMMFYKSTTISMYLASKLVETMYFKGIEAGKVPYFPHADTIIYSISTAICFQAAVMEVQTLRPSYWKFLLRLTKGKFAVMNRKVLDVFGTGASKHFQDFIPRLDPRYTTVTPELPTEFS

SEQ ID NO: 4769 - protein, 245 aa, unidentified
MALALCLQVLCSLCGWLSLYISFCHLNKHRSYEWSCRLVTFTHGVLSIGLSAYIGFIDGPWPFTHPGSPNTPLQVHVLCLTLGYFIFDLGWCVYFQSEGALMLAHHTLSILGIIMALVLGESGTEVNAVLFGSELTNPLLQMRWFLRETGHYHSFTGDVVDFLFVALFTGVRIGVGACLLFCEMVSPTPKWFVKAGGVAMYAVSWCFMFSIWRFAWRKSIKKYHAWRSRRSEERQLKHNGHLKIH

SEQ ID NO: 4770 - protein, 162 aa, unidentified
MLQTSNYSLVLSLQFLLLSYDLFVNSFSELLQKTPVIQLVLFIIQDIAVLFNIIIIFLMFFNTFVFQAGLVNLLFHKFKGTIILTAVYFALSISLHVWVMNLRWKNSNSFIWTDGLQMLFVFQRLAAVLYCYFYKRTAVRLGDPHFYQDSLWLRKEFMQVRR

SEQ ID NO: 4771 - protein, 216 aa, unidentified
MVPMHLLGRLEKPLLLLCCASFLLGLALLGIKTDITPVAYFFLTLGGFFLFAYLLVRFLEWGLRSQLQSMQTESPGPSGNARDNEAFEVPVYEEAVVGLESQCRPQELDQPPPYSTVVIPPAPEEEQPSHPEGSRRAKLEQRRMASEGSMAQEGSPGRAPINLRLRGPRAVSTAPDLQSLAAVPTLEPLTPPPAYDVCFGHPDDDSVFYEDNWAPP

SEQ ID NO: 4772 - protein, 185 aa, unidentified
MAGPRPRWRDQLLFMSIIVLVIVVICLMFYALLWEAGNLTDLPNLRIGFYNFCLWNEDTSTLQCHQFPELEALGVPRVGLGLARLGVYGSLVLTLFAPQPLLLAQCNSDERAWRLAVGFLAVSSVLLAGGLGLFLSYVWKWVRLSLPGPGFLALGSAQALLILLLIAMAVFPLRAERAESKLESC

SEQ ID NO: 4773 - protein, 108 aa, unidentified
MVNLGLSRVDDAVAAKHPGLGEYAACQSHAFMKGVFTFVTGTGMAFGLQMFIQRKFPYPLQWSLLVAVVAGSVVSYGVTRVESEKCNNLWLFLETGQLPKDRSTDQRS

SEQ ID NO: 4774 - protein, 459 aa, unidentified
MTVELWLRLRGKGLAMLHVTRGVWGSRVRVWPLLPALLGPPRALSSLAAKMGEYRKMWNPREPRDWAQQYRERFIPFSKEQLLRLLIQEFHSSPAEKAALEAFSAHVDFCTLFHYHQILARLQALYDPINPDRETLDQPSLTDPQRLSNEQEVLRALEPLLAQANFSPLSEDTLAYALVVHHPQDEVQVTVNLDQYVYIHFWALGQRVGQMPLKSSVGSRRGFFTKLPPAERRYFKRVVLAARTKRGHLVLKSFKDTPLEGLEQLLPELKVRTPTLQRALLNLMLVVSGVAIFVNVGMVVLTDLKVATSLLLLLFAIFMGLRASKMFGQRRSAQALELAHMLYYRSTSNNSELLSALALRAQDEHTKEALLAHSFLARRPGGTQGSPEETSRWLRSEVENWLLAKSGCEVTFNGTRALAHLQALTPSMGLYPPPGFPKLDPVAPITSEPPQATPSSNIS

SEQ ID NO: 4775 - protein, 345 aa, unidentified
MSNNGADLTFGYISCFVAILLFGSNFVPLKKFDTGDGMFLQWVLCAAIWLVALVVNLILHCPKFWPFAMLGGCIWATGNIAVVPIIKTIGLGLGILIWGSFNALTGWASSRFGWFGLDAEEVSNPLLNYIGAGLSVVSAFIFLFIKSEIPNNTCSMDTTPLITEHVINTTQDPCSWVDKLSTVHHRIVGCSLAVISGVLYGSTFVPIIYIKDHSKRNDSIYAGASQYDLDYVFAHFSGIFLTSTVYFLAYCIAMKNSPKLYPEAVLPGFLSGVLWAIATCCWFIANHSLSAVVSFPIITAGPGFIAAMWGIFMFKEIKGLQNYLLMILAFCIILTGALCTAFSKI

SEQ ID NO: 4776 - protein, 493 aa, unidentified
MEPLRAPALRRLLPPLLLLLLSLPPRARAKYVRGNLSSKEDWVFLTRFCFLSDYGRLDFRFRYPEAKCCQNILLYFDDPSQWPAVYKAGDKDCLAKESVIRPENNQVINLTTQYAWSGCQVVSEEGTRYLSCSSGRSFRSGDGLQLEYEMVLTNGKSFWTRHFSADEFGILETDVTFLLIFILIFFLSCYFGYLLKGRQLLHTTYKMFMAAAGVEVLSLLFFCIYWGQYATDGIGNESVKILAKLLFSSSFLIFLLMLILLGKGFTVTRGRISHAGSVKLSVYMTLYTLTHVVLLIYEAEFFDPGQVLYTYESPAGYGLIGLQVAAYVWFCYAVLVSLRHFPEKQPFYVPFFAAYTLWFFAVPVMALIANFGIPKWAREKIVNGIQLGIHLYAHGVFLIMTRPSAANKNFPYHVRTSQIASAGVPGPGGSQSADKAFPQHVYGNVTFISDSVPNFTELFSIPPPATSPLPRAAPDSGLPLFRDLRPPGPLRDL

SEQ ID NO: 4777 - protein, 224 aa, unidentified
MTLFHFGNCFALAYFPYFITYKCSGLSEYNAFWKCVQAGVTYLFVQLCKMLFLATFFPTWEGGIYDFIGEFMKASVDVADLIGLNLVMSRNAGKGEYKIMVAALGWATAELIMSRCIPLWVGARGIEFDWKYIQMSIDSNISLVHYIVASAQVWMITRYDLYHTFRPAVLLLMFLSVYKAFVMETFVHLCSLGSWAALLARAVVTGLLALSTLALYVAVVNVHS

SEQ ID NO: 4778 - protein, 99 aa, unidentified
MDLIGFGYAALVTFGSIFGYKRRGGVPSLIAGLFVGCLAGYGAYRVSNDKRDVKVSLFTAFFLATIMGVRFKRSKKIMPAGLVAGLSLMMILRLVLLLL

SEQ ID NO: 4779 - protein, 114 aa, unidentified
MEKPLFPLVPLHWFGFGYTALVVSGGIVGYVKTGSVPSLAAGLLFGSLAGLGAYQLYQDPRNVWGFLAATSVTFVGVMGMRSYYYGKFMPVGLIAGASLLMAAKVGVRMLMTSD

SEQ ID NO: 4780 - protein, 112 aa, unidentified
MQDTGSVVPLHWFGFGYAALVASGGIIGYVKAGSVPSLAAGLLFGSLAGLGAYQLSQDPRNVWVFLATSGTLAGIMGMRFYHSGKFMPAGLIAGASLLMVAKVGVSMFNRPH

SEQ ID NO: 4781 - protein, 271 aa, unidentified
MTAWILLPVSLSAFSITGIWTVYAMAVMNHHVCPVENWSYNESCPPDPAEQGGPKTCCTLDDVPLISKCGSYPPESCLFSLIGNMGAFMVALICLLRYGQLLEQSRHSWVNTTALITGCTNAAGLLVVGNFQVDHARSLHYVGAGVAFPAGLLFVCLHCALSYQGATAPLDLAVAYLRSVLAVIAFITLVLSGVFFVHESSQLQHGAALCEWVCVIDILIFYGTFSYEFGAVSSDTLVAALQPTPGRACKSSGSSSTSTHLNCAPESIAMI

SEQ ID NO: 4782 - protein, 233 aa, unidentified
MWGYLSLMPVFLAVWAISGVWIVFAIAVTNRTVDLSKGFPYISICGSFPPQSCIFSQVLNMGAALAAWICIVRYHQLRDWGVRRWPNQLILWTGLLCALGTSVVGNFQEKNQRPTHLAGAFLAFILGNVYFWLQLLLWRLKRLPQPGAAWIGPLRLGLCSVCTILIVAMIVLHACSLRSVSAACEWVVAMLLFALFGLLAVDFSALESCTLCVQPWPSLSPPPASPISLPVQL

SEQ ID NO: 4783 - protein, 249 aa, unidentified
MDGKKCSVWMFLPLVFTLFTSAGLWIVYFIAVEDDKILPLNSAERKPGVKHAPYISIAGDDPPASCVFSQVMNMAAFLALVVAVLRFIQLKPKVLNPWLNISGLVALCLASFGMTLLGNFQLTNDEEIHNVGTSLTFGFGTLTCWIQAALTLKVNIKNEGRRVGIPRVILSASITLCVVLYFILMAQSIHMYAARVQWGLVMCFLSYFGTFAVEFRHYRYEIVCSEYQENFLSFSESLSEASEYQTDQV

SEQ ID NO: 4784 - protein, 468 aa, unidentified
MPEDGAGDGGEVPALIPDGEPLREEQRPLKQSLGSSLCRESHWKCLLLTLLIHACGAVVAWCRLATVPRLVLGPEAALARGAGGPPPTYPASPCSDGYLYIPLAFVSLLYLLYLAECWHCHVRSCQAPRTDAHTVLALIRRLQQAPPCVWWKATSYHYVRRTRQITRYRNGDAYTTTQVYHERADSRTARGEFDYSAHGVRDVSKELVGLAEHAATRLRFTKCFSFGSAEAEASYLTQRARFFSANEGLDDYLEAREGMHLKDVDFRESLMVFADPRSPPWYARAWVFWLVSAATLSWPLRVVAAYGTAHVHYQVEKLFGASSPPPGAVPSGPPLSRVATVDFTELEWHICSNRQLVPSYSEAVVMGAGSGAYLRGCQRCRRSVSSNSLPPARPSGPRLPFSRSRLSLGAGGRATPGVFRSLSGGPLGRRGEDTEPLESPPCYEDALYFPVLIVHGDSGCQGDGQGAL

SEQ ID NO: 4785 - protein, 566 aa, unidentified
MSPPGSAAGESAAGGGGGGGGPGVSEELTAAAAAAAADEGPAREEQRPIQPSFTKSLCRESHWKCLLLSLLMYGCLGAVAWCHVTTVTRLTFSSAYQGNSLMYHDSPCSNGYVYIPLAFLLMLYAVYLVECWHCQARHELQHRVDVSSVRERVGRMQQATPCIWWKAISYHYVRRTRQVTRYRNGDAYTTTQVYHERVNTHVAEAEFDYARCGVRDVSKTLVGLEGAPATRLRFTKCFSFASVEAENAYLCQRARFFAENEGLDDYMEAREGMHLKNVDFREFMVAFPDPARPPWYACSSAFWAAALLTLSWPLRVLAEYRTAYAHYHVEKLFGLEGPGSASSAGGGLSPSDELLPPLTHRLPRVNTVDSTELEWHIRSNQQLVPSYSEAVLMDLAGLGTRCGGAGGGYAPSCRYGGVGGPGAAGVAPYRRSCEHCQRAVSSSSIFSRSALSICASPRAGPGPGGGAGCGGSRFSLGRLYGSRRSCLWRSRSGSVNEASCPTEQTRLSSQASMGDDEDDDEEEAGPPPPYHDALYFPVLIVHRQEGCLGHSHRPLHRHGSCVETSL

SEQ ID NO: 4786 - protein, 183 aa, unidentified
MQAPRAALVFALVIALVPVGRGNYEELENSGDTTVESERPNKVTIPSTFAAVTIKETLNANINSTNFAPDENQLEFILMVLIPLILLVLLLLSVVFLATYYKRKRTKQEPSSQGSQSALQTYELGSENVKVPIFEEDTPSVMEIEMEELDKWMNSMNRNADFECLPTLKEEKESNHNPSDSES

SEQ ID NO: 4787 - protein, 296 aa, unidentified
MTKTALLKLFVAIVITFILILPEYFKTPKERTLELSCLEVCLQSNFTYSLSSLNFSFVTFLQPVRETQIIMRIFLNPSNFRNFTRTCQDITGEFKMCSSCLVCESKGNMDFISQEQTSKVLIRRGSMEVKANDFHSPCQHFNFSVAPLVDHLEEYNTTCHLKNHTGRSTIMEDEPSKEKSINYTCRIMEYPNDCIHISLHLEMDIKNITCSMKITWYILVLLVFIFLIILTIRKILEGQRRVQKWQSHRDKPTSVLLRGSDSEKLRALNVQVLSAETTQRLPLDQVQEVLPPIPEL

SEQ ID NO: 4788 - protein, 300 aa, unidentified
MLPLLAALLAAACPLPPVRGGAADAPGLLGVPSNASVNASSADEPIAPRLLASAAPGPPERPGPEEAAAAAAPCNISVQRQMLSSLLVRWGRPRGFQCDLLLFSTNAHGRAFFAAAFHRVGPPLLIEHLGLAAGGAQQDLRLCVGCGWVRGRRTGRLRPAAAPSAAAATAGAPTALPAYPAAEPPGPLWLQGEPLHFCCLDFSLEELQGEPGWRLNRKPIESTLVACFMTLVIVVWSVAALIWPVPIIAGFLPNGMEQRRTTASTTAATPAAVPAGTTAAAAAAAAAAAAAAVTSGVATK

SEQ ID NO: 4789 - protein, 161 aa, unidentified
MAKEEPQSISRDLQELQKKLSLLIDSFQNNSKVVAFMKSPVGQYLDSHPFLAFTLLVFIVMSAVPVGFFLLIVVLTTLAALLGVIILEGLVISVGGFSLLCILCGLGFVSLAMSGMMIASYVVVSSLISCWFSPRPLTQQNTSCDFLPAMKSAEFEGLYQE

SEQ ID NO: 4790 - protein, 188 aa, unidentified
MGGGWWWARAARLARLRFRRSLLPPQRPRSGGARGSFAPGHGPRAGASPPPVSELDRADAWLLRKAHETAFLSWFRNGLLASGIGVISFMQSDMGREAAYGFFLLGGLCVVWGSASYAVGLAALRGPMQLTLGGAAVGAGAVLAASLLWACAVGLYMGQLELDVELVPEDDGTASAEGPDEAGRPPPE

SEQ ID NO: 4791 - protein, 479 aa, unidentified
MAVLGVQLVVTLLTATLMHRLAPHCSFARWLLCNGSLFRYKHPSEEELRALAGKPRPRGRKERWANGLSEEKPLSVPRDAPFQLETCPLTTVDALVLRFFLEYQWFVDFAVYSGGVYLFTEAYYYMLGPAKETNIAVFWCLLTVTFSIKMFLTVTRLYFSAEEGGERSVCLTFAFLFLLLAMLVQVVREETLELGLEPGLASMTQNLEPLLKKQGWDWALPVAKLAIRVGLAVVGSVLGAFLTFPGLRLAQTHRDALTMSEDRPMLQFLLHTSFLSPLFILWLWTKPIARDFLHQPPFGETRFSLLSDSAFDSGRLWLLVVLCLLRLAVTRPHLQAYLCLAKARVEQLRREAGRIEAREIQQRVVRVYCYVTVVSLQYLTPLILTLNCTLLLKTLGGYSWGLGPAPLLSPDPSSASAAPIGSGEDEVQQTAARIAGALGGLLTPLFLRGVLAYLIWWTAACQLLASLFGLYFHQHLAGS

SEQ ID NO: 4792 - protein, 487 aa, unidentified
MGVIGIQLVVTMVMASVMQKIIPHYSLARWLLCNGSLRWYQHPTEEELRILAGKQQKGKTKKDRKYNGHIESKPLTIPKDIDLHLETKSVTEVDTLALHYFPEYQWLVDFTVAATVVYLVTEVYYNFMKPTQEMNISLVWCLLVLSFAIKVLFSLTTHYFKVEDGGERSVCVTFGFFFFVKAMAVLIVTENYLEFGLETGFTNFSDSAMQFLEKQGLESQSPVSKLTFKFFLAIFCSFIGAFLTFPGLRLAQMHLDALNLATEKITQTLLHINFLAPLFMVLLWVKPITKDYIMNPPLGKESIPLMTEATFDTLRLWLIILLCALRLAMMRSHLQAYLNLAQKCVDQMKKEAGRISTVELQKMVARVFYYLCVIALQYVAPLVMLLHTTLLLKTLGNHSWGIYPESISTLPVDNSLLSNSVYSELPSAEGKMKVTVTQITVALSSLKNIFTPLLFRGLLSFLTWWIAACLFSTSLFGLFYHQYLTVA

SEQ ID NO: 4793 - protein, 289 aa, unidentified
MEPAAGIQRRSSQGPTVPPPPRGHAPPAAAPGPAPLSSPVREPPQLEEERQVRISESGQFSDGLEDRGLLESSTRLKPHEAQNYRKKALWVSWFSIIVTLALAVAAFTVSVMRYSASAFGFAFDAILDVLSSAIVLWRYSNAAAVHSAHREYIACVILGVIFLLSSICIVVKAIHDLSTRLLPEVDDFLFSVSILSGILCSILAVLKFMLGKVLTSRALITDGFNSLVGGVMGFSILLSAEVFKHDSAVWYLDGSIGVLIGLTIFAYGVKLLIDMVPRVRQTRHYEMFE

SEQ ID NO: 4794 - protein, 258 aa, unidentified
MSRYSYQSLLDWLYGGVDPSFAGNGGPDCAAFLSWQQRLLESVVVLTLALLEILVALRHILRQTKEDGRGSPGSQPEQVTQRPEEGKESLSKNLLLVALCLTFGVEVGFKFATKTVIYLLNPCHLVTMMHLPFELEIYYIQHVMLYVVPIYLLWKGGAYTPEPLSSFRWALLSTGLMFFYHFSVLQILGLVTEVNLNNMLCPAISDPFYGPWYRIWASGHQTLMTMTHGKLVILFSYMAGPLCKYLLDLLRLPAKKID

SEQ ID NO: 4795 - protein, 324 aa, unidentified
MAAAAPGNGRASAPRLLLLFLVPLLWAPAAVRAGPDEDLSHRNKEPPAPAQQLQPQPVAVQGPEPARVEKIFTPAAPVHTNKEDPATQTNLGFIHAFVAAISVIIVSELGDKTFFIAAIMAMRYNRLTVLAGAMLALGLMTCLSVLFGYATTVIPRVYTYYVSTVLFAIFGIRMLREGLKMSPDEGQEELEEVQAELKKKDEEFQRTKLLNGPGDVETGTSITVPQKKWLHFISPIFVQALTLTFLAEWGDRSQLTTIVLAAREDPYGVAVGGTVGHCLCTGLAVIGGRMIAQKISVRTVTIIGGIVFLAFAFSALFISPDSGF

SEQ ID NO: 4796 - protein, 72 aa, unidentified
MSAIFNFQSLLTVILLLICTCAYIRSLAPSLLDRNKTGLLGIFWKCARIGERKSPYVAVCCIVMAFSILFIQ

SEQ ID NO: 4797 - protein, 74 aa, unidentified
MTNVYSLDGILVFGLLFVCTCAYFKKVPRLKTWLLSEKKGVWGVFYKAAVIGTRLHAAVAIACVVMAFYVLFIK

SEQ ID NO: 4798 - protein, 297 aa, unidentified
MEEPTAVEGQVQLPSPHQGSLRKAVAAALALDGESTMGHRKKKRKESRPESIIIYRSDNEKTDEEPGESEGGDQPKEEEGDDFLDYPVDDDMWNLPLDSRYVTLTGTITRGKKKGQMVDIHVTLTEKELQELTKPKESSRETTPEGRMACQMGADRGPHVVLWTLICLPVVFILSFVVSFYYGTITWYNIFLVYNEERTFWHKISYCPCLVLFYPVLIMAMASSLGLYAAVVQLSWSWEAWWQAARDMEKGFCGWLCSKLGLEDCSPYSIVELLESDNISSTLSNKDPIQEVETSTV

SEQ ID NO: 4799 - protein, 198 aa, unidentified
MELPDPVRQRLGNFSRAVFSDSNRTGPESNEGPENEMVSSLALQMSLYFNTYYFPLWWVSSIMMLHMKYSILPDYYKFIVITVIILITLIEAIRLYLGYVGNLQEKVPELAGFWLLSLLLQLPLILFLLFNEGLTNLPLEKAIHIIFTLFLAFQVVAAFLTLRKMVNQLAVRFHLQDFDRLSANRGDMRRMRSCIEEI

SEQ ID NO: 4800 - protein, 144 aa, unidentified
MEREGSGGSGGSAGLLQQILSLKVVPRVGNGTLCPNSTSLCSFPEMWYGVFLWALVSSLFFHVPAGLLALFTLRHHKYGRFMSVSILLMGIVGPITAGILTSAAIAGVYRAAGKEMIPFEALTLGTGQTFCVLVVSFLRILATL

SEQ ID NO: 4801 - protein, 132 aa, unidentified
MKAEGGDHSMINLSVQQVLSLWAHGTVLRNLTEMWYWIFLWALFSSLFVHGAAGVLMFVMLQRHRQGRVISVIAVSIGFLASVTGAMITSAAVAGIYRVAGKNMAPLEALVWGVGQTVLTLIISFSRILATL

SEQ ID NO: 4802 - protein, 324 aa, unidentified
MSPAAAAEPDGDQQDRHVSKLIFCFFVFGAVLLCVGVLLSIFGFQACQYKPLPDCPMVLKVAGPACAVVGLGAVILARSRAQLQLRAGLQRGQQMDPDRAFICGESRQFAQCLIFGFLFLTSGMLISVLGIWVPGCGSNWAQEPLNETDTGDSEPRMCGFLSLQIMGPLIVLVGLCFFVVAHVKKRNTLNAGQDASEREEGQIQIMEPVQVTVGDSVIIFPPPPPPYFPESSASAVAESPGTNSLLPNENPPSYYSIFNYGRTPTSEGAASERDCESIYTISGTNSSSEASHTPHLPSELPPRYEEKENAAATFLPLSSEPSPP

SEQ ID NO: 4803 - protein, 379 aa, unidentified
MPHSSLHPSIPCPRGHGAQKAALVLLSACLVTLWGLGEPPEHTLRYLVLHLASLQLGLLLNGVCSLAEELRHIHSRYRGSYWRTVRACLGCPLRRGALLLLSIYFYYSLPNAVGPPFTWMLALLGLSQALNILLGLKGLAPAEISAVCEKGNFNVAHGLAWSYYIGYLRLILPELQARIRTYNQHYNNLLRGAVSQRLYILLPLDCGVPDNLSMADPNIRFLDKLPQQTGDHAGIKDRVYSNSIYELLENGQRAGTCVLEYATPLQTLFAMSQYSQAGFSREDRLEQAKLFCRTLEDILADAPESQNNCRLIAYQEPADDSSFSLSQEVLRHLRQEEKEEVTVGSLKTSAVPSTSTMSQEPELLISGMEKPLPLRTDFS

SEQ ID NO: 4804 - protein, 243 aa, unidentified
MEQGSGRLEDFPVNVFSVTPYTPSTADIQVSDDDKAGATLLFSGIFLGLVGITFTVMGWIKYQGVSHFEWTQLLGPVLLSVGVTFILIAVCKFKMLSCQLCKESEERVPDSEQTPGGPSFVFTGINQPITFHGATVVQYIPPPYGSPEPMGINTSYLQSVVSPCGLITSGGAAAAMSSPPQYYTIYPQDNSAFVVDEGCLSFTDGGNHRPNPDVDQLEETQLEEEACACFSPPPYEEIYSLPR

SEQ ID NO: 4805 - protein, 235 aa, unidentified
MGTADSDEMAPEAPQHTHIDVHIHQESALAKLLLTCCSALRPRATQARGSSRLLVASWVMQIVLGILSAVLGGFFYIRDYTLLVTSGAAIWTGAVAVLAGAAAFIYEKRGGTYWALLRTLLTLAAFSTAIAALKLWNEDFRYGYSYYNSACRISSSSDWNTPAPTQSPEEVRRLHLCTSFMDMLKALFRTLQAMLLGVWILLLLASLTPLWLYCWRMFPTKGKRDQKEMLEVSGI

SEQ ID NO: 4806 - protein, 270 aa, unidentified
MTQNTVIVNGVAMASRPSQPTHVNVHIHQESALTQLLKAGGSLKKFLFHPGDTVPSTARIGYEQLALGVTQILLGVVSCVLGVCLSLGPWTVLSASGCAFWAGSVVIAAGAGAIVHEKHPGKLAGYISSLLTLAGFATAMAAVVLCVNSFIWQTEPFLYIDTVCDRSDPVFPTTGYRWMRRSQENQWQKEECRAYMQMLRKLFTAIRALFLAVCVLKVIVSLVSLGVGLRNLCGQSSQPLNEEGSEKRLLGENSVPPSPSREQTSTAIVL

SEQ ID NO: 4807 - protein, 311 aa, unidentified
MAGPLWRTAAFVQRHRTGLLVGSCAGLFGVPISYHLFPDPVVQWLYQYWPQGQPAPLPPQLQSLFQEVLQDIGVPSGHCYKPFTTFTFQPVSAGFPRLPAGAVVGIPASFLGDLVINTNHPVVIHGHTVDWRSPAGARLRASLTLSREAQKFALAREVVYLESSTTAVHALLAPACLAGTWALGVGAKYTLGLHAGPMNLRAAFSLVAAVAGFVAYAFSQDSLTHAVESWLDRRTASLSAAYACGGVEFYEKLLSGNLALRSLLGKDGEKLYTPSGNIVPRHLFRIKHLPYTTRRDSVLQMWRGMLNPGRS

SEQ ID NO: 4808 - protein, 297 aa, unidentified
MEPRALVTALSLGLSLCSLGLLVTAIFTDHWYETDPRRHKESCERSRAGADPPDQKNRLMPLSHLPLRDSPPLGRRLLPGGPGRADPESWRSLLGLGGLDAECGRPLFATYSGLWRKCYFLGIDRDIDTLILKGIAQRCTAIKYHFSQPIRLRNIPFNLTKTIQQDEWHLLHLRRITAGFLGMAVAVLLCGCIVATVSFFWEESLTQHVAGLLFLMTGIFCTISLCTYAASISYDLNRLPKLIYSLPADVEHGYSWSIFCAWCSLGFIVAAGGLCIAYPFISRTKIAQLKSGRDSTV

SEQ ID NO: 4809 - protein, 294 aa, unidentified
MAAGRLLLYTGLSLALCALGMLAVAICSDHWYETDARKHRDRCKAFNTRRVDPGFIYNNNNNLPLRASRSRLDRWEGKLLRARNRRQLFAMSPADECSRQYNSTNMGLWRKCHRQGFDPEIAALIRKGEIERCTYIKYHYSSATIPRNLTFNITKTIRQDEWHALHLRRMTAGFMGMAVAIILFGWIIGVLGCCWDRGLMQYVAGLLFLMGGTFCIISLCTCVAGINFELSRYPRYLYGLPDDISHGYGWSMFCAWGGLGLTLISGFFCTLAPSVQPVPRTNYPKSRPENGTVC

SEQ ID NO: 4810 - protein, 233 aa, unidentified
MALNNFLFAQCACYFLAFLFSFVVVVPLSENGHDFRGRCLLFTEGMWLSANLTVQERERFTVQEWGPPAACRFSLLASLLSLLLAAAHAWRTLFFLCKGHEGSFFSAFLNLLVSAFVVFLVFIASTIVSVGFTMWCDTITEKGTVPHSCEELQDIDLELGVDNSAFYDQFAIAQFGLWASWLAWLAITTLAFLKVYHNYRQEDLLDSLIHEKELLLARPSPRTSFQEEKSAVI

SEQ ID NO: 4811 - protein, 219 aa, unidentified
MALSWLQRVELALFAAAFLCGAVAAAAMTRTQGSFSGRCPLYGVATLNGSSLALSRPSAPSLCYFVAGASGLLALYCLLLLLFWIYSSCIEDSHRGAIGLRIALAISAIAVFLVLVSACILRFGTRSLCNSIISLNTTISCSEAQKIPWTPPGTALQFYSNLHNAETSSWVNLVLWCVVLVLQVVQWKSEATPYRPLERGDPEWSSETDALVGSRLSHS

SEQ ID NO: 4812 - protein, 140 aa, unidentified
MPSAFSVSSFPVSIPAVLTQTDWTEPWLMGLATFHALCVLLTCLSSRSYRLQIGHFLCLVILVYCAEYINEAAAMNWRLFSKYQYFDSRGMFISIVFSAPLLVNAMIIVVMWVWKTLNVMTDLKNAQERRKEKKRRRKED

SEQ ID NO: 4813 - protein, 612 aa, unidentified
MGAAPSPTQASSRGGGPGPPAPTRAVSSSSRARGGALSALGPSPARPLTTSPAPAPPPRSRPARQQPDPQCWEKRGGAGGDTKGGAAGPGPGRLRGMDAEYPAFEPPLCSELKHLCRRLREAYRELKEDLTPFKDDRYYRLAPMRLYTLSKRHFVLVFVVFFICFGLTIFVGIRGPKVIQTSAANFSLNNSKKLKPIQILSNPLSTYNQQLWLTCVVELDQSKETSIKTSFPMTVKVDGVAQDGTTMYIHNKVHNRTRTLTCAGKCAEIIVAHLGYLNYTQYTVIVGFEHLKLPIKGMNFTWKTYNPAFSRLEIWFRFFFVVLTFIVTCLFAHSLRKFSMRDWGIEQKWMSVLLPLLLLYNDPFFPLSFLVNSWLPGMLDDLFQSMFLCALLLFWLCVYHGIRVQGERKCLTFYLPKFFIVGLLWLASVTLGIWQTVNELHDPMYQYRVDTGNFQGMKVFFMVVAAVYILYLLFLIVRACSELRHMPYVDLRLKFLTALTFVVLVISIAILYLRFGAQVLQDNFVAELSTHYQNSAEFLSFYGLLNFYLYTLAFVYSPSKNALYESQLKDNPAFSMLNDSDDDVIYGSDYEEMPLQNGQAIRAKYKEESDSD

SEQ ID NO: 4814 - protein, 229 aa, unidentified
MRLNIAIFFGALFGALGVLLFLVAFGSDYWLLATEVGRCSGEKNIENVTFHHEGFFWRCWFNGIVEENDSNIWKFWYTNQPPSKNCTHAYLSPYPFMRGEHNSTSYDSAVIYRGFWAVLMLLGVVAVVIASFLIICAAPFASHFLYKAGGGSYIAAGILFSLVVMLYVIWVQAVADMESYRNMKMKDCLDFTPSVLYGWSFFLAPAGIFFSLLAGLLFLVVGWHIQIHH

SEQ ID NO: 4815 - protein, 376 aa, unidentified
MARGPGPLGRPRPDTVAMPKRGKRLKFRAHDACSGRVTVADYANSDPAVVRSGRVKKAVANAVQQEVKSLCGLEASQVPAEEALSGAGEPCDIIDSSDEMDAQEESIHERTVSRKKKSKRHKEELDGAGGEEYPMDIWLLLASYIRPEDIVNFSLICKNAWTVTCTAAFWTRLYRRHYTLDASLPLRLRPESMEKLRCLRACVIRSLYHMYEPFAARISKNPAIPESTPSTLKNSKCLLFWCRKIVGNRQEPMWEFNFKFKKQSPRLKSKCTGGLQPPVQYEDVHTNPDQDCCLLQVTTLNFIFIPIVMGMIFTLFTINVSTDMRHHRVRLVFQDSPVHGGRKLRSEQGVQVILDPVHSVRLFDWWHPQYPFSLRA

SEQ ID NO: 4816 - protein, 413 aa, unidentified
MSNVSGILETAGVPLVSANWPQPSPPPAVPAGPQMDHMGNSSQGAPWLFLTSALARGVSGIFVWTALVLTCHQIYLHLRSYTVPQEQRYIIRLLLIVPIYAFDSWLSLLLLGDHQYYVYFDSVRDCYEAFVIYSFLSLCFQYLGGEGAIMAEIRGKPIKSSCLYGTCCLRGMTYSIGFLRFCKQATLQFCLVKPVMAVTTIILQAFGKYHDGDFNVRSGYLYVTLIYNASVSLALYALFLFYFTTRELLRPFQPVLKFLTIKAVIFLSFWQGLLLAILERCGVIPEVETSGGNKLGAGTLAAGYQNFIICVEMLFASVALRYAFPCQVYAEKKENSPAPPAPMQSISSGIRETVSPQDIVQDAIHNFSPAYQHYTQQATHEAPRPGTHPSGGSGGSRKSRSLEKRMLIPSEDL

SEQ ID NO: 4817 - protein, 407 aa, unidentified
MTVRGDVLAPDPASPTTAAASPSVSVIPEGSPTAMEQPVFLMTTAAQAISGFFVWTALLITCHQIYMHLRCYSCPNEQRYIVRILFIVPIYAFDSWLSLLFFTNDQYYVYFGTVRDCYEALVIYNFLSLCYEYLGGESSIMSEIRGKPIESSCMYGTCCLWGKTYSIGFLRFCKQATLQFCVVKPLMAVSTVVLQAFGKYRDGDFDVTSGYLYVTIIYNISVSLALYALFLFYFATRELLSPYSPVLKFFMVKSVIFLSFWQGMLLAILEKCGAIPKIHSARVSVGEGTVAAGYQDFIICVEMFFAALALRHAFTYKVYADKRLDAQGRCAPMKSISSSLKETMNPHDIVQDAIHNFSPAYQQYTQQSTLEPGPTWRGGAHGLSRSHSLSGARDNEKTLLLSSDDEF

SEQ ID NO: 4818 - protein, 438 aa, unidentified
MPCTCTWRNWRQWIRPLVAVIYLVSIVVAVPLCVWELQKLEVGIHTKAWFIAGIFLLLTIPISLWVILQHLVHYTQPELQKPIIRILWMVPIYSLDSWIALKYPGIAIYVDTCRECYEAYVIYNFMGFLTNYLTNRYPNLVLILEAKDQQKHFPPLCCCPPWAMGEVLLFRCKLGVLQYTVVRPFTTIVALICELLGIYDEGNFSFSNAWTYLVIINNMSQLFAMYCLLLFYKVLKEELSPIQPVGKFLCVKLVVFVSFWQAVVIALLVKVGVISEKHTWEWQTVEAVATGLQDFIICIEMFLAAIAHHYTFSYKPYVQEAEEGSCFDSFLAMWDVSDIRDDISEQVRHVGRTVRGHPRKKLFPEDQDQNEHTSLLSSSSQDAISIASSMPPSPMGHYQGFGHTVTPQTTPTTAKISDEILSDTIGEKKEPSDKSVDS

SEQ ID NO: 4819 - protein, 350 aa, unidentified
MNPRGLFQDFNPSKFLIYTCLLLFSVLLPLRLDGIIQWSYWAVFAPIWLWKLLVVAGASVGAGVWARNPRYRTEGEACVEFKAMLIAVGIHLLLLMFEVLVCDRVERGTHFWLLVFMPLFFVSPVSVAACVWGFRHDRSLELEILCSVNILQFIFIALKLDRIIHWPWLVVFVPLWILMSFLCLVVLYYIVWSLLFLRSLDVVAEQRRTHVTMAISWITIVVPLLTFEVLLVHRLDGHNTFSYVSIFVPLWLSLLTLMATTFRRKGGNHWWFGIRRDFCQFLLEIFPFLREYGNISYDLHHEDSEDAEETSVPEAPKIAPIFGKKARVVITQSPGKYVPPPPKLNIDMPD

SEQ ID NO: 4820 - protein, 213 aa, unidentified
MAALLRAVRRFRGKAVWERPLHGLWCCSGQEDPKRWVGSSSPISKEKLPNAETEKFWMFYRFDAIRTFGFLSRLKLAQTALTVVALPPGYYLYSQGLLTLNTVCLMSGISGFALTMLCWMSYFLRRLVGILYLNESGTMLRVAHLNFWGWRQDTYCPMADVIPLTETKDRPQEMFVRIQRYSGKQTFYVTLRYGRILDRERFTQVFGVHQMLK

SEQ ID NO: 4821 - protein, 261 aa, unidentified
MNPEWGQAFVHVAVAGGLCAVAVFTGIFDSVSVQVGYEHYAEAPVAGLPAFLAMPFNSLVNMAYTLLGLSWLHRGGAMGLGPRYLKDVFAAMALLYGPVQWLRLWTQWRRAAVLDQWLTLPIFAWPVAWCLYLDRGWRPWLFLSLECVSLASYGLALLHPQGFEVALGAHVVAAVGQALRTHRHYGSTTSATYLALGVLSCLGFVVLKLCDHQLARWRLFQCLTGHFWSKVCDVLQFHFAFLFLTHFNTHPRFHPSGGKTR

SEQ ID NO: 4822 - protein, 270 aa, unidentified
MAGAENWPGQQLELDEDEASCCRWGAQHAGARELAALYSPGKRLQEWCSVILCFSLIAHNLVHLLLLARWEDTPLVILGVVAGALIADFLSGLVHWGADTWGSVELPIVGKAFIRPFREHHIDPTAITRHDFIETNGDNCLVTLLPLLNMAYKFRTHSPEALEQLYPWECFVFCLIIFGTFTNQIHKWSHTYFGLPRWVTLLQDWHVILPRKHHRIHHVSPHETYFCITTGWLNYPLEKIGFWRRLEDLIQGLTGEKPRADDMKWAQKIK

SEQ ID NO: 4823 - protein, 336 aa, unidentified
MTDLNDNICKRYIKMITNIVILSLIICISLAFWIISMTASTYYGNLRPISPWRWLFSVVVPVLIVSNGLKKKSLDHSGALGGLVVGFILTIANFSFFTSLLMFFLSSSKLTKWKGEVKKRLDSEYKEGGQRNWVQVFCNGAVPTELALLYMIENGPGEIPVDFSKQYSASWMCLSLLAALACSAGDTWASEVGPVLSKSSPRLITTWEKVPVGTNGGVTVVGLVSSLLGGTFVGIAYFLTQLIFVNDLDISAPQWPIIAFGGLAGLLGSIVDSYLGATMQYTGLDESTGMVVNSPTNKARHIAGKPILDNNAVNLFSSVLIALLLPTAAWGFWPRG

SEQ ID NO: 4824 - protein, 177 aa, unidentified
MLGCGIPALGLLLLLQGSADGNGIQGFFYPWSCEGDIWDRESCGGQAAIDSPNLCLRLRCCYRNGVCYHQRPDENVRRKHMWALVWTCSGLLLLSCSICLFWWAKRRDVLHMPGFLAGPCDMSKSVSLLSKHRGTKKTPSTGSVPVALSKESRDVEGGTEGEGTEEGEETEGEEEED

SEQ ID NO: 4825 - protein, 271 aa, unidentified
MAAGGRMEDGSLDITQSIEDDPLLDAQLLPHHSLQAHFRPRFHPLPTVIIVNLLWFIHLVFVVLAFLTGVLCSYPNPNEDKCPGNYTNPLKVQTVIILGKVILWILHLLLECYIQYHHSKIRNRGYNLIYRSTRHLKRLALMIQSSGNTVLLLILCMQHSFPEPGRLYLDLILAILALELICSLICLLIYTVKIRRFNKAKPEPDILEEEKIYAYPSNITSETGFRTISSLEEIVEKQGDTIEYLKRHNALLSKRLLALTSSDLGCQPSRT

SEQ ID NO: 4826 - protein, 178 aa, unidentified
MCTSGQIIGSLLVLSVLEIGLGVSSVAVGAVSFSLALREHKPQLGDSSPVWSGVCFLLCGICGILCAKKKSGLVMILFSACCICGLIGGILNFQFLRAVTKKTSSLYPLHLASMSLACIGIGGCTLSSWLTCRLASYEQRRMFSEREHSLHHSHEMAEKEITDNMSNGGPQLIFNGRV

SEQ ID NO: 4827 - protein, 360 aa, unidentified
MPGTVATLRFQLLPPEPDDAFWGAPCEQPLERRYQALPALVCIMCCLFGVVYCFFGYRCFKAVLFLTGLLFGSVVIFLLCYRERVLETQLSAGASAGIALGIGLLCGLVAMLVRSVGLFLVGLLLGLLLAAAALLGSAPYYQPGSVWGPLGLLLGGGLLCALLTLRWPRPLTTLATAVTGAALIATAADYFAELLLLGRYVVERLRAAPVPPLCWRSWALLALWPLLSLMGVLVQWRVTAEGDSHTEVVISRQRRRVQLMRIRQQEDRKEKRRKKRPPRAPLRGPRAPPRPGPPDPAYRRRPVPIKRFNGDVLSPSYIQSFRDRQTGSSLSSFMASPTDADYEYGSRGPLTACSGPPVRV

SEQ ID NO: 4828 - protein, 208 aa, unidentified
MASSLLAGERLVRALGPGGELEPERLPRKLRAELEAALGKKHKGGDSSSGPQRLVSFRLIRDLHQHLRERDSKLYLHELLEGSEIYLPEVVKPPRNPELVARLEKIKIQLANEEYKRITRNVTCQDTRHGGTLSDLGKQVRSLKALVITIFNFIVTVVAAFVCTYLGSQYIFTEMASRVLAALIVASVVGLAELYVMVRAMEGELGEL

SEQ ID NO: 4829 - protein, 1383 aa, unidentified
MYATDSRGHSPAFLQPQNGNSRHPSGYVPGKVVPLRPPPPPKSQASAKFTSIRREDRATFAFSPEEQQAQRESQKQKRHKNTFICFAITSFSFFIALAIILGISSKYAPDENCPDQNPRLRNWDPGQDSAKQVVIKEGDMLRLTSDATVHSIVIQDGGLLVFGDNKDGSRNITLRTHYILIQDGGALHIGAEKCRYKSKATITLYGKSDEGESMPTFGKKFIGVEAGGTLELHGARKASWTLLARTLNSSGLPFGSYTFEKDFSRGLNVRVIDQDTAKILESERFDTHEYRNESRRLQEFLRFQDPGRIVAIAVGDSAAKSLLQGTIQMIQERLGSELIQGLGYRQAWALVGVIDGGSTSCNESVRNYENHSSGGKALAQREFYTVDGQKFSVTAYSEWIEGVSLSGFRVEVVDGVKLNLLDDVSSWKPGDQIVVASTDYSMYQAEEFTLLPCSECSHFQVKVKETPQFLHMGEIIDGVDMRAEVGILTRNIVIQGEVEDSCYAENQCQFFDYDTFGGHIMIMKNFTSVHLSYVELKHMGQQQMGRYPVHFHLCGDVDYKGGYRHATFVDGLSIHHSFSRCITVHGTNGLLIKDTIGFDTLGHCFFLEDGIEQRNTLFHNLGLLTKPGTLLPTDRNNSMCTTMRDKVFGNYIPVPATDCMAVSTFWIAHPNNNLINNAAAGSQDAGIWYLFHKEPTGESSGLQLLAKPELTPLGIFYNNRVHSNFKAGLFIDKGVKTTNSSAADPREYLCLDNSARFRPHQDANPEKPRVAALIDRLIAFKNNDNGAWVRGGDIIVQNSAFADNGIGLTFASDGSFPSDEGSSQEVSESLFVGESRNYGFQGGQNKYVGTGGIDQKPRTLPRNRTFPIRGFQIYDGPIHLTRSTFKKYVPTPDRYSSAIGFLMKNSWQITPRNNISLVKFGPHVSLNVFFGKPGPWFEDCEMDGDKNSIFHDIDGSVTGYKDAYVGRMDNYLIRHPSCVNVSKWNAVICSGTYAQVYVQTWSTQNLSMTITRDEYPSNPMVLRGINQKAAFPQYQPVVMLEKGYTIHWNGPAPRTTFLYLVNFNKNDWIRVGLCYPSNTSFQVTFGYLQRQNGSLSKIEEYEPVHSLEELQRKQSERKFYFDSSTGLLFLYLKAKSHRHGHSYCSSQGCERVKIQAATDSKDISNCMAKAYPQYYRKPSVVKRMPAMLTGLCQGCGTRQVVFTSDPHKSYLPVQFQSPDKAETQRGDPSVISVNGTDFTFRSAGVLLLVVDPCSVPFRLTEKTVFPLADVSRIEEYLKTGIPPRSIVLLSTRGEIKQLNISHLLVPLGLAKPAHLYDKGSTIFLGFSGNFKPSWTKLFTSPAGQGLGVLEQFIPLQLDEYGCPRATTVRRRDLELLKQASKAH

SEQ ID NO: 4830 - protein, 491 aa, unidentified
MIATGGVITGLAALKRQDSARSQQHVNLSPSPATQEKKPIRRRPRADVVVVRGKIRLYSPSGFFLILGVLISIIGIAMAVLGYWPQKEHFIDAETTLSTNETQVIRNEGGVVVRFFEQHLHSDKMKMLGPFTMGIGIFIFICANAILHENRDKETKIIHMRDIYSTVIDIHTLRIKEQRQMNGMYTGLMGETEVKQNGSSCASRLAANTIASFSGFRSSFRMDSSVEEDELMLNEGKSSGHLMPPLLSDSSVSVFGLYPPPSKTTDDKTSGSKKCETKSIVSSSISAFTLPVIKLNNCVIDEPSIDNITEDADNLKSRSRNLSMDSLVVPLPNTSESFQPVSTVLPRNNSIGESLSSQYKSSMALGPGAGQLLSPGAARRQFGSNTSLHLLSSHSKSLDLDRGPSTLTVQAEQRKHPSWPRLDRNNSKGYMKLENKEDPMDRLLVPQVAIKKDFTNKEKLLMISRSHNNLSFEHDEFLSNNLKRGTSETRF

SEQ ID NO: 4831 - protein, 307 aa, unidentified
MTAGSPEECGEVRRSPEGRVSRLGRRLGRRRRPRSPPEPLRVRARLRLRSPSGAFAALGALVVLVGMGIAVAGYWPHRAGAPGSRAANASSPQMSELRREGRGGGRAHGPHERLRLLGPVIMGVGLFVFICANTLLYENRDLETRRLRQGVLRAQALRPPDGPGWDCALLPSPGPRSPRAVGCAEPEIWDPSPRRGTSPVPSVRSLRSEPANPRLGLPALLNSYPLKGPGLPPPWGPRTQTGHVIITVQPSGSCIEHSKSLDLGLGELLLGAPAARDCAHRSWPRLDRLSLGGYAKLGGGGDLGARV

SEQ ID NO: 4832 - protein, 621 aa, unidentified
MIATGGLLRISARKQDPLRPPSQIPKRKRKAKKRRKNDVVVVKGKLKLCSISGLIALCGILVLLVGIAMAVVGYWPKATGTNREGGKQLPPAGSSHRVPTTANSSSSGSKNRSRSHPRAPGGVNSSSAGAPRSTPPARAASPSSSSTSVGFFFRIFSGYLHSDKLKVFGPLIMGIGIFLFICANAVLHENRDKKTKIINLRDLYSTVIDVHSLRAKDLAAAAAAAAAAAASSSSSAPAAAPPGAIPLNGFLSYVQSRGLELKPGGCGGSGDAFGAAAMLAKGSWPPHPAAPSGGRPRGAASPPDLASSPRCPREPPSLAEAVYSVYRERSGVAGSRRAAAATAAAAASSCSSPAPCSPPESWGRQSTASSFVDSSLSAFALLPLQGGRDRGGDAEGASCSWQRPPGERGSQEIPRGELDLSMTNLRGAEGSMRGARREPEEPEGAVAARAARGQGGRLPRTGRYAALRRRSTSGLPDYRAPPSPEPPPSPGSADPDSSPLAKAASPSPPLRLEGSPPTRRDSGSSQSDDPSSSNKGYTPLREAGTSTESVLDAVAGQTRDSAVAAPVLGAEQSSPEGASQEPPTAEQPQPVQRQFTNKEKLIMISRSHAIGVEEELESTGI

SEQ ID NO: 4833 - protein, 666 aa, unidentified
MEGVSALLARCPTAGLAGGLGVTACAAAGVLLYRIARRMKPTHTMVNCWFCNQDTLVPYGNRNCWDCPHCEQYNGFQENGDYNKPIPAQYLEHLNHVVSSAPSLRDPSQPQQWVSSQVLLCKRCNHHQTTKIKQLAAFAPREEGRYDEEVEVYRHHLEQMYKLCRPCQAAVEYYIKHQNRQLRALLLSHQFKRREADQTHAQNFSSAVKSPVQVILLRALAFLACAFLLTTALYGASGHFAPGTTVPLALPPGGNGSATPDNGTTPGAEGWRQLLGLLPEHMAEKLCEAWAFGQSHQTGVVALGLLTCLLAMLLAGRIRLRRIDAFCTCLWALLLGLHLAEQHLQAASPSWLDTLKFSTTSLCCLVGFTAAVATRKATGPRRFRPRRFFPGDSAGLFPTSPSLAIPHPSVGGSPASLFIPSPPSFLPLANQQLFRSPRRTSPSSLPGRLSRALSLGTIPSLTRADSGYLFSGSRPPSQVSRSGEFPVSDYFSLLSGSCPSSPLPSPAPSVAGSVASSSGSLRHRRPLISPARLNLKGQKLLLFPSPPGEAPTTPSSSDEHSPHNGSLFTMEPPHVPRKPPLQDVKHALDLRSKLERGSACSNRSIKKEDDSSQSSTCVVDTTTRGCSEEAATWRGRFGPSLVRGLLAVSLAANALFTSVFLYQSLR

SEQ ID NO: 4834 - protein, 273 aa, unidentified
MERREHLTLTFHSPEVPKIKGNRKYQRPTVPAKKHPSASMSCQRQQQLMDQAHIYIRTLCGSLCSFSLLMLIAMSPLNWVQFLVIKNGLELYAGLWTLCNHELCWSHTPKPPYYLQYSRAFFLISVFTILTGLGWLFSSWILNRGSMTTNLDLKVSMLSFISATCLLLCLNLFVAQVHWHTRDAMESDLLWTYYLNWCSDIFYMFAGIISLLNYLTSRSPACDENVTVIPTERSRLGVGPVTTVSPAKDEGPRSEMESLSVREKNLPKSGLWW

SEQ ID NO: 4835 - protein, 136 aa, unidentified
MLFSLRELVQWLGFATFEIFVHLLALLVFSVLLALRVDGLVPGLSWWNVFVPFFAADGLSTYFTTIVSVRLFQDGEKRLAVLRLFWVLTVLSLKFVFEMLLCQKLAEQTRELWFGLITSPLFILLQLLMIRACRVN

SEQ ID NO: 4836 - protein, 226 aa, unidentified
MTVQRLVAAAVLVALVSLILNNVAAFTSNWVCQTLEDGRRRSVGLWRSCWLVDRTRGGPSPGARAGQVDAHDCEALGWGSEAAGFQESRGTVKLQFDMMRACNLVATAALTAGQLTFLLGLVGLPLLSPDAPCWEEAMAAAFQLASFVLVIGLVTFYRIGPYTNLSWSCYLNIGACLLATLAAAMLIWNILHKREDCMAPRVIVISRSLTARFRRGLDNDYVESPC

SEQ ID NO: 4837 - protein, 189 aa, unidentified
MEEGGNLGGLIKMVHLLVLSGAWGMQMWVTFVSGFLLFRSLPRHTFGLVQSKLFPFYFHISMGCAFINLCILASQHAWAQLTFWEASQLYLLFLSLTLATVNARWLEPRTTAAMWALQTVEKERGLGGEVPGSHQGPDPYRQLREKDPKYSALRQNFFRYHGLSSLCNLGCVLSNGLCLAGLALEIRSL

SEQ ID NO: 4838 - protein, 350 aa, unidentified
MIRQERSTSYQELSEELVQVVENSELADEQDKETVRVQGPGILPGLDSESASSSIRFSKACLKNVFSVLLIFIYLLLMAVAVFLVYRTITDFREKLKHPVMSVSYKEVDRYDAPGIALYPGQAQLLSCKHHYEVIPPLTSPGQPGDMNCTTQRINYTDPFSNQTVKSALIVQGPREVKKRELVFLQFRLNKSSEDFSAIDYLLFSSFQEFLQSPNRVGFMQACESAYSSWKFSGGFRTWVKMSLVKTKEEDGREAVEFRQETSVVNYIDQRPAAKKSAQLFFVVFEWKDPFIQKVQDIVTANPWNTIALLCGAFLALFKAAEFAKLSIKWMIKIRKRYLKRRGQATSHIS

SEQ ID NO: 4839 - protein, 146 aa, unidentified
MSRSRLFSVTSAISTIGILCLPLFQLVLSDLPCEEDEMCVNYNDQHPNGWYIWILLLLVLVAALLCGAVVLCLQCWLRRPRIDSHRRTMAVFAVGDLDSIYGTEAAVSPTVGIHLQTQTPDLYPVPAPCFGPLGSPPPYEEIVKTT

SEQ ID NO: 4840 - protein, 173 aa, unidentified
MAPKGKVGTRGKKQIFEENRETLKFYLRIILGANAIYCLVTLVFFYSSASFWAWLALGFSLAVYGASYHSMSSMARAAFSEDGALMDGGMDLNMEQGMAEHLKDVILLTAIVQVLSCFSLYVWSFWLLAPGRALYLLWVNVLGPWFTADSGTPAPEHNEKRQRRQERRQMKRL

SEQ ID NO: 4841 - protein, 561 aa, unidentified
MMQGEAHPSASLIDRTIKMRKETEARKVVLAWGLLNVSMAGMIYTEMTGKLISSYYNVTYWPLWYIELALASLFSLNALFDFWRYFKYTVAPTSLVVSPGQQTLLGLKTAVVQTTPPHDLAATQIPPAPPSPSIQGQSVLSYSPSRSPSTSPKFTTSCMTGYSPQLQGLSSGGSGSYSPGVTYSPVSGYNKLASFSPSPPSPYPTTVGPVESSGLRSRYRSSPTVYNSPTDKEDYMTDLRTLDTFLRSEEEKQHRVKLGSPDSTSPSSSPTFWNYSRSMGDYAQTLKKFQYQLACRSQAPCANKDEADLSSKQAAEEVWARVAMNRQLLDHMDSWTAKFRNWINETILVPLVQEIESVSTQMRRMGCPELQIGEASITSLKQAALVKAPLIPTLNTIVQYLDLTPNQEYLFERIKELSQGGCMSSFRWNRGGDFKGRKWDTDLPTDSAIIMHVFCTYLDSRLPPHPKYPDGKTFTSQHFVQTPNKPDVTNENVFCIYQSAINPPHYELIYQRHVYNLPKGRNNMFHTLLMFLYIIKTKESGMLGRVNLGLSGVNILWIFGE

SEQ ID NO: 4842 - protein, 147 aa, unidentified
MAPGPWPVSCLRGGPLGLTYLSLLLIPAAAGTYCECSLGLSREALIALLVVLAGISASCFCALVIVAIGVLRAKGETCPRQVDNRLVENFGVQEDLMDLHPVYVESQLMDADLEVSLVPPLEDQSLVAIPMEASSEEPPPPPPLPPE

SEQ ID NO: 4843 - protein, 200 aa, unidentified
MLSSVWVALGLSLTCTSAFSLISPAWFQTPTFSFGILTYCSWPQGNSWNQSCVTFSSLEDIPDFAWKVSAVMLLGGWLLLAFNAIFLLSWAVAPKGLCPRRSSVPMPGVQAVAATAMIVGLLIFPIGLASPFIKEVCEASSMYYGGKCRLGWGYMTAILNAVLASLLPIISWPHTTKVQGRTIIFSSATERIIFVPEMNK

SEQ ID NO: 4844 - protein, 194 aa, unidentified
MKGLYQAAGRILVTLGILSVCSGVIAFFPVFSYKPWFTGWSVRIACPIWNGALAITTGVLLLLAYREWTQRYLGEATFTFVILSIMGCPLHFAIALESALLGPYCFYSFSGIAGTNYLGYAVTFPYPYAKFPLACVDPPHYEEYHLTLQALDLCLSFTLLCTSLTVFIKLSARLIQNGHINMQLPAGNPNPFSP

SEQ ID NO: 4845 - protein, 107 aa, unidentified
MQRLPAATRATLILSLAFASLHSACSAEASSSNSSSLTAHHPDPGTLEQCLNVDFCPQAARCCRTGVDEYGWIAAAVGWSLWFLTLILLCVDKLMKLTPDEPKDLQA

SEQ ID NO: 4846 - protein, 689 aa, unidentified
MATKTAGVGRWEVVKKGRRPGVGAGAGGRGGGRNRRALGEANGVWKYDLTPAIQTTSTLYERGFENIMKRQNKEQVPPPAVEPKKPGNKKQPKKVATPPNQNQKQGRFRSLEEALKALDVADLQKELDKSQSVFSGNPSIWLKDLASYLNYKLQAPLSEPTLSQHTHDYPYSLVSRELRGIIRGLLAKAAGSLELFFDHCLFTMLQELDKTPGESLHGYRICIQAILQDKPKIATANLGKFLELLRSHQSRPAKCLTIMWALGQAGFANLTEGLKVWLGIMLPVLGIKSLSPFAITYLDRLLLMHPNLTKGFGMIGPKDFFPLLDFAYMPNNSLTPSLQEQLCQLYPRLKVLAFGAKPDSTLHTYFPSFLSRATPSCPPEMKKELLSSLTECLTVDPLSASVWRQLYPKHLSQSSLLLEHLLSSWEQIPKKVQKSLQETIQSLKLTNQELLRKGSSNNQDVVTCDMACKGLLQQVQGPRLPWTRLLLLLLVFAVGFLCHDLRSHSSFQASLTGRLLRSSGFLPASQQACAKLYSYSLQGYSWLGETLPLWGSHLLTVVRPSLQLAWAHTNATVSFLSAHCASHLAWFGDSLTSLSQRLQIQLPDSVNQLLRYLRELPLLFHQNVLLPLWHLLLEALAWAQEHCHEACRGEVTWDCMKTQLSEAVHWTWLCLQDITVAFLDWALALISQQ

SEQ ID NO: 4847 - protein, 235 aa, unidentified
MRPDDINPRTGLVVALVSVFLVFGFMFTVSGMKGETLGNIPLLAIGPAICLPGIAAIALARKTEGCTKWPENELLWVRKLPCFRKPKDKEVVELLRTPSDLESGKGSSDELAKKAGLRGKPPPQSQGEVSVASSINSPTPTEEGECQSLVQNGHQEETSRYLDGYCPSGSSLTYSALDVKCSARDRSECPEPEDSIFFVPQDSIIVCSYKQNSPYDRYCCYINQIQGRWDHETIV

SEQ ID NO: 4848 - protein, 145 aa, unidentified
MLPRGLKMAPRGKRLSSTPLEILFFLNGWYNATYFLLELFIFLYKGVLLPYPTANLVLDVVMLLLYLGIEVIRLFFGTKGNLCQRKMPLSISVALTFPSAMMASYYLLLQTYVLRLEAIMNGILLFFCGSELLLEVLTLAAFSRI

SEQ ID NO: 4849 - protein, 229 aa, unidentified
MKQQQWCGMTAKMGTVLSGVFTIMAVDMYLIFEQKHLGNGSCTEITPKYRGASNIINNFIICWSFKIVLFLSFITILISCFLLYSVYAQIFRGLVIYIVWIFFYETANVVIQILTNNDFDIKEVRIMRWFGLVSRTVMHCFWMFFVINYAHITYKNRSQGNIISYKRRISTAEILHSRNKRLSISSGFSGSHLESQYFERQSFHTSIFTCLSPVPSSAPSTCRYTIDVC

SEQ ID NO: 4850 - protein, 115 aa, unidentified
MAGTVLGVGAGVFILALLWVAVLLLCVLLSRASGAARFSVIFLFFGAVIITSVLLLFPRAGEFPAPEVEVKIVDDFFIGRYVLLAFLSAIFLGGLFLVLIHYVLEPIYAKPLHSY

SEQ ID NO: 4851 - protein, 240 aa, unidentified
MGNCQAGHNLHLCLAHHPPLVCATLILLLLGLSGLGLGSFLLTHRTGLRSPDIPQDWVSFLRSFGQLTLCPRNGTVTGKWRGSHVVGLLTTLNFGDGPDRNKTRTFQATVLGSQMGLKGSSAGQLVLITARVTTERTAGTCLYFSAVPGILPSSQPPISCSEEGAGNATLSPRMGEECVSVWSHEGLVLTKLLTSEELALCGSRLLVLGSFLLLFCGLLCCVTAMCFHPRRESHWSRTRL

SEQ ID NO: 4852 - protein, 130 aa, unidentified
MAPALWRACNGLMAAFFALAALVQVVYTIPAVLTLLVGLNPEVTGNVIWKSISAIHILFCTVWAVGLASYLLHRTQQNILHEEEGRNPVGGRIQLAIAIVITLFPFISWVYIYINKEMRSSWPTHCKTVI

SEQ ID NO: 4853 - protein, 291 aa, unidentified
MARSYGGRVLAAMTLLGIAAAVLAALGAQLLFQLQAGRAELRGLRAEGLGQELGAGPGLPEDAAGTLLPLAAALAALVLVLGFTCLLLAALCGHLGAELARGPGPRRSDWFLYDCRLLRHVALGLFCCGISVYLAALSIYALLLFEIETGAAAASILGSGTLVLVAVLTHTLLRAARAARRGLHELSPPSFEDDLARPAEVSKASPRAQPQQGIHRRTPYSTCPEPGDPFGSMATATAPAALEGGWESSLPASRMHRTLSAGLGHWDGVTHEMRRMLGHRPGSMGKDSTLV

SEQ ID NO: 4854 - protein, 208 aa, unidentified
MAEAEGSSLLLLPPPPPPPRMAEVEAPTAAETDMKQYQGSGGVAMDVERSRFPYCVVWTPIPVLTWFFPIIGHMGICTSTGVIRDFAGPYFVSEDNMAFGKPAKYWKLDPAQVYASGPNAWDTAVHDASEEYKHRMHNLCCDNCHSHVALALNLMRYNNSTNWNMVTLCFFCLLYGKYVSVGAFVKTWLPFILLLGIILTVSLVFNLR

SEQ ID NO: 4855 - protein, 202 aa, unidentified
MAAPWRRWPTGLLAVLRPLLTCRPLQGTTLQRDVLLFEHDRGRFFTILGLFCAGQGVFWASMAVAAVSRPPVPVQPLDAEVPNRGPFDLRSALWRYGLAVGCGAIGALVLGAGLLFSLRSVRSVVLRAGGQQVTLTTHAPFGLGAHFTVPLKQVSCMAHRGEVPAMLPLKVKGRRFYFLLDKTGHFPNTKLFDNTVGAYRSL

SEQ ID NO: 4856 - protein, 225 aa, unidentified
MVHVSNRSIQGMNILFSSWAVVLMVMGITLDKWVELISEDERAKMNHSPWMMCCPALWPEDDLKVVRIMMTSSLGLSFLLNLILGMKFTYLIPQNKYIQLFTTILSFFSGISLLWALILYHNKLKQGQSMHFSNYRITWIMYTAYLNVFFLSVCGVLSLLECKLSTSSCTCLNIHKSDNECKESENSIEDISLPECTAMPRSIVRAHTVNSLNKKVQTRHVTWAL

SEQ ID NO: 4857 - protein, 380 aa, unidentified
MAGSDVDSEGPARRGGAARRPGAPGGPGSEAAAGCPEPLSTAEAPAESATLPAWMRLYFYGMHGITLDVLVSSARRFARSPDLRMLGFSSPYRCLLHSLTHFALEKVYLQQRRCPNAFVFNFLLYPSAHVGLQTLAGQALLLSLGGGAGVAVAPGALDLALQYVLALYHCQVFLKRFLRLRYGRQRRRQQQQQQQQQQQQRRGALPVPPGARVPTAAGARRRRPRGPRGAGGAPSQGLPDLPRFLFFGMHGFLDEIFFTFFFNVLGQGDGTTSGHTSLWSFFMYGSCSFVVEKLYFHLHYSRGWGTWKRVPIYVIFIYVWELSWGLGLRTCGACSWDYSHYPLNFMGLITLMYLPGWIFLSVYQDLISNVLWRVQYVPAN

SEQ ID NO: 4858 - protein, 167 aa, unidentified
MASAEPLTALSRWYLYAIHGYFCEVMFTAAWEFVVNLNWKFPGVTSVWALFIYGTSILIVERMYLRLRGRCPLLLRCLIYTLWTYLWEFTTGFILRQFNACPWDYSQFDFDFMGLITLEYAVPWFCGALIMEQFIIRNTLRLRFDKDAEPGEPSGALALANGHVKTD

SEQ ID NO: 4859 - protein, 120 aa, unidentified
MMPSRTNLATGIPSSKVKYSRLSSTDDGYIDLQFKKTPPKIPYKAIALATVLFLIGAFLIIIGSLLLSGYISKGGADRAVPVLIIGILVFLPGFYHLRIAYYASKGYRGYSYDDIPDFDD

SEQ ID NO: 4860 - protein, 316 aa, unidentified
MALYELFSHPVERSYRAGLCSKAALFLLLAAALTYIPPLLVAFRSHGFWLKRSSYEEQPTVRFQHQVLLVALLGPESDGFLAWSTFPAFNRLQGDRLRVPLVSTREEDRNQDGKTDMLHFKLELPLQSTEHVLGVQLILTFSYRLHRMATLVMQSMAFLQSSFPVPGSQLYVNGDLRLQQKQPLSCGGLDARYNISVINGTSPFAYDYDLTHIVAAYQERNVTTVLNDPNPIWLVGRAADAPFVINAIIRYPVEVISYQPGFWEMVKFAWVQYVSILLIFLWVFERIKIFVFQNQVVTTIPVTVTPRGDLCKEHLS

SEQ ID NO: 4861 - protein, 657 aa, unidentified
MNMPVNKSPMINTCGGISSPYHEELWKLNFQHLSGERGHKSRPTFSITKEFILRFNQTQNSKEKEELLELARKIILRCKRKLGLKTLGSGRHVHLPAAWTEVIYLAQCKGEIQDESLNMLYASLDHASFDYDHLPALFFVAESVLYRLCCDASLKTYLYSVEIKLAKIGYLVFLRLFIFFLHGHLESFKQHLLRLQPYLYALSFSGASYHKYPNIFSNVQFILKASEIIGKRELRSESIFRPVEDKKRYENTDSDMGGYEINHLLWHCVAAWSCVQNNSPQLNNVLEHLVFHKTQLQKKCWLDSVLALLVLGEAAKLNMACLKALMDVVRDFVSSIMSVQNQEESCKVDDFSWAWNVVYIYTVILAEICLYAATSDLRKTALIGFCHCKSSQKNILYLDKSVPPELKETSILSLLEYFSSKMSENCDQVVWTGYYGLVYNLVKISWELQGDEEQDGLRNMIWQTLQKTKDYEEDVRIQNAINIAQAELNDPTDPFTRYSTNISSNVGEEVFSKYIGWRIANTLSKLFFPPIEAHFLPLKKPSIKKDQTKYPNKKLESVKKQVLHFTVREHPSVSEIPMFPYPDFFTKADKELAKIIDHHWQEELKIREKEDAICKAQELKDKKLAEKNHFQEVMKKREEKLHKQTKPYELPYRKEVI

SEQ ID NO: 4862 - protein, 109 aa, unidentified
MSQYAPSPDFKRALDSSPEANTEDDKTEEDVPMPKNYLWLTIVSCFCPAYPINIVALVFSIMSLNSYNDGDYEGARRLGRNAKWVAIASIIIGLLIIGISCAVHFTRNA

SEQ ID NO: 4863 - protein, 164 aa, unidentified
MAASLGQVLALVLVAALWGGTQPLLKRASAGLQRVHEPTWAQQLLQEMKTLFLNTEYLMPFLLNQCGSLLYYLTLASTDLTLAVPICNSLAIIFTLIVGKALGEDIGGKRAVAGMVLTVIGISLCITSSVPWTAELQLHGKGQLQTLSQKCKREASGTQSERFG

SEQ ID NO: 4864 - protein, 223 aa, unidentified
MARLGALLLAAALGALLSFALLAAAVASDYWYILEVADAGNGSAWPGRAELLSSHSGLWRICEGQNGCIPLVDPFASESLDVSTSVQHLILLHRAVIVVLPLSLVLLVCGWICGLLSSLAQSVSLLLFTGCYFLLGSVLTLAGVSIYISYSHLAFAETVQQYGPQHMQGVRVSFGWSMALAWGSCALEAFSGTLLLSAAWTLSLSPPICGHLSPQQVGGRGGD

SEQ ID NO: 4865 - protein, 351 aa, unidentified
MASGRLIKFVVFELLEFAAFSIPTLVITEQFATAYQGTRARSDNTHYWLIISCSIAYVALVTLLIWVPVKVILHKKRYIYRKIKGWRPVLMMCVVLTTLPCLTFSIAVTEVQKSINGSADVLPDMLPDLPVSLVLLSLIMVDIIEKLRIYPLRGSQKSSENGHIHSTSLQHIKTVTEQVRQSPENAASPQATNSTQVSQPSGAMTRSQESVFMGPQEPSCDSGILRMMSRRDVRAELFLWSFLLWSDTIEMVRVAGHPNVYKSSWLYPVYIFSFISLLRITFTPQNPLLNSLSVLLQDLPFVFVRLGLIIALGTITPVLGLCKNILVTLSYIYFNYLTRIRIFSAFEMSPF

SEQ ID NO: 4866 - protein, 408 aa, unidentified
MRTDSGARLEEGHLRPPRALPPVPSQDDIPLSRPKKKKPRTKNTPASASLEGLAQTAGRRPSEGNEPSTKELKEHPEAPVQRRQKKTRLPLELETSSTQKKSSSSSLLRNENGIDAEPAEEAVIQKPRRKTKKTQPAELQYANELGVEDEDIITDEQTTVEQQSVFTAPTGISQPVGKVFVEKSRRFQAADRSELIKTTENIDVSMDVKPSWTTRDVALTVHRAFRMIGLFSHGFLAGCAVWNIVVIYVLAGDQLSNLSNLLQQYKTLAYPFQSLLYLLLALSTISAFDRIDFAKISVAIRNFLALDPTALASFLYFTALILSLSQQMTSDRIHLYTPSSVNGSLWEAGIEEQILQPWIVVNLVVALLVGLSWLFLSYRPGMDLSEELMFSSEVEEYPDKEKEIKASS

SEQ ID NO: 4867 - protein, 176 aa, unidentified
MAAAPAVCASQGSPPGAPSAPAAAPAPAAGLGRCRMALLLAVALDVAGMAALLTGVFAQLQVRGRDFGDLLIYSGALLVFLSLLGWILWYTGNIEISRQELERDYGLRPSALARLARKLSRRWSAPAAAGQRPAPGSRRARRAARAPPPPAAGSRRVRLQLATLEAGPGAAGAGSE

SEQ ID NO: 4868 - protein, 195 aa, unidentified
MRVGTWICLPGRPGRCRKQHDLGNCPEVPGIFKTLALSPGAPDMMQQPRVETDTIGAGEGPQQAVPWSAWVTRHGWVRWWVSHMPPSWIQWWSTSNWRQPLQRLLWGLEGILYLLLALMLCHALFTTGSHLLSSLWPVVAAVWRHLLPALLLLVLSALPALLFTASFLLLFSTLLSLVGLLTSMTHPGDTQDLDQ

SEQ ID NO: 4869 - protein, 173 aa, unidentified
MSMSANTMIFMILGASVVMAIACLMDMNALLDRFHNYILPHLRGEDRVCHCNCGRHHIHYVIPYDGDQSVVDASENYFVTDSVTKQEIDLMLGLLLGFCISWFLVWMDGVLHCAVRAWRAGRRYDGSWTWLPKLCSLRELGRRPHRPFEEAAGNMVHVKQKLYHNGHPSPRHL

SEQ ID NO: 4870 - protein, 296 aa, unidentified
MCVRRSLVGLTFCTCYLASYLTNKYVLSVLKFTYPTLFQGWQTLIGGLLLHVSWKLGWVEINSSSRSHVLVWLPASVLFVGIIYAGSRALSRLAIPVFLTLHNVAEVIICGYQKCFQKEKTSPAKICSALLLLAAAGCLPFNDSQFNPDGYFWAIIHLLCVGAYKILQKSQKPSALSDIDQQYLNYIFSVVLLAFASHPTGDLFSVLDFPFLYFYRFHGSCCASGFLGFFLMFSTVKLKNLLAPGQCAAWIFFAKIITAGLSILLFDAILTSATTGCLLLGALGEALLVFSERKSS

SEQ ID NO: 4871 - protein, 141 aa, unidentified
METAGAATGQPASGLEAPGSTNDRLFLVKGGIFLGTVAAAGMLAGFITTLSLAKKKSPEWFNKGSMATAALPESGSSLALRALGWGSLYAWCGVGVISFAVWKALGVHSMNDFRSKMQSIFPTIPKNSESAVEWEETLKSK

SEQ ID NO: 4872 - protein, 118 aa, unidentified
MEDFATRTYGTSGLDNRPLFGETSAKDRIINLVVGSLTSLLILVTLISAFVFPQLPPKPLNIFFAVCISLSSITACILIYWYRQGDLEPKFRKLIYYIIFSIIMLCICANLYFHDVGR

SEQ ID NO: 4873 - protein, 128 aa, unidentified
MALQVRVAPSKVVLQKFLLCVILFYTVYYVSLSMGCVMFEVHELNVLAPFDFKTNPSWLNINYKVLLVSTEVTYFVCGLFFVPVVEEWVWDYAISVTILHVAITSTVMLEFPLTSHWWAALGISKLLV

SEQ ID NO: 4874 - protein, 879 aa, unidentified [sequence omitted]

SEQ ID NO: 4875 - protein, 403 aa, unidentified
MSTSTSPAAMLLRRLRRLSWGSTAVQLFILTVVTFGLLAPLACHRLLHSYFYLRHWHLNQMSQEFLQQSLKEGEAALHYFEELPSANGSVPIVWQATPRPWLVITIITVDRQPGFHYVLQVVSQFHRLLQQCGPQCEGHQLFLCNVERSVSHFDAKLLSKYVPVANRYEGTEDDYGDDPSTNSFEKEKQDYVYCLESSLQTYNPDYVLMVEDDAVPEEQIFPVLEHLLRARFSEPHLRDALYLKLYHPERLQHYINPEPMRILEWVGVGMLLGPLLTWIYMRFASRPGFSWPVMLFFSLYSMGLVELVGRHYFLELRRLSPSLYSVVPASQCCTPAMLFPAPAARRTLTYLSQVYCHKGFGKDMALYSLLRAKGERAYVVEPNLVKHIGLFSSLRYNFHPSLL

SEQ ID NO: 4876 - protein, 219 aa, unidentified
MAAEDREMMEARGAGESCPTFPKMVPGDSKSEGKPRAYLEAESQKPDSSYDYLEEMEACEDGGCQGPLKSLSPKSCRATKGQAGDGPKPAELPPTPGTERNPEMELEKVRMEFELTRLKYLHEKNQRQRQHEVVMEQLQRERQHEVVMEQLQQEAAPRLFSGGLQNFLLPQNQFAMFLYCFIFIHIIYVTKEMVFFLFAKHYLFCIAAILLCLIKTFWS

SEQ ID NO: 4877 - protein, 314 aa, unidentified
MFSINPLENLKVYISSRPPLVVFMISVSAMAIAFLTLGYFFKIKEIKSPEMAEDWNTFLLRFNDLDLCVSENETLKHLTNDTTTPESTMTSGQARASTQSPQALEDSGPVNISVSITLTLDPLKPFGGYSRNVTHLYSTILGHQIGLSGREAHEEINITFTLPTAWSSDDCALHGHCEQVVFTACMTLTASPGVFPVTVQPPHCVPDTYSNATLWYKIFTTARDANTKYAQDYNPFWCYKGAIGKVYHALNPKLTVIVPDDDRSLINLHLMHTSYFLFVMVITMFCYAVIKGRPSKLRQSNPEFCPEKVALAEA

SEQ ID NO: 4878 - protein, 366 aa, unidentified
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGLLATRVEVPLLGIVVAAGLALGTLVGFSTLVACLVCRKEKKTKGPSRHPSLISSDSNNLKLNNVRLPRENMSLPSNLQLNDLTPDSRAVKPADRQMAQNNSRPELLDPEPGGLLTSQGFIRLPVLGYIYRVSSVSSDEIWL

SEQ ID NO: 4879 - protein, 163 aa, unidentified
MPKPPDYSELSDSLTLAVGTGRFSGPLHRAWRMMNFRQRMGWIGVGLYLLASAAAFYYVFEISETYNRLALEHIQQHPEEPLEGTTWTHSLKAQLLSLPFWVWTVIFLVPYLQMFLFLYSCTRADPKTVGYCIIPICLAVICNRHQAFVKASNQISRLQLIDT

SEQ ID NO: 4880 - protein, 170 aa, unidentified
MQNRTGLILCALALLMGFLMVCLGAFFISWGSIFDCQGSLIAAYLLLPLGFVILLSGIFWSNYRQVTESKGVLRHMLRQHLAHGALPVATVDRPDFYPPAYEESLEVEKQSCPAEREASGIPPPLYTETGLEFQDGNDSHPEAPPSYRESIAGLVVTAISEDAQRRGQEC

SEQ ID NO: 4881 - protein, 217 aa, unidentified
MEDRAGEQEQERHSLRLEKLQHWARHRQSGHLLVLAVSQLWLAVVVVPLAVSVACLNSDCHMATALPLGPGASGLLTGTVTLELRRAPRLWKVRAMMIFNTFNLILGFIVVVVEVMKTALGPAPTASSQHAGLLVLELSAEAFTLGGVLVSVHALFLLSQRKPGCCRSQSLHYQELQEGFSELEEVPGLENGPTVASTGANERVGQREQTRAALLPP

SEQ ID NO: 4882 - protein, 123 aa, unidentified
MATAAGATYFQRGSLFWFTVITLSFGYYTWVVFWPQSIPYQNLGPLGPFTQYLVDHHHTLLCNGYWLAWLIHVGESLYAIVLCKHKGITSGRAQLLWFLQTFFFGIASLTILIAYKRKRQKQT

SEQ ID NO: 4883 - protein, 349 aa, unidentified
MHQSLTQQRSSDMSLPDSMGAFNRRKRNSIYVTVTLLIVSVLILTVGLAATTRTQNVTVGGYYPGVILGFGSFLGIIGSNLIENKRQMLVASIVFISFGVIAAFCCAIVDGVFAARHIDLKPLYANRCHYVPKTSQKEAEEVISSSTKNSPSTRVMRNLTQAAREVNCPHLSREFCTPRIRGNTCFCCDLYNCGNRVEITGGYYEYIDVSSCQDIIHLYHLLWSATILNIVGLFLGIITAAVLGGFKDMNPTLPALNCSVENTHPTVSYYAHPQVASYNTYYHSPPHLPPYSAYDFQHSGVFPSSPPSGLSDEPQSASPSPSYMWSSSAPPRYSPPYYPPFEKPPPYSP

SEQ ID NO: 4884 - protein, 326 aa, unidentified
MQPPVPGPLGLLDPAEGLSRRKKTSLWFVGSLLLVSVLIVTVGLAATTRTENVTVGGYYPGIILGFGSFLGIIGINLVENRRQMLVAAIVFISFGVVAAFCCAIVDGVFAAQHIEPRPLTTGRCQFYSSGVGYLYDVYQTEVTCHSLDGKCQLKVRSNTCYCCDLYACGSAEPSPAYYEFIGVSGCQDVLHLYRLLWASAVLNVLGLFLGIITAAVLGAFKDMVPLSQLAYGPAVPPQTLYNPAQQILAYAGFRLTPEPVPTCSSYPLPLQPCSRFPVAPSSALASSEDLQPPSPSSSGSGLPGQAPPCYAPTYFPPGEKPPPYAP

SEQ ID NO: 4885 - protein, 113 aa, unidentified
MAGPAAAFRRLGALSGAAALGFASYGAHGAQFPDAYGKELFDKANKHHFLHSLALLGVPHCRKPLWAGLLLASGTTLFCTSFYYQALSGDPSIQTLAPAGGTLLLLGWLALAL

SEQ ID NO: 4886 - protein, 111 aa, unidentified
MYSRLFYLKSSYIIYFEPLFSNAIINILSFINSLASPLTIFCFALSAQALSTIFYFRIFIFIFHSWILLFHFYFTCSFKTYEHQHSKMVPAYRMQSPRALPRTYLYVWPYK

SEQ ID NO: 4887 - protein, 79 aa, unidentified
MELEAMSRYTSPVNPAVFPHLTVVLLAIGMFFTAWFFVYEVTSTKYTRDIYKELLISLVASLFMGFGVLFLLLWVGIYV

SEQ ID NO: 4888 - protein, 620 aa, unidentified
MSEHVEPAAPGPGPNGGGGGPAPARGPRTPNLNPNPLINVRDRLFHALFFKMAVTYSRLFPPAFRRLFEFFVLLKALFVLFVLAYIHIVFSRSPINCLEHVRDKWPREGILRVEVRHNSSRAPVFLQFCDSGGRGSFPGLAVEPGSNLDMEDEEEEELTMEMFGNSSIKFELDIEPKVFKPPSSTEALNDSQEFPFPETPTKVWPQDEYIVEYSLEYGFLRLSQATRQRLSIPVMVVTLDPTRDQCFGDRFSRLLLDEFLGYDDILMSSVKGLAENEENKGFLRNVVSGEHYRFVSMWMARTSYLAAFAIMVIFTLSVSMLLRYSHHQIFVFIVDLLQMLEMNMAIAFPAAPLLTVILALVGMEAIMSEFFNDTTTAFYIILIVWLADQYDAICCHTSTSKRHWLRFFYLYHFAFYAYHYRFNGQYSSLALVTSWLFIQHSMIYFFHHYELPAILQQVRIQEMLLQAPPLGPGTPTALPDDMNNNSGAPATAPDSAGQPPALGPVSPGASGSPGPVAAAPSSLVAAAASVAAAAGGDLGWMAETAAIITDASFLSGLSASLLERRPASPLGPAGGLPHAPQDSVPPSDSAASDTTPLGAAVGGPSPASMAPTEAPSEVGS

SEQ ID NO: 4889 - protein, 368 aa, unidentified
MEGLVFLNALATRLLFLLHSLVGVWRVTEVKKEPRYWLLALLNLLLFLETALTLKFKRGRGYKWFSPAIFLYLISIVPSLWLLELHHETQYCSIQAEGTSQNTSRKEDFNQTLTSNEQTSRADDLIETAKVFVNNLSTVCEKVWTLGLHQTFLLMLIIGRWLLPIGGGITRDQLSQLLLMFVGTAADILEFTSETLEEQNVRNSPALVYAILVIWTWSMLQFPLDLAVQNVVCPVSVTERGFPSLFFCQYSADLWNIGISVFIQDGPFLVVRLILMTYFKVINQMLVFFAAKNFLVVVLQLYRLVVLALAVRASLRSQSEGLKGEHGCRAQTSESGPSQRDWQNESKEGLAIPLRGSPVTSDDSHHTP

SEQ ID NO: 4890 - protein, 707 aa, unidentified
MSPHGDGRGQAQGRAVRVGLRRSGGIRGGVAVFAAVAAVFTFTLPPSVPGGDSGELITAAHELGVAHPPGYPLFTLVAKLAITLFPFGSIAYRVNLLCGLFGAVAASLLFFTVFRLSGSSAGGILAAGVFSFSRLTWQWSIAAEVFSLNNLFVGLLMALTVHFEEAATAKERSKVAKIGAFCCGLSLCNQHTIILYVLCIIPWILFQLLKKKELSLGSLLKLSLYFSAGLLPYVHLPISSYLNHARWTWGDQTTLQGFLTHFLREEYGTFSLAKSEIGSSMSEILLSQVTNMRTELSFNIQALAVCANICLATKDRQNPSLVWLFTGMFCIYSLFFAWRANLDISKPLFMGVVERFWMQSNAVVAVLAGIGLAAVVSETNRVLNSNGLQCLEWLSATLFVVYQIYSNYSVCDQRTNYVIDKFAKNLLTSMPHDAIILLRGDLPGNSLRYMHYCEGLRPDISLVDQEMMTYEWYLPKMAKHLPGVNFPGNRWNPVEGILPSGMVTFNLYHFLEVNKQKETFVCIGIHEGDPTWKKNYSLWPWGSCDKLVPLEIVFNPEEWIKLTKSIYNWTEEYGRFDPSSWESVANEEMWQARMKTPFFIFNLAETAHMPSKVKAQLYAQAYDLYKEIVYLQKEHPVNWHKNYAIACERMLRLQARDADPEVLLSETIRHFRLYSQKAPNDPQQADILGALKHLRKELQSLRNRKNV

SEQ ID NO: 4891 - protein, 116 aa, unidentified
MGSRLSQPFESYITAPPGTAAAPAKPAPPATPGAPTSPAEHRLLKTCWSCRVLSGLGLMGAGGYVYWVARKPMKMGYPPSPWTITQMVIGLSENQGIATWGIVVMADPKGKAYRVV

SEQ ID NO: 4892 - protein, 531 aa, unidentified
MAVAPSFNMTNPQPAIEGGISEVEIISQQVDEETKSIAPVQLVNFAYRDLPLAAVDLSTAGSQLLSNLDEDYQREGSNWLKPCCGKRAAVWQVFLLSASLNSFLVACVILVVILLTLELLIDIKLLQFSSAFQFAGVIHWISLVILSVFFSETVLRIVVLGIWDYIENKIEVFDGAVIILSLAPMVASTVANGPRSPWDAISLIIMLRIWRVKRVIDAYVLPVKLEMEMVIQQYEKAKVIQDEQLERLTQICQEQGFEIRQLRAHLAQQDLDLAAEREAALQAPHVLSQPRSRFKVLEAGTWDEETAAESVVEELQPSQEATMKDDMNSYISQYYNGPSSDSGVPEPAVCMVTTAAIDIHQPNISSDLFSLDMPLKLGGNGTSATSESASRSSVTRAQSDSSQTLGSSMDCSTAREEPSSEPGPSPPPLPSQQQVEEATVQDLLSSLSEDPCPSQKALDPAPLARPSPAGSAQTSPELEHRVSLFNQKNQEGFTVFQIRPVIHFQPTVPMLEDKFRSLESKEQKLHRVPEA

SEQ ID NO: 4893 - protein, 215 aa, unidentified
MASETEKTHALLQTCSTESLISSLGLGAFCLVADRLLQFSTIQQNDWLRALSDNAVHCVIGMWSWAVVTGIKKKTDFGEIILAGFLASVIDVDHFFLAGSMSLKAALTLPRRPFLHCSTVIPVVVLTLKFTMHLFKLKDSWCFLPWMLFISWTSHHIRDGIRHGLWICPFGKTSPLPFWLYVIITSSLPHICSFVMYLTGTRQMMSSKHGVRIDV

SEQ ID NO: 4894 - protein, 342 aa, unidentified
MACEPQVDPGATGPLPPSSPGWSALPGGSPPGWGQELHNGQVLTVLRIDNTCAPISFDLGAAEEQLQTWGIQVPADQYRSLAESALLEPQVRRYIIYNSRPMRLAFAVVFYVVVWANIYSTSQMFALGNHWAGMLLVTLAAVSLTLTLVLVFERHQKKANTNTDLRLAAANGALLRHRVLLGVTDTVEGCQSVIQLWFVYFDLENCVQFLSDHVQEMKTSQESLLRSRLSQLCVVMETGVSPATAEGPENLEDAPLLPGNSCPNERPLMQTELHQLVPEAEPEEMARQLLAVFGGYYIRLLVTSQLPQAMGTRHTNSPRIPCPCQLIEAYILGTGCCPFLAR

SEQ ID NO: 4895 - protein, 222 aa, unidentified
MLWLLFFLVTAIHAELCQPGAENAFKVRLSIRTALGDKAYAWDTNEEYLFKAMVAFSMRKVPNREATEISHVLLCNVTQRVSFWFVVTDPSKNHTLPAVEVQSAIRMNKNRINNAFFLNDQTLEFLKIPSTLAPPMDPSVPIWIIIFGVIFCIIIVAIALLILSGIWQRRRKNKEPSEVDDAEDKCENMITIENGIPSDPLDMKGGHINDAFMTEDERLTPL

SEQ ID NO: 4896 - protein, 361 aa, unidentified
MAMNYNAKDEVDGGPPCAPGGTAKTRRPDNTAFKQQRLPAWQPILTAGTVLPIFFIIGLIFIPIGIGIFVTSNNIREIEIDYTGTEPSSPCNKCLSPDVTPCFCTINFTLEKSFEGNVFMYYGLSNFYQNHRRYVKSRDDSQLNGDSSALLNPSKECEPYRRNEDKPIAPCGAIANSMFNDTLELFLIGNDSYPIPIALKKKGIAWWTDKNVKFRNPPGGDNLEERFKGTTKPVNWLKPVYMLDSDPDNNGFINEDFIVWMRTAALPTFRKLYRLIERKSDLHPTLPAGRYSLNVTYNYPVHYFDGRKRMILSTISWMGGKNPFLGIAYIAVGSISFLLGVVLLVINHKYRNSSNTADITI

SEQ ID NO: 4897 - protein, 351 aa, unidentified
MTWSATARGAHQPDNTAFTQQRLPAWQPLLSASIALPLFFCAGLAFIGLGLGLYYSSNGIKELEYDYTGDPGTGNCSVCAAAGQGRALPPPCSCAWYFSLPELFQGPVYLYYELTNFYQNNRRYGVSRDDAQLSGLPSALRHPVNECAPYQRSAAGLPIAPCGAIANSLFNDSFSLWHQRQPGGPYVEVPLDRSGIAWWTDYHVKFRNPPLVNGSLALAFQGTAPPPNWRRPVYELSPDPNNTGFINQDFVVWMRTAALPTFRKLYARIRQGNYSAGLPRGAYRVNITYNYPVRAFGGHKLLIFSSISWMGGKNPFLGIAYLVVGSLCILTGFVMLVVYIRYQDQDDDDEE

SEQ ID NO: 4898 - protein, 168 aa, unidentified
MRLTEKSEGEQQLKPNNSNAPNEDQEEEIQQSEQHTPARQRTQRADTQPSRCRLPSRRTPTTSSDRTINLLEVLPWPTEWIFNPYRLPALFELYPEFLLVFKEAFHDISHCLKAQMEKIGLPIILHLFALSTLYFYKFFLPTILSLSFFILLVLLLLLFIIVFILIFF

SEQ ID NO: 4899 - protein, 247 aa, unidentified
MADTTPNGPQGAGAVQFMMTNKLDTAMWLSRLFTVYCSALFVLPLLGLHEAASFYQRALLANALTSALRLHQRLPHFQLSRAFLAQALLEDSCHYLLYSLIFVNSYPVTMSIFPVLLFSLLHAATYTKKVLDARGSNSLPLLRSVLDKLSANQQNILKFIACNEIFLMPATVFMLFSGQGSLLQPFIYYRFLTLRYSSRRNPYCRTLFNELRIVVEHIIMKPACPLFVRRLCLQSIAFISRLAPTVP

SEQ ID NO: 4900 - protein, 167 aa, unidentified
MASPRTVTIVALSVALGLFFVFMGTIKLTPRLSKDAYSEMKRAYKSYVRALPLLKKMGINSILLRKSIGALEVACGIVMTLVPGRPKDVANFFLLLLVLAVLFFHQLVGDPLKRYAHALVFGILLTCRLLIARKPEDRSSEKKPLPGNAEEQPSLYEKAPQGKVKVS

SEQ ID NO: 4901 - protein, 154 aa, unidentified
MALLLSVLRVLLGGFFALVGLAKLSEEISAPVSERMNALFVQFAEVFPLKVFGYQPDPLNYQIAVGFLELLAGLLLVMGPPMLQEISNLFLILLMMGAIFTLAALKESLSTCIPAIVCLGFLLLLNVGQLLAQTKKVVRPTRKKTLSTFKESWK

SEQ ID NO: 4902 - protein, 190 aa, unidentified
MTAVGVQAQRPLGQRQPRRSFFESFIRTLIITCVALAVVLSSVSICDGHWLLAEDRLFGLWHFCTTTNQTICFRDLGQAHVPGLAVGMGLVRSVGALAVVAAIFGLEFLMVSQLCEDKHSQCKWVMGSILLLVSFVLSSGGLLGFVILLRNQVTLIGFTLMFWCEFTASFLLFLNAISGLHINSITHPWE

SEQ ID NO: 4903 - protein, 299 aa, unidentified
MELLSALSLGELALSFSRVPLFPVFDLSYFIVSILYLKYEPGAVELSRRHPIASWLCAMLHCFGSYILADLLLGEPLIDYFSNNSSILLASAVWYLIFFCPLDLFYKCVCFLPVKLIFVAMKEVVRVRKIAVGIHHAHHHYHHGWFVMIATGWVKGSGVALMSNFEQLLRGVWKPETNEILHMSFPTKASLYGAILFTLQQTRWLPVSKASLIFIFTLFMVSCKVFLTATHSHSSPFDALEGYICPVLFGSACGGDHHHDNHGGSHSGGGPGAQHSAMPAKSKEELSEGSRKKKAKKAD

SEQ ID NO: 4904 - protein, 291 aa, unidentified
MDSPWDELALAFSRTSMFPFFDIAHYLVSVMAVKRQPGAAALAWKNPISSWFTAMLHCFGGGILSCLLLAEPPLKFLANHTNILLASSIWYITFFCPHDLVSQGYSYLPVQLLASGMKEVTRTWKIVGGVTHANSYYKNGWIVMIAIGWARGAGGTIITNFERLVKGDWKPEGDEWLKMSYPAKVTLLGSVIFTFQHTQHLAISKHNLMFLYTIFIVATKITMMTTQTSTMTFAPFEDTLSWMLFGWQQPFSSCEKKSEAKSPSNGVGSLASKPVDVASDNVKKKHTKKNE

SEQ ID NO: 4905 - protein, 488 aa, unidentified
MPGGRRGPSRQQLSRSALPSLQTLVGGGCGNGTGLRNRNGSAIGLPVPPITALITPGPVRHCQIPDLPVDGSLLFEFLFFIYLLVALFIQYINIYKTVWWYPYNHPASCTSLNFHLIDYHLAAFITVMLARRLVWALISEATKAGAASMIHYMVLISARLVLLTLCGWVLCWTLVNLFRSHSVLNLLFLGYPFGVYVPLCCFHQDSRAHLLLTDYNYVVQHEAVEESASTVGGLAKSKDFLSLLLESLKEQFNNATPIPTHSCPLSPDLIRNEVECLKADFNHRIKEVLFNSLFSAYYVAFLPLCFVKSTQYYDMRWSCEHLIMVWINAFVMLTTQLLPSKYCDLLHKSAAHLGKWQKLEHGSYSNAPQHIWSENTIWPQGVLVRHSRCLYRAMGPYNVAVPSDVSHARFYFLFHRPLRLLNLLILIEGSVVFYQLYSLLRSEKWNHTLSMALILFCNYYVLFKLLRDRIVLGRAYSYPLNSYELKAN

SEQ ID NO: 4906 - protein, 264 aa, unidentified
MRPLLGLLLVFAGCTFALYLLSTRLPRGRRLGSTEEAGGRSLWFPSDLAELRELSEVLREYRKEHQAYVFLLFCGAYLYKQGFAIPGSSFLNVLAGALFGPWLGLLLCCVLTSVGATCCYLLSSIFGKQLVVSYFPDKVALLQRKVEENRNSLFFFLLFLRLFPMTPNWFLNLSAPILNIPIVQFFFSVLIGLIPYNFICVQTGSILSTLTSLDALFSWDTVFKLLAIAMVALIPGTLIKKFSQKHLQLNETSTANHIHSRKDT

SEQ ID NO: 4907 - protein, 291 aa, unidentified
MAKGRVAERSQLGAHHTTPVGDGAAGTRGLAAPGSRDHQKEKSWVEAGSARMSLLILVSIFLSAAFVMFLVYKNFPQLSEEERVNMKVPRDMDDAKALGKVLSKYKDTFYVQVLVAYFATYIFLQTFAIPGSIFLSILSGFLYPFPLALFLVCLCSGLGASFCYMLSYLVGRPVVYKYLTEKAVKWSQQVERHREHLINYIIFLRITPFLPNWFINITSPVINVPLKVFFIGTFLGVAPPSFVAIKAGTTLYQLTTAGEAVSWNSIFILMILAVLSILPAIFQKKLKQKFE

SEQ ID NO: 4908 - protein, 159 aa, unidentified
MAERPGPPGGAVSATAYPDTPAEFPPHLQAGAMRRRFWGVFNCLCAGAFGALAAASAKLAFGSEVSMGLCVLGIIVMASTNSLMWTFFSRGLSFSMSSAIASVTVTFSNILSSAFLGYVLYGECQEVLWWGGVFLILCGLTLIHRKLPPTWKPLPHKQQ

SEQ ID NO: 4909 - protein, 400 aa, unidentified
MAANYSSTSTRREHVKVKTSSQPGFLERLSETSGGMFVGLMAFLLSFYLIFTNEGRALKTATSLAEGLSLVVSPDSIHSVAPENEGRLVHIIGALRTSKLLSDPNYGVHLPAVKLRRHVEMYQWVETEESREYTEDGQVKKETRYSYNTEWRSEIINSKNFDREIGHKNPSAMAVESFMATAPFVQIGRFFLSSGLIDKVDNFKSLSLSKLEDPHVDIIRRGDFFYHSENPKYPEVGDLRVSFSYAGLSGDDPDLGPAHVVTVIARQRGDQLVPFSTKSGDTLLLLHHGDFSAEEVFHRELRSNSMKTWGLRAAGWMAMFMGLNLMTRILYTLVDWFPVFRDLVNIGLKAFAFCVATSLTLLTVAAGWLFYRPLWALLIAGLALVPILVARTRVPAKKLE

SEQ ID NO: 4910 - protein, 475 aa, unidentified
MGEAPSPAPALWDWDYLDRCFARHRVCISFGLWICASSCWIAAHALLLYLRCAQKPRQDQSALCAACCLLTSLCDTVGALLARQLTIQVFTGAYLAAIDLVNFMFILFPVCGSKFKSNSDREARERKRRRQLRASVFALALPLSLGPCWALWVAVPKASATIRGPQRRLLASLLQENTEILGYLLGSVAAFGSWASRIPPLSRIAPPPTLGITTQHEIWRGQMSKPSQSPSRSPSGHWRAAAQRQVLGTEMCRGKTFPSIHLWTRLLSALAGLLYASAIVAHDQHPEYLLRATPWFLTSLGRAALDLAIIFLSCVMKSKMRQALGFAKEARESPDTQALLTCAEKEEENQENLDWVPLTTLSHCKSLRTMTAISRYMELTIEPVQQAGCSATRLPGDGQTSAGDASLQDPPSYPPVQVIRARVSSGSSSEVSSINSDLEWDPEDVNLEGSKENVELLGSQVHQDSVRTAHLSDDD

SEQ ID NO: 4911 - protein, 275 aa, unidentified
MGNFRGHALPGTFFFIIGLWWCTKSILKYICKKQKRTCYLGSKTLFYRLEILEGITIVGMALTGMAGEQFIPGGPHLMLYDYKQGHWNQLLGWHHFTMYFFFGLLGVADILCFTISSLPVSLTKLMLSNALFVEAFIFYNHTHGREMLDIFVHQLLVLVVFLTGLVAFLEFLVRNNVLLELLRSSLILLQGSWFFQIGFVLYPPSGGPAWDLMDHENILFLTICFCWHYAVTIVIVGMNYAFITWLVKSRLKRLCSSEVGLLKNAEREQESEEEM

SEQ ID NO: 4912 - protein, 275 aa, unidentified
MANFKGHALPGSFFLIIGLCWSVKYPLKYFSHTRKNSPLHYYQRLEIVEAAIRTLFSVTGILAEQFVPDGPHLHLYHENHWIKLMNWQHSTMYLFFAVSGIVDMLTYLVSHVPLGVDRLVMAVAVFMEGFLFYYHVHNRPPLDQHIHSLLLYALFGGCVSISLEVIFRDHIVLELFRTSLIILQGTWFWQIGFVLFPPFGTPEWDQKDDANLMFITMCFCWHYLAALSIVAVNYSLVYCLLTRMKRHGRGEIIGIQKLNSDDTYQTALLSGSDEE

SEQ ID NO: 4913 - protein, 181 aa, unidentified
MASAGSGMEEVRVSVLTPLKLVGLVCIFLALCLDLGAVLSPAWVTADHQYYLSLWESCRKPASLDIWHCESTLSSDWQIATLALLLGGAAIILIAFLVGLISICVGSRRRFYRPVAVMLFAAVVLQVCSLVLYPIKFIETVSLKIYHEFNWGYGLAWGATIFSFGGAILYCLNPKNYEDYY

SEQ ID NO: 4914 - protein, 157 aa, unidentified
MSGFLEGLRCSECIDWGEKRNTIASIAAGVLFFTGWWIIIDAAVIYPTMKDFNHSYHACGVIATIAFLMINAVSNGQVRGDSYSEGCLGQTGARIWLFVGFMLAFGSLIASMWILFGGYVAKEKDIVYPGIAVFFQNAFIFFGGLVFKFGRTEDLWQ

SEQ ID NO: 4915 - protein, 158 aa, unidentified
MAGFLDNFRWPECECIDWSERRNAVASVVAGILFFTGWWIMIDAAVVYPKPEQLNHAFHTCGVFSTLAFFMINAVSNAQVRGDSYESGCLGRTGARVWLFIGFMLMFGSLIASMWILFGAYVTQNTDVYPGLAVFFQNALIFFSTLIYKFGRTEELWT

SEQ ID NO: 4916 - protein, 253 aa, unidentified
MMAQSKANGSHYALTAIGLGMLVLGVIMAMWNLVPGFSAAEKPTAQGSNKTEVGGGILKSKTFSVAYVLVGAGVMLLLLSICLSIRDKRKQRQGEDLAHVQHPTGAGPHAQEEDSQEEEEEDEEAASRYYVPSYEEVMNTNYSEARGEEQNPRLSISLPSYESLTGLDETTPTSTRADVEASPGNPPDRQNSKLAKRLKPLKVRRIKSEKLHLKDFRINLPDKNVPPPSIEPLTPPPQYDEVQEKAPDTRPPD

SEQ ID NO: 4917 - protein, 209 aa, unidentified
MARGPLAARGLRLLLPLLPLLPLLPLPQVALGFADGSCDPSDQCPPQARWSSLWHVGLILLAVLLLLLCGVTAGCVRFCCLRKQAQAQPHLPPARQPCDVAVIPMDSDSPVHSTVTSYSSVQYPLGMRLPLPFGELDLDSMAPPAYSLYTPEPPPSYDEAVKMAKPREEGPALSQKPSPLLGASGLETTPVPQESGPNTQLPPCSPGAP

SEQ ID NO: 4918 - protein, 277 aa, unidentified
MASAELDYTIEIPDQPCWSQKNSPSPGGKEAETRQPVVILLGWGGCKDKNLAKYSAIYHKRGCIVIRYTAPWHMVFFSESLGIPSLRVLAQKLLELLFDYEIEKEPLLFHVFSNGGVMLYRYVLELLQTRRFCRLRVVGTIFDSAPGDSNLVGALRALAAILERRAAMLRLLLLVAFALVVVLFHVLLAPITALFHTHFYDRLQDAGSRWPELYLYSRADEVVLARDIERMVEARLARRVLARSVDFVSSAHVSHLRDYPTYYTSLCVDFMRNCVRC

SEQ ID NO: 4919 - protein, 222 aa, unidentified
MCLRLGGLSVGDFRKVLMKTGLVLVVLGHVSFITAALFHGTVLRYVGTPQDAVALQYCVVNILSVTSAIVVITSGIAAIVLSRYLPSTPLRWTVFSSSVACALLSLTCALGLLASIAMTFATQGKALLAACTFGSSELLALAPDCPFDPTRIYSSSLCLWGIALVLCVAENVFAVRCAQLTHQLLELRPWWGKSSHHMMRENPELVEGRDLLSCTSSEPLTL

SEQ ID NO: 4920 - protein, 257 aa, unidentified
MAADGVDERSPLLSASHSGNVTPTAPPYLQESSPRAELPPPYTAIASPDASGIPVINCRVCQSLINLDGKLHQHVVKCTVCNEATPIKNPPTGKKYVRCPCNCLLICKDTSRRIGCPRPNCRRIINLGPVMLISEEQPAQPALPIQPEGTRVVCGHCGNTFLWMELRFNTLAKCPHCKKISSVGSALPRRRCCAYITIGMICIFIGVGLTVGTPDFARRFRATYVSWAIAYLLGLICLIRACYWGAIRVSYPEHSFA

SEQ ID NO: 4921 - protein, 277 aa, unidentified
MAADGERSPLLSEPIDGGAGGNGLVGPGGSGAGPGGGLTPSAPPYGAAFPPFPEGHPAVLPGEDPPPYSPLTSPDSGSAPMITCRVCQSLINVEGKMHQHVVKCGVCNEATPIKNAPPGKKYVRCPCNCLLICKVTSQRIACPRPYCKRIINLGPVHPGPLSPEPQPMGVRVICGHCKNTFLWTEFTDRTLARCPHCRKVSSIGRRYPRKRCICCFLLGLLLAVTATGLAFGTWKHARRYGGIYAAWAFVILLAVLCLGRALYWACMKVSHPVQNFS

SEQ ID NO: 4922 - protein, 263 aa, unidentified
MEINTKLLISVTCISFFTFQLLFYFVSYWFSAKVSPGFNSLSFKKKIEWNSRVVSTCHSLVVGIFGLYIFLFDEATKADPLWGGPSLANVNIAIASGYLISDLSIIILYWKVIGDKFFIMHHCASLYAYYLVLKNGVLAYIGNFRLLAELSSPFVNQRWFFEALKYPKFSKAIVINGILMTVVFFIVRIASMLPHYGFMYSVYGTEPYIRLGVLIQLSWVISCVVLDVMNVMWMIKISKGCIKVISHIRQEKAKNSLQNGKLD

SEQ ID NO: 4923 - protein, 201 aa, unidentified
MEINTKLLISVTCISFFTFQLLFYFVSYWFSAKVSPGFNSLSFKKKIEWNSRVVSTCHSLVVGIFGLYIFLFDEATKADPLWGGPSLANVNIAIASGYLISDLSIIILYWKVIGDKFFIMHHCASLYAYYLVLKNGVLAYIGNFRLLAELSSPFVNQRPKAVVTGNMDLFSSLTLHLSTLSLQSPANNQDRWDRVQNSHKS

SEQ ID NO: 4924 - protein, 664 aa, unidentified
MKRRNADCSKLRRPLKRNRITEGIYGSTFLYLKFLVVWALVLLADFVLEFRFEYLWPFWLFIRSVYDSFRYQGLAFSVFFVCVAFTSNIICLLFIPIQWLFFAASTYVWVQYVWHTERGVCLPTVSLWILFVYIEAAIRFKDLKNFHVDLCRPFAAHCIGYPVVTLGFGFKSYVSYKMRLRKQKEVQKENEFYMQLLQQALPPEQQMLQKQEKEAEEAAKGLPDMDSSILIHHNGGIPANKKLSTTLPEIEYREKGKEKDKDAKKHNLGINNNNILQPVDSKIQEIEYMENHINSKRLNNDLVGSTENLLKEDSCTASSKNYKNASGVVNSSPRSHSATNGSIPSSSSKNEKKQKCTSKSPSTHKDLMENCIPNNQLSKPDALVRLEQDIKKLKADLQASRQVEQELRSQISSLSSTERGIRSEMGQLRQENELLQNKLHNAVQMKQKDKQNISQLEKKLKAEQEARSFVEKQLMEEKKRKKLEEATAARAVAFAAASRGECTETLRNRIRELEAEGKKLTMDMKVKEDQIRELELKVQELRKYKENEKDTEVLMSALSAMQDKTQHLENSLSAETRIKLDLFSALGDAKRQLEIAQGQILQKDQEIKDLKQKIAEVMAVMPSITYSAATSPLSPVSPHYSSKFVETSPSGLDPNASVYQPLKK

SEQ ID NO: 4925 - protein, 323 aa, unidentified
MAAPKGSLWVRTQLGLPPLLLLTMALAGGSGTASAEAFDSVLGDTASCHRACQLTYPLHTYPKEEELYACQRGCRLFSICQFVDDGIDLNRTKLECESACTEAYSQSDEQYACHLGCQNQLPFAELRQEQLMSLMPKMHLLFPLTLVRSFWSDMMDSAQSFITSSWTFYLQADDGKIVIFQSKPEIQYAPHLEQEPTNLRESSLSKMSYLQMRNSQAHRNFLEDGESDGFLRCLSLNSGWILTTTLVLSVMVLLWICCATVATAVEQYVPSEKLSIYGDLEFMNEQKLNRYPASSLVVVRSKTEDHEEAGPLPTKVNLAHSEI

SEQ ID NO: 4926 - protein, 342 aa, unidentified
MAAVALMPPPLLLLLLLASPPAASAPSARDPFAPQLGDTQNCQLRCRDRDLGPQPSQAGLEGASESPYDRAVLISACERGCRLFSICRFVARSSKPNATQTECEAACVEAYVKEAEQQACSHGCWSQPAEPEPEQKRKVLEAPSGALSLLDLFSTLCNDLVNSAQGFVSSTWTYYLQTDNGKVVVFQTQPIVESLGFQGGRLQRVEVTWRGSHPEALEVHVDPVGPLDKVRKAKIRVKTSSKAKVESEEPQDNDFLSCMSRRSGLPRWILACCLFLSVLVMLWLSCSTLVTAPGQHLKFQPLTLEQHKGFMMEPDWPLYPPPSHACEDSLPPYKLKLDLTKL

SEQ ID NO: 4927 - protein, 133 aa, unidentified
MRMSLAQRVLLTWLFTLLFLIMLVLKLDEKAPWNWFLIFIPVWIFDTILLVLLIVKMAGRCKSGFDPRHGSHNIKKKAWYLIAMLLKLAFCLALCAKLEQFTTMNLSYVFIPLWALLAGALTELGYNVFFVRD

SEQ ID NO: 4928 - protein, 210 aa, unidentified
MALPQMCDGSHLASTLRYCMTVSGTVVLVAGTLCFAWWSEGDATAQPGQLAPPTEYPVPEGPSPLLRSVSFVCCGAGGLLLLIGLLWSVKASIPGPPRWDPYHLSRDLYYLTVESSEKESCRTPKVVDIPTYEEAVSFPVAEGPPTPPAYPTEEALEPSGSRDALLSTQPAWPPPSYESISLALDAVSAETTPSATRSCSGLVQTARGGS

SEQ ID NO: 4929 - protein, 643 aa, unidentified
MAAVLALRVVAGLAAAALVAMLLEHYGLAGQPSPLPRPAPPRRPHPAPGPGDSNIFWGLQISDIHLSRFRDPGRAVDLEKFCSETIDIIQPALVLATGDLTDAKTKEQLGSRQHEVEWQTYQGILKKTRVMEKTKWLDIKGNHDAFNIPSLDSIKNYYRKYSAVRRDGSFHYVHSTPFGNYSFICVDATVNPGPKRPYNFFGILDKKKMEELLLLAKESSRSNHTIWFGHFTTSTILSPSPGIRSIMSSAIAYLCGHLHTLGGLMPVLHTRHFQGTLELEVGDWKDNRRYRIFAFDHDLFSFADLIFGKWPVVLITNPKSLLYSCGEHEPLERLLHSTHIRVLAFSLSSITSVTVKIDGVHLGQAVHVSGPIFVLKWNPRNYSSGTHNIEVIVQDSAGRSKSVHHIFSVQENNHLSFDPLASFILRTDHYIMARVLFVLIVLSQLTILIIFRYRGYPELKEPSGFINLTSFSLHVLSKINIFYYSVLLLTLYTVLGPWFFGEIIDGKFGCCFSFGIFVNGHFLQGSITFIIGILQLAFFNIPLMAYMCWSLLQRCFGHNFRSHLHQRKYLKIMPVHLLMLLLYIWQVYSCYFLYATYGTLAFLFSPLRTWLTLLTPVLIRYVWTLNSTKFGIFMVQLKSHLSS

SEQ ID NO: 4930 - protein, 807 aa, unidentified
MMDSPFLELWQSKAVSIREQLGLGDRPNDSYCYNSAKNSTVLQGVTFGGIPTVLLIDVSCFLFLILVFSIIRRRFWDYGRIALVSEADSESRFQRLSSTSSSGQQDFENELGCCPWLTAIFRLHDDQILEWCGEDAIHYLSFQRHIIFLLVVVSFLSLCVILPVNLSGDLLDKDPYSFGRTTIANLQTDNDLLWLHTIFAVIYLFLTVGFMRHHTQSIKYKEENLVRRTLFITGLPRDARKETVESHFRDAYPTCEVVDVQLCYNVAKLIYLCKEKKKTEKSLTYYTNLQVKTGQRTLINPKPCGQFCCCEVLGCEWEDAISYYTRMKDRLLERITEEERHVQDQPLGMAFVTFQEKSMATYILKDFNACKCQSLQCKGEPQPSSHSRELYTSKWTVTFAADPEDICWKNLSIQGLRWWLQWLGINFTLFLGLFFLTTPSIILSTMDKFNVTKPIHALNNPIISQFFPTLLLWSFSALLPSIVYYSTLLESHWTKSGENQIMMTKVYIFLIFMVLILPSLGLTSLDFFFRWLFDKTSSEASIRLECVFLPDQGAFFVNYVIASAFIGNGMELLRLPGLILYTFRMIMAKTAADRRNVKQNQAFQYEFGAMYAWMLCVFTVIVAYSITCPIIAPFGLIYILLKHMVDRHNLYFVYLPAKLEKGIHFAAVNQALAAPILCLFWLYFFSFLRLGMKAPATLFTFLVLLLTILVCLAHTCFGCFKHLSPLNYKTEEPASDKGSEAEAHMPPPFTPYVPRILNGLASERTALSPQQQQQQTYGAIHNISGTIPGQCLAQSATGSVAAAPQEA

SEQ ID NO: 4931 - protein, 832 aa, unidentified
MLPFLLATLGTTALNNSNPKDYCYSARIRSTVLQGLPFGGVPTVLALDFMCFLALLFLFSILRKVAWDYGRLALVTDADRLRRQERDRVEQEYVASAMHGDSHDRYERLTSVSSSVDFDQRDNGFCSWLTAIFRIKDDEIRDKCGGDAVHYLSFQRHIIGLLVVVGVLSVGIVLPVNFSGDLLENNAYSFGRTTIANLKSGNNLLWLHTSFAFLYLLLTVYSMRRHTSKMRYKEDDLVKRTLFINGISKYAESEKIKKHFEEAYPNCTVLEARPCYNVARLMFLDAERKKAERGKLYFTNLQSKENVPTMINPKPCGHLCCCVVRGCEQVEAIEYYTKLEQKLKEDYKREKEKVNEKPLGMAFVTFHNETITAIILKDFNVCKCQGCTCRGEPRPSSCSESLHISNWTVSYAPDPQNIYWEHLSIRGFIWWLRCLVINVVLFILLFFLTTPAIIITTMDKFNVTKPVEYLNNPIITQFFPTLLLWCFSALLPTIVYYSAFFEAHWTRSGENRTTMHKCYTFLIFMVLLLPSLGLSSLDLFFRWLFDKKFLAEAAIRFECVFLPDNGAFFVNYVIASAFIGNAMDLLRIPGLLMYMIRLCLARSAAERRNVKRHQAYEFQFGAAYAWMMCVFTVVMTYSITCPIIVPFGLMYMLLKHLVDRYNLYYAYLPAKLDKKIHSGAVNQVVAAPILCLFWLLFFSTMRTGFLAPTSMFTFVVLVITIVICLCHVCFGHFKYLSAHNYKIEHTETDTVDPRSNGRPPTAAAVPKSAKYIAQVLQDSEVDGDGDGAPGSSGDEPPSSSSQDEELLMPPDALTDTDFQSCEDSLIENEIHQ

SEQ ID NO: 4932 - protein, 806 aa, unidentified
MSASPDDLSTGGRLQNMTVDECFQSRNTVLQGQPFGGVPTVLCLNIALWVLVLVVYSFLRKAAWDYGRLALLIHNDSLTSLIYGEQSEKTSPSETSLEMERRDKGFCSWFFNSITMKDEDLINKCGDDARIYIVFQYHLIIFVLIICIPSLGIILPINYTGSVLDWSSHFARTTIVNVSTESKLLWLHSLLSFFYFITNFMFMAHHCLGFAPRNSQKVTRTLMITYVPKDIEDPELIIKHFHEAYPGSVVTRVHFCYDVRNLIDLDDQRRHAMRGRLFYTAKAKKTGKVMIRIHPCARLCFCKCWTCFKEVDAEQYYSELEEQLTDEFNAELNRVPLKRLDLIFVTFQDSRMAKRVRKDYKYVQCGVQPQQSSVTTIVKSYYWRVTMAPHPKDIIWKHLSVRRFFWWARFIAINTFLFFLFFFLTTPAIIMNTIDMYNVTRPIEKLQNPIVTQFFPSVMLWGFTVILPLIVYFSAFLEAHWTRSSQNLVMVHKCYIFLVFMVVILPSMGLTSLDVFLRWLFDIYYLEQASIRFQCVFLPDNGAFFVNYVITAALLGTGMELLRLGSLFCYSTRLFFSRSEPERVNIRKNQAIDFQFGREYAWMMNVFSVVMAYSITCPIIVPFGLLYLCMKHLTDRYNMYYSFAPTKLNEQIHMAAVSQAIFAPLLGLFWMLFFSILRLGSLHAITIFSLSTLLIAMVIAFVGIFLGKLRMVADYEPEEEEIQTVFDMEPSSTSSTPTSLLYVATVLQEPELNLTPASSPARHTYGTMNNQPEEGEEESGLRGFARELDSAQFQEGLELEGQNQYH

SEQ ID NO: 4933 - protein, 380 aa, unidentified
MRSPGGILLQALPRLLQHAALPGLAELPARWALPRGAGGDGPADRLPRGGGASAAAAAAAASGALLGAYLERHGPPEASELPEPGGALAGGPGSGGGGVVVGVAEVRNWRCCCLGSTCWCRSLVLVCVLAALCFASLALVRRYLHHLLLWVESLDSLLGVLLFVVGFIVVSFPCGWGYIVLNVAAGYLYGFVLGMGLMMVGVLIGTFIAHVVCKRLLTAWVAARIQSSEKLSAVIRVVEGGSGLKVVALARLTPIPFGLQNAVFSITDLSLPNYLMASSVGLLPTQLLNSYLGTTLRTMEDVIAEQSVSGYFVFCLQIIISIGLMFYVVHRAQVELNAAIVACEMELKSSLVKGNQPNTSGSSFYNKRTLTFSGGGINVV

SEQ ID NO: 4934 - protein, 240 aa, unidentified
MSRLLPLLRSRTARSLRPGPAAAAAPRPPSWCCCGRGLLALAPPGGLPGGPRRLGTHPKKEPMEALNTAQGARDFIYSLHSTERSCLLKELHRFESIAIAQEKLEAPPPTPGQLRYVFIHNAIPFIGFGFLDNAIMIVAGTHIEMSIGIILGISTMAAAALGNLVSDLAGLGLAGYVEALASRLGLSIPDLTPKQVDMWQTRLSTHLGKAVGVTIGCILGMFPLIFFGGGEEDEKLETKS

SEQ ID NO: 4935 - protein, 995 aa, unidentified
MATRGGAGVAMAVWSLLSARAVTAFLLLFLPRFLQAQTFSFPFQQPEKCDNNQYFDISALSCVPCGANQRQDARGTSCVCLPGFQMISNNGGPAIICKKCPENMKGVTEDGWNCISCPSDLTAEGKCHCPIGHILVERDINGTLLSQATCELCDGNENSFMVVNALGDRCVRCEPTFVNTSRSCACSEPNILTGGLCFSSTGNFPLRRISAARYGEVGMSLTSEWFAKYLQSSAAACWVYANLTSCQALGNMCVMNMNSYDFATFDACGLFQFIFENTAGLSTVHSISFWRQNLPWLFYGDQLGLAPQVLSSTSLPTNFSFKGENQNTKLKFVAASYDIRGNFLKWQTLEGGVLQLCPDTETRLNAAYSFGTTYQQNCEIPISKILIDFPTPIFYDVYLEYTDENQHQYILAVPVLNLNLQHNKIFVNQDSNSGKWLLTRRIFLVDAVSGRENDLGTQPRVIRVATQISLSVHLVPNTINGNIYPPLITIAYSDIDIKDANSQSVKVSFSVTYEMDHGEAHVQTDIALGVLGGLAVLASLLKTAGWKRRIGSPMIDLQTVVKFLVYYAGDLANVFFIITVGTGLYWLIFFKAQKSVSVLLPMPIQEERFVTYVGCAFALKALQFLHKLISQITIDVFFIDWERPKGKVLKAVEGEGGVRSATVPVSIWRTYFVANEWNEIQTVRKINSLFQVLTVLFFLEVVGFKNLALMDSSSSLSRNPPSYIAPYSCILRYAVSAALWLAIGIIQVVFFAVFYERFIEDKIRQFVDLCSMSNISVFLLSHKCFGYYIHGRSVHGHADTNMEEMNMNLKREAENLCSQRGLVPNTDGQTFEIAISNQMRQHYDRIHETLIRKNGPARLLSSSASTFEQSIKAYHMMNKFLGSFIDHVHKEMDYFIKDKLLLERILGMEFMEPMEKSIFYNDEGYSFSSVLYYGNEATLLIFDLLFFCVVDLACQNFILASFLTYLQQEIFRYIRNTVGQKNLASKTLVDQRFLI

SEQ ID NO: 4936 - protein, 324 aa, unidentified
MIDKNQTCGVGQDSVPYMICLIHILEEWFGVEQLEDYLNFANYLLWVFTPLILLILPYFTIFLLYLTIIFLHIYKRKNVLKEAYSHNLWDGARKTVATLWDGHAAVWHGYEVHGMEKIPEDGPALIIFYHGAIPIDFYYFMAKIFIHKGRTCRVVADHFVFKIPGFSLLLDVFCALHGPREKCVEILRSGHLLAISPGGVREALISDETYNIVWGHRRGFAQVAIDAKVPIIPMFTQNIREGFRSLGGTRLFRWLYEKFRYPFAPMYGGFPVKLRTYLGDPIPYDPQITAEELAEKTKNAVQALIDKHQRIPGNIMSALLERFH

SEQ ID NO: 4937 - protein, 247 aa, unidentified
MLRFIQKFSQASSKILKYSFPVGLRTSRTDILSLKMSLQQNFSPCPRPWLSSSFPAYMSKTQCYHTSPCSFKKQQKQALLARPSSTITYLTDSPKPALCVTLAGLIPFVAPPLVMLMTKTYIPILAFTQMAYGASFLSFLGGIRWGFALPEGSPAKPDYLNLASSAAPLFFSWFAFLISERLSEAIVTVIMGMGVAFHLELFLLPHYPNWFKALRIVVTLLATFSFIITLVVKSSFPEKGHKRPGQV

SEQ ID NO: 4938 - protein, 260 aa, unidentified
MLFLALGSPWAVELPLCGRRTALCAAAALRGPRASVSRASSSSGPSGPVAGWSTGPSGAARLLRRPGRAQIPVYWEGYVRFLNTPSDKSEDGRLIYTGNMARAVFGVKCFSYSTSLIGLTFLPYIFTQNNAISESVPLPIQIIFYGIMGSFTVITPVLLHFITKGYVIRLYHEATTDTYKAITYNAMLAETSTVFHQNDVKIPDAKHVFTTFYAKTKSLLVNPVLFPNREDYIHLMGYDKEEFILYMEETSEEKRHKDDK

SEQ ID NO: 4939 - protein, 295 aa, unidentified
MYRISQLMSTPVASSSRLEREYAGELSPTCIFPSFTCDSLDGYHSFECGSIDPLTGSHYTCRRSPRLLTNGYYIWTEDSFLCDKDGNITLNPSQTSVMYKENLVRIFRKKKRICHSFSSLFNLSTSKSWLHGSIFGDINSSPSEDNWLKGTRRLDTDHCNGNADDLDCSSLTDDWESGKMNAESVITSSSSHIISQPPGGNSHSLSLQSQLTASERFQENSSDHSETRLLQEVFFQAILLAVCLIISACARWFMGEILASVFTCSLMITVAYVKSLFLSLASYFKTTACARFVKI

SEQ ID NO: 4940 - protein, 275 aa, unidentified
MQLQVFWTGLEYTCRLLGITTAAVLIGVGTETFLQGQFKSLAFYLLFTGAAVSICEGAYFVAQLLAICFQCQPGSLADRVREKAHWLGCFQKFLAYLLLSVACFLHPVLVWHVTIPGSMLIITGLAYFLLSKRKKRKAAPEVLASPEQYTDPSSSAVSTTGSGDTEQTYTFHGALKEGPSSLFIHMKSILKGTKKPSALQPPNTLMELSLEPADSLAKKKQVHFEDNLVRIVPSLAEGLDDGDSEPEETTSDTTPIIPPPQAPLFLSSLTATGLF

SEQ ID NO: 4941 - protein, 305 aa, unidentified
MELHYLAKKSNQADLCDARDWSSRGLPGDQADTAATRAALCCQKQCASTPRATEMEGSKLSSSPASPSSSLQNSTLQPDAFPPGLLHSGNNQITAERKVCNCCSQELETSFTYVDKNINLEQRNRSSPSAKGHNHPGELGWENPNEWSQEAAISLISEEEDDTSSEATSSGKSIDYGFISAILFLVTGILLVIISYIVPREVTVDPNTVAAREMERLEKESARLGAHLDRCVIAGLCLLTLGGVILSCLLMMSMWKGELYRRNRFASSKESAKLYGSFNFRMKTSTNENTLELSLVEEDALAVQS

SEQ ID NO: 4942 - protein, 256 aa, unidentified
MPPAQGYEFAAAKGPRDELGPSFPMASPPGLELKTLSNGPQAPRRSAPLGPVAPTREGVENACFSSEEHETHFQNPGNTRLGSSPSPPGGVSSLPRSQRDDLSLHSEEGPALEPVSRPVDYGFVSALVFLVSGILLVVTAYAIPREARVNPDTVTAREMERLEMYYARLGSHLDRCIIAGLGLLTVGGMLLSVLLMVSLCKGELYRRRTFVPGKGSRKTYGSINLRMRQLNGDGGQALVENEVVQVSETSHTLQRS

SEQ ID NO: 4943 - protein, 394 aa, unidentified
MTEQETLALLEVKRSDSPEKSSPQALVPNGRQPEGEGGAESPGAESLRVGSSAGSPTAIEGAEDGLDSTVSEAATLPWGTGPQPSAPFPDPPGWRDIEPEPPESEPLTKLEELPEDDANLLPEKAARAFVPIDLQCIERQPQEDLIVRCEAGEGECRTFMPPRVTHPDPTERKWAEAVVRPPGCSCGGCGSCGDREWLRAVASVGAALILFPCLLYGAYAFLPFDVPRLPTMSSRLIYTLRCGVFATFPIVLGILVYGLSLLCFSALRPFGEPRREVEIHRRYVAQSVQLFILYFFNLAVLSTYLPQDTLKLLPLLTGLFAVSRLIYWLTFAVGRSFRGFGYGLTFLPLLSMLMWNLYYMFVVEPERMLTATESRLDYPDHARSASDYRPRPWG

SEQ ID NO: 4944 - protein, 216 aa, unidentified
MLPNVGSPPLPFRKCPSGAGRTNRASAVARTSAPETRRGRAPSSGDAKMAEGARARGPRGCRDRDGPAGGAGKMAAPRRGRGSSTVLSSVPLQMLFYLSGTYYALYFLATLLMITYKSQVFSYPHRYLVLDLALLFLMGILEAVRLYLGTRGNLTEAERPLAASLALTAGTALLSAHFLLWQALVLWADWALSATLLALHGLEAVLQVVAIAAFTR

SEQ ID NO: 4945 - protein, 255 aa, unidentified
MKVLATSFVLGSLGLAFYLPLVVTTPKTLAIPEKLQEAVGKVIINATTCTVTCGLGYKEETVCEVGPDGVRRKCQTRRLECLTNWICGMLHFTILIGKEFELSCLSSDILEFGQEAFRFTWRLARGVISTDDEVFKPFQANSHFVKFKYAQEYDSGTYRCDVQLVKNLRLVKRLYFGLRVLPPNLVNLNFHQSLTEDQKLIDEGLEVNLDSYSKPHHPKWKKKVASALGIGIAIGVVGGVLVRIVLCALRGGLQQ

SEQ ID NO: 4946 - protein, 343 aa, unidentified
MFSLPSLPSWLPGLPSLEWGSSLLDSLLQGLIGALGVLVLNSLLKVYFFVGCANDPQRRPEKERLRAQWASLETVHLAGLALFLTVVGSRVAALVVLEFSLRAVSTLLSLGKGSQGAAERLQLYLLCQYSLGCGLTCGLSFLQEGAPHRTLNLLLSLGLATLLGLGARRLHRHVCRLYELHSSQRYCGVCLGLLAHAHGLPQLLGRALAIAFAVGDLAAVALINQDFLTTSEAMRFWTPLTICYTLLVIYMQEEQRQHPGLQSQVQTVLVRMGGLFVLLLTVGRWLDLLGILVSLLGELWCLVGVRTLLDLCQIQDFPSQRPPVSTPSQPLPSAPQSQSSAPS

SEQ ID NO: 4947 - protein, 240 aa, unidentified
MVSPVTVVKSEGPKLVPFFKATCVYFVLWLPSSSPSWVSTLIKCLPIFCLWLFLLAHGLGFLLAHPSATRIFVGLVFSAVGDAFLIWQDQGYFVHGLLMFAVTHMFYASAFGMQPLALRTGLVMAALSGLCYALLYPCLSGAFTYLVGVYVALIGFMGWRAMAGLRLAGADWRWTELAAGSGALFFIISDLTIALNKFCFPVPYSRALIMSTYYVAQMLVALSAVESREPVEHYRLTKAN

SEQ ID NO: 4948 - protein, 226 aa, unidentified
MDAGKAGQTLKTHCSAQRPDVCRWLSPFILSCCVYFCLWIPEDQLSWFAALVKCLPVLCLAGFLWVMSPSGGYTQLLQGALVCSAVGDACLIWPAAFVPGMAAFATAHLLYVWAFGFSPLQPGLLLLIILAPGPYLSLVLQHLEPDMVLPVAAYGLILMAMLWRGLAQGGSAGWGALLFTLSDGVLAWDTFAQPLPHAHLVIMTTYYAAQLLITLSALRSPVPKTD

SEQ ID NO: 4949 - protein, 555 aa, unidentified
MAAAAWLQVLPVILLLLGAHPSPLSFFSAGPATVAAADRSKWHIPIPSGKNYFSFGKILFRNTTIFLKFDGEPCDLSLNITWYLKSADCYNEIYNFKAEEVELYLEKLKEKRGLSGKYQTSSKLFQNCSELFKTQTFSGDFMHRLPLLGEKQEAKENGTNLTFIGDKTAMHEPLQTWQDAPYIFIVHIGISSSKESSKENSLSNLFTMTVEVKGPYEYLTLEDYPLMIFFMVMCIVYVLFGVLWLAWSACYWRDLLRIQFWIGAVIFLGMLEKAVFYAEFQNIRYKGESVQGALILAELLSAVKRSLARTLVIIVSLGYGIVKPRLGVTLHKVVVAGALYLLFSGMEGVLRVTGAQTDLASLAFIPLAFLDTALCWWIFISLTQTMKLLKLRRNIVKLSLYRHFTNTLILAVAASIVFIIWTTMKFRIVTCQSDWRELWVDDAIWRLLFSMILFVIMVLWRPSANNQRFAFSPLSEEEEEDEQKEPMLKESFEGMKMRSTKQEPNGNSKVNKAQEDDLKWVEENVPSSVTDVALPALLDSDEERMITHFERSKME

SEQ ID NO: 4950 - protein, 555 aa, unidentified
MVAACRSVAGLLPRRRRCFPARAPLLRVALCLLCWTPAAVRAVPELGLWLETVNDKSGPLIFRKTMFNSTDIKLSVKSFHCSGPVKFTIVWHLKYHTCHNEHSNLEELFQKHKLSVDEDFCHYLKNDNCWTTKNENLDCNSDSQVFPSLNNKELINIRNVSNQERSMDVVARTQKDGFHIFIVSIKTENTDASWNLNVSLSMIGPHGYISASDWPLMIFYMVMCIVYILYGILWLTWSACYWKDILRIQFWIAAVIFLGMLEKAVFYSEYQNISNTGLSTQGLLIFAELISAIKRTLARLLVIIVSLGYGIVKPRLGTVMHRVIGLGLLYLIFAAVEGVMRVIGGSNHLAVVLDDIILAVIDSIFVWFIFISLAQTMKTLRLRKNTVKFSLYRHFKNTLIFAVLASIVFMGWTTKTFRIAKCQSDWMERWVDDAFWSFLFSLILIVIMFLWRPSANNQRYAFMPLIDDSDDEIEEFMVTSENLTEGIKLRASKSVSNGTAKPATSENFDEDLKWVEENIPSSFTDVALPVLVDSDEEIMTRSEMAEKMFSSEKIM

SEQ ID NO: 4951 - protein, 159 aa, unidentified
MADVPGAQRAVPGDGPEPRDPLDCWACAVLVTAQNLLVAAFNLLLLVLVLGTILLPAVTMLGFGFLCHSQFLRSQAPPCTAHLRDPGFTALLVTGFLLLVPLLVLALASYRRLCLRLRLADCLVPYSRALYRRRRAPQPRQIRASPGSQAVPTSGKVWV

SEQ ID NO: 4952 - protein, 163 aa, unidentified
MSEQGRETEEEEGGGGASDTAPMLPRGPPDHQASALTCPGWSGPPLLPGRLLAGLLLHLLLPAAAFLLVLLPAAAVVYLGFLCHSRVHPAPGPRCRALFSDRGSAALIVFGLLSLPPLLVLASAVRARLARRLRPLLPPPAGTPGPRRPPGRPDEDEQLCAWV

SEQ ID NO: 4953 - protein, 159 aa, unidentified
MLHVLASLPLLLLLVTSASTHAWSRPLWYQVGLDLQPWGCQPKSVEGCRGGLSCPGYWLGPGASRIYPVAAVMITTTMLMICRKILQGRRRSQATKGEHPQVTTEPCGPWKRRAPISDHTLLRGVLHMLDALLVHIEGHLRHLATQRQIQIKGTSTQSG

SEQ ID NO: 4954 - protein, 771 aa, unidentified
MGRAGTGTGGEAVAAVVAGPLLLLLLARPPPASAGYSGKSEVGLVSEHFSQAPQRLSFYSWYGSARLFRFRVPPDAVLLRWLLQVSRESGAACTDAEITVHFRSGAPPVINPLGTSFPDDTAVQPSFQVGVPLSTTPRSNASVNVSHPAPGDWFVAAHLPPSSQKIELKGLAPTCAYVFQPELLVTRVVEISIMEPDVPLPQTLLSHPSYLKVFVPDYTRELLLELRDCVSNGSLGCPVRLTVGPVTLPSNFQKVLTCTGAPWPCRLLLPSPPWDRWLQVTAESLVGPLGTVAFSAVAALTACRPRSVTIQPLLQSSQNQSFNASSGLLSPSPDHQDLGRSGRVDRSPFCLTNYPVTREDMDVVSVHFQPLDRVSVRVCSDTPSVMRLRLNTGMDSGGSLTISLRANKTEMRNETVVVACVNAASPFLGFNTSLNCTTAFFQGYPLSLSAWSRRANLIIPYPETDNWYLSLQLMCPENAEDCEQAVVHVETTLYLVPCLNDCGPYGQCLLLRRHSYLYASCSCKAGWRGWSCTDNSTAQTVAQQRAATLLLTLSNLMFLAPIAVSVRRFFLVEASVYAYTMFFSTFYHACDQPGEAVLCILSYDTLQYCDFLGSGAAIWVTILCMARLKTVLKYVLFLLGTLVIAMSLQLDRRGMWNMLGPCLFAFVIMASMWAYRCGHRRQCYPTSWQRWAFYLLPGVSMASVGIAIYTSMMTSDNYYYTHSIWHILLAGSAALLLPPPDQPAEPWACSQKFPCHYQICKNDREELYAVT

SEQ ID NO: 4955 - protein, 472 aa, unidentified
MNMPQSLGNQPLPPEPPSLGTPAEGPGTTSPPEHCWPVRPTLRNELDTFSVHFYIFFGPSVALPPERPAVFAMRLLPVLDSGGVLSLELQLNASSVRQENVTVFGCLTHEVPLSLGDAAVTCSKESLAGFLLSVSATTRVARLRIPFPQTGTWFLALRSLCGVGPRFVRCRNATAEVRMRTFLSPCVDDCGPYGQCKLLRTHNYLYAACECKAGWRGWGCTDSADALTYGFQLLSTLLLCLSNLMFLPPVVLAIRSRYVLEAAVYTFTMFFSTFYHACDQPGIVVFCIMDYDVLQFCDFLGSLMSVWVTVIAMARLQPVVKQVLYLLGAMLLSMALQLDRHGLWNLLGPSLFALGILATAWTVRSVRRRHCYPPTWRRWLFYLCPGSLIAGSAVLLYAFVETRDNYFYIHSIWHMLIAGSVGFLLPPRAKTDHGVPSGARARGCGYQLCINEQEELGLVGPGGATVSSICAS

SEQ ID NO: 4956 - protein, 221 aa, unidentified
MGTLVAKLLLPTLSSLAFLPTVSIAAKRRFHMEAMVYLFTLFFVALHHACNGPGLSVLCFMRHDILEYFSVYGTALSMWVSLMALADFDEPKRSTFVMFGVLTIAVRIYHDRWGYGVYSGPIGTAILIIAAKWLQKMKEKKGLYPDKSVYTQQIGPGLCFGALALMLRFFFEDWDYTYVHSFYHCALAMSFVLLLPKVNKKAGSPGTPAKLDCSTLCCACV

SEQ ID NO: 4957 - protein, 183 aa, unidentified
MKLLSLVAVVGCLLVPPAEANKSSEDIRCKCICPPYRNISGHIYNQNVSQKDCNCLHVVEPMPVPGHDVEAYCLLCECRYEERSTTTIKVIIVIYLSVVGALLLYMAFLMLVDPLIRKPDAYTEQLHNEEENEDARSMAAAAASLGGPRANTVLERVEGAQQRWKLQVQEQRKTVFDRHKMLS

SEQ ID NO: 4958 - protein, 172 aa, unidentified
MDSPSLRELQQPLLEGTECETPAQKPGRHELGSPLREIAFAESLRGLQFLSPPLPSVSAGLGEPRPPDVEDMSSSDSDSDWDGGSRLSPFLPHDHLGLAVFSMLCCFWPVGIAAFCLAQKTNKAWAKGDIQGAGAASRRAFLLGVLAVGLGVCTYAAALVTLAAYLASRDPP

SEQ ID NO: 4959 - protein, 159 aa, unidentified
MSQAWVPGLAPTLLFSLLAGPQKIAAKCGLILACPKGFKCCGDSCCQENELFPGPVRIFVIIFLVILSVFCICGLAKCFCRNCREPEPDSPVDCRGPLELPSIIPPERVRVSLSAPPPPYSEVILKPSLGPTPTEPPPPYSFRPEEYTGDQRGIDNPAF

SEQ ID NO: 4960 - protein, 1356 aa, unidentified
MDLKEKHLGEPPSALGLSTRKALSVLKEQLEAVLEGHLRERKKCLTWKEVWRSSFLHHSNRCSCFHWPGASLMLLAVLLLLGCCGGQPAGSRGVGLVNASALFLLLLLNLVLIGRQDRLKRREVERRLRGIIDQIQDALRDGREIQWPSAMYPDLHMPFAPSWSLHWAYRDGHLVNLPVSLLVEGDIIALRPGQESFASLRGIKDDEHIVLEPGDLFPPFSPPPSPRGEVERGPQSPQQHRLFRVLETPVIDNIRWCLDMALSRPVTALDNERFTVQSVMLHYAVPVVLAGFLITNALRFIFSAPGVTSWQYTLLQLQVNGVLPILPLLFPVLWVLATACGEARVLAQMSKASPSSLLAKFSEDTLSSYTEAVSSQEMLRCIWGHFLRVLGGTSPTLSHSSSLLHSLGSVTVLCCVDKQGILSWPNPSPETVLFFSGKVEPPHSSHEDLTDGLSTRSFCHPEPHERDALLAGSLNNTLHLSNEQERGDWPGEAPKPPEPYSHHKAHGRSKHPSGSNVSFSRDTEGGEEEPSKTQPGMESDPYEAEDFVCDYHLEMLSLSQDQQNPSCIQFDDSNWQLHLTSLKPLGLNVLLNLCDASVTERLCRFSDHLCNIALQESHSAVLPVHVPWGLCELARLIGFTPGAKELFKQENHLALYRLPSAETMKETSLGRLSCVTKRRPPLSHMISLFIKDTTTSTEQMLSHGTADVVLEACTDFWDGADIYPLSGSDRKKVLDFYQRACLSGYCSAFAYKPMNCALSSQLNGKCIELVQVPGQSSIFTMCELPSTIPIKQNARRSSWSSDEGIGEVLEKEDCMQALSGQIFMGMVSSQYQARLDIVRLIDGLVNACIRFVYFSLEDELKSKVFAEKMGLETGWNCHISLTPNGDMPGSEIPPSSPSHAGSLHDDLNQVSRDDAEGLLLMEEEGHSDLISFQPTDSDIPSFLEDSNRAKLPRGIHQVRPHLQNIDNVPLLVPLFTDCTPETMCEMIKIMQEYGEVTCCLGSSANLRNSCLFLQSDISIALDPLYPSRCSWETFGYATSISMAQASDGLSPLQLSGQLNSLPCSLTFRQEETISIIRLIEQARHATYGIRKCFLFLLQCQLTLVVIQFLSCLVQLPPLLSTTDILWLSCFCYPLLSISLLGKPPHSSIMSMATGKNLQSIPKKTQHYFLLCFLLKFSLTISSCLICFGFTLQSFCDSSRDRNLTNCSSVMLPSNDDRAPAWFEDFANGLLSAQKLTAALIVLHTVFISITHVHRTKPLWRKSPLTNLWWAVTVPVVLLGQVVQTAVDLQLWTHRDSHVHFGLEDVPLLTWLLGCLSLVLVVVTNEIVKLHEIRVRVRYQKRQKLQFETKLGMNSPF

SEQ ID NO: 4961 - protein, 176 aa, unidentified
MWRLALGGVFLAAAQACVFCRLPAHDLSGRLARLCSQMEARQKECGASPDFSAFALDEVSMNKVTEKTHRVLRVMEIKEAVSSLPSYWSWLRKTKLPEYTREALCPPACRGSTTLYNCSTCKGTEVSCWPRKRCFPGSQDLWEAKILLLSIFGAFLLLGVLSLLVESHHLQAKSGL

SEQ ID NO: 4962 - protein, 176 aa, unidentified
MGAPATRRCVEWLLGLYFLSHIPITLFMDLQAVLPRELYPVEFRNLLKWYAKEFKDPLLQEPPAWFKSFLFCELVFQLPFFPIATYAFLKGSCKWIRTPAIIYSVHTMTTLIPILSTFLFEDFSKASGFKGQRPETLHERLTLVSVYAPYLLIPFILLIFMLRSPYYKYEEKRKKK

SEQ ID NO: 4963 - protein, 226 aa, unidentified
METVVIVAIGVLATIFLASFAALVLVCRQRYCRPRDLLQRYDSKPIVDLIGAMETQSEPSELELDDVVITNPHIEAILENEDWIEDASGLMSHCIAILKICHTLTEKLVAMTMGSGAKMKTSASVSDIIVVAKRISPRVDDVVKSMYPPLDPKLLDARTTALLLSVSHLVLVTRNACHLTGGLDWIDQSLSAAEEHLEVLREAALASEPDKGLPGPEGFLQEQSAI

SEQ ID NO: 4964 - protein, 258 aa, unidentified
MVGILPLCCSGCVPSLCCSSYVPSVAPTAAHSVRVPHSAGHCGQRVLACSLPQVFLKPWIFVEHFSSWLSLELFSFLRYLGTLLCACGHRLREGLLLPCLLGVGSWLLFNNWTGGSWFSLHLQQVSLSQGSHVAAFLPEAIGPGVPVPVSGESTSAQQSHAGWQLSAEADACPSVLYSEVLEWNKNINTYTSFHDFCLILGIFLFCFVLAVIGLPYIKPGLSLSVALLWQSLILLSSLVQQDSQVHTWGCLFSTFTST

SEQ ID NO: 4965 - protein, 198 aa, unidentified
MATLWGGLLRLGSLLSLSCLALSVLLLAQLSDAAKNFEDVRCKCICPPYKENSGHIYNKNISQKDCDCLHVVEPMPVRGPDVEAYCLRCECKYEERSSVTIKVTIIIYLSILGLLLLYMVYLTLVEPILKRRLFGHAQLIQSDDDIGDHQPFANAHDVLARSRSRANVLNKVEYAQQRWKLQVQEQRKSVFDRHVVLS

SEQ ID NO: 4966 - protein, 156 aa, unidentified
MAGWPGAGPLCVLGGAALGVCLAGVAGQLVEPSTAPPKPKPPPLTKETVVFWDMRLWHVVGIFSLFVLSIIITLCCVFNCRVPRTRKEIEARYLQRKAAKMYTDKLETVPPLNELTEVPGEDKKKKKKKKKDSVDTVAIKVEEDEKNEAKKKKGEK

SEQ ID NO: 4967 - protein, 262 aa, unidentified
MAWKSSVIMQMGRFLLLVILFLPREMTSSVLTVNGKTENYILDTTPGSQASLICAVQNHTREEELLWYREEGRVDLKSGNKINSSSVCVSSISENDNGISFTCRLGRDQSVSVSVVLNVTFPPLLSGNDFQTVEEGSNVKLVCNVKANPQAQMMWYKNSSLLDLEKSRHQIQQTSESFQLSITKVEKPDNGTYSCIAKSSLKTESLDFHLIVKDKTVGVPIEPIIAACVVIFLTLCFGLIARRKKIMKLCMKDKDPHSETAL

SEQ ID NO: 4968 - protein, 282 aa, unidentified
MGSPGMVLGLLVQIWALQEASSLSVQQGPNLLQVRQGSQATLVCQVDQATAWERLRVKWTKDGAILCQPYITNGSLSLGVCGPQGRLSWQAPSHLTLQLDPVSLNHSGAYVCWAAVEIPELEEAEGNITRLFVDPDDPTQNRNRIASFPGFLFVLLGVGSMGVAAIVWGAWFWGRRSCQQRDSGNSPGNAFYSNVLYRPRGAPKKSEDCSGEGKDQRGQSIYSTSFPQPAPRQPHLASRPCPSPRPCPSPRPGHPVSMVRVSPRPSPTQQPRPKGFPKVGEE

SEQ ID NO: 4969 - protein, 454 aa, unidentified
MPEFLEDPSVLTKDKLKSELVANNVTLPAGEQRKDVYVQLYLQHLTARNRPPLPAGTNSKGPPDFSSDEEREPTPVLGSGAAAAGRSRAAVGRKATKKTDKPRQEDKDDLDVTELTNEDLLDQLVKYGVNPGPIVGTTRKLYEKKLLKLREQGTESRSSTPLPTISSSAENTRQNGSNDSDRYSDNEEDSKIELKLEKREPLKGRAKTPVTLKQRRVEHNQSYSQAGITETEWTSGSSKGGPLQALTRESTRGSRRTPRKRVETSEHFRIDGPVISESTPIAETIMASSNESLVVNRVTGNFKHASPILPITEFSDIPRRAPKKPLTRAEVGEKTEERRVERDILKEMFPYEASTPTGISASCRRPIKGAAGRPLELSDFRMEESFSSKYVPKYVPLADVKSEKTKKGRSIPVWIKILLFVVVAVFLFLVYQAMETNQVNPFSNFLHVDPRKSN

SEQ ID NO: 4970 - protein, 453 aa, unidentified
MAIFRQLSLGAKATLAAVTVFVSMIASRSYLAESLELRAWRWLLRLQLALFVNSLLLIGSLYIWRSTVSNLCHSPAAESTCFQLWKVVVLAFLALAHSSFFTMFFLVAEEPYLFSLAAYSCLGAYIIMLFFLFILSGMEQAYQLLAWRSGRVVGSLEKTRKLVLRPALAVGVTAVLSVAGILNAAQPPAVKTVEVPIHQLPASMNNLKIVLLSDIHLGPTVGRTKMEMFVRMVNVLEPDITVIVGDLSDSEASVLRTAVAPLGQLHSHLGAYFVTGNHEYYTSDVSNWFALLESLHVQPLHNENVKISATRAQRGGGGSGSGSEDEDWICLAGVDDIEADILHYSGHGMDLDKALEGCSPDHTIILLAHQPLAAKRALQARPDINLILSGHTHAGQIFPLNVAAYLLNPFFAGLYQVAQATFVYVSPGTAYYGIPMRLGSRAEITELILQRSP

SEQ ID NO: 4971 - protein, 421 aa, unidentified
MMYRTVGFGTRSRNLKPWMIAVLIVLSLTVVAVTIGLLVHFLVFDQKKEYYHGSFKILDPQINNNFGQSNTYQLKDLRETTENLVSQVDEIFIDSAWKKNYIKNQVVRLTPEEDGVKVDVIMVFQFPSTEQRAVREKKIQSILNQKIRNLRALPINASSVQVNAMSSSTGELTVQASCGKRVVPLNVNRIASGVIAPKAAWPWQASLQYDNIHQCGATLISNTWLVTAAHCFQKYKNPHQWTVSFGTKINPPLMKRNVRRFIIHEKYRSAAREYDIAVVQVSSRVTFSDDIRRICLPEASASFQPNLTVHITGFGALYYGGESQNDLREARVKIISDDVCKQPQVYGNDIKPGMFCAGYMEGIYDACRGDSGGPLVTRDLKDTWYLIGIVSWGDNCGQKDKPGVYTQVTYYRNWIASKTGI

SEQ ID NO: 4972 - protein, 416 aa, unidentified
MYRHGISSQRSWPLWTTIFIFLGVAAILGVTIGLLVHFLAVEKTYYYQGDFHISGVTYNDNCENAASQASTNLSKDIETKMLNAFQNSSIYKEYVKSEVIKLLPNANGSNVQLQLKFKFPPAEGVSMRTKIKAKLHQMLKNNMASWNAVPASIKLMEISKAASEMLTNNCCGRQVANSIITGNKIVNGKSSLEGAWPWQASMQWKGRHYCGASLISSRWLLSAAHCFAKKNNSKDWTVNFGIVVNKPYMTRKVQNIIFHENYSSPGLHDDIALVQLAEEVSFTEYIRKICLPEAKMKLSENDNVVVTGWGTLYMNGSFPVILQEDFLKIIDNKICNASYAYSGFVTDTMLCAGFMSGEADACQNDSGGPLAYPDSRNIWHLVGIVSWGDGCGKKNKPGVYTRVTSYRNWITSKTGL

SEQ ID NO: 4973 - protein, 418 aa, unidentified
MYRPARVTSTSRFLNPYVVCFIVVAGVVILAVTIALLVYFLAFDQKSYFYRSSFQLLNVEYNSQLNSPATQEYRTLSGRIESLITKTFKESNLRNQFIRAHVAKLRQDGSGVRADVVMKFQFTRNNNGASMKSRIESVLRQMLNNSGNLEINPSTEITSLTDQAAANWLINECGAGPDLITLSEQRILGGTEAEEGSWPWQVSLRLNNAHHCGGSLINNMWILTAAHCFRSNSNPRDWIATSGISTTFPKLRMRVRNILIHNNYKSATHENDIALVRLENSVTFTKDIHSVCLPAATQNIPPGSTAYVTGWGAQEYAGHTVPELRQGQVRIISNDVCNAPHSYNGAILSGMLCAGVPQGGVDACQGDSGGPLVQEDSRRLWFIVGIVSWGDQCGLPDKPGVYTRVTAYLDWIRQQTGI

SEQ ID NO: 4974 - protein, 423 aa, unidentified
MMYRPDVVRARKRVCWEPWVIGLVIFISLIVLAVCIGLTVHYVRYNQKKTYNYYSTLSFTTDKLYAEFGREASNNFTEMSQRLESMVKNAFYKSPLREEFVKSQVIKFSQQKHGVLAHMLLICRFHSTEDPETVDKIVQLVLHEKLQDAVGPPKVDPHSVKIKKINKTETDSYLNHCCGTRRSKTLGQSLRIVGGTEVEEGEWPWQASLQWDGSHRCGATLINATWLVSAAHCFTTYKNPARWTASFGVTIKPSKMKRGLRRIIVHEKYKHPSHDYDISLAELSSPVPYTNAVHRVCLPDASYEFQPGDVMFVTGFGALKNDGYSQNHLRQAQVTLIDATTCNEPQAYNDAITPRMLCAGSLEGKTDACQGDSGGPLVSSDARDIWYLAGIVSWGDECAKPNKPGVYTRVTALRDWITSKTGI

SEQ ID NO: 4975 - protein, 438 aa, unidentified
MMYAPVEFSEAEFSRAEYQRKQQFWDSVRLALFTLAIVAIIGIAIGIVTHFVVEDDKSFYYLASFKVTNIKYKENYGIRSSREFIERSHQIERMMSRIFRHSSVGGRFIKSHVIKLSPDEQGVDILIVLIFRYPSTDSAEQIKKKIEKALYQSLKTKQLSLTINKPSFRLTPIDSKKMRNLLNSRCGIRMTSSNMPLPASSSTQRIVQGRETAMEGEWPWQASLQLIGSGHQCGASLISNTWLLTAAHCFWKNKDPTQWIATFGATITPPAVKRNVRKIILHENYHRETNENDIALVQLSTGVEFSNIVQRVCLPDSSIKLPPKTSVFVTGFGSIVDDGPIQNTLRQARVETISTDVCNRKDVYDGLITPGMLCAGFMEGKIDACKGDSGGPLVYDNHDIWYIVGIVSWGQSCALPKKPGVYTRVTKYRDWIASKTGM

SEQ ID NO: 4976 - protein, 348 aa, unidentified
MRLGLLSVALLFVGSSHLYSDHYSPSGRHRLGPSPEPAASSQQAEAVRKRLRRRREGGAHAEDCGTAPLKDVLQGSRIIGGTEAQAGAWPWVVSLQIKYGRVLVHVCGGTLVRERWVLTAAHCTKDASDPLMWTAVIGTNNIHGRYPHTKKIKIKAIIIHPNFILESYVNDIALFHLKKAVRYNDYIQPICLPFDVFQILDGNTKCFISGWGRTKEEGNATNILQDAEVHYISREMCNSERSYGGIIPNTSFCAGDEDGAFDTCRGDSGGPLMCYLPEYKRFFVMGITSYGHGCGRRGFPGVYIGPSFYQKWLTEHFFHASTQGILTINILRGQILIALCFVILLATT

SEQ ID NO: 4977 - protein, 586 aa, unidentified
MERDSHGNASPARTPSAGASPAQASPAGTPPGRASPAQASPAQASPAGTPPGRASPAQASPAGTPPGRASPGRASPAQASPAQASPARASPALASLSRSSSGRSSSARSASVTTSPTRVYLVRATPVGAVPIRSSPARSAPATRATRESPGTSLPKFTWREGQKQLPLIGCVLLLIALVVSLIILFQFWQGHTGIRYKEQRESCPKHAVRCDGVVDCKLKSDELGCVRFDWDKSLLKIYSGSSHQWLPICSSNWNDSYSEKTCQQLGFESAHRTTEVAHRDFANSFSILRYNSTIQESLHRSECPSQRYISLQCSHCGLRAMTGRIVGGALASDSKWPWQVSLHFGTTHICGGTLIDAQWVLTAAHCFFVTREKVLEGWKVYAGTSNLHQLPEAASIAEIIINSNYTDEEDDYDIALMRLSKPLTLSAHIHPACLPMHGQTFSLNETCWITGFGKTRETDDKTSPFLREVQVNLIDFKKCNDYLVYDSYLTPRMMCAGDLRGGRDSCQGDSGGPLVCEQNNRWYLAGVTSWGTGCGQRNKPGVYTKVTEVLPWIYSKMEVRSLQQDTAPSRLGTSSGGDPGGAPRL

SEQ ID NO: 4978 - protein, 492 aa, unidentified
MALNSGSPPAIGPYYENHGYQPENPYPAQPTVVPTVYEVHPAQYYPSPVPQYAPRVLTQASNPVVCTQPKSPSGTVCTSKTKKALCITLTLGTFLVGAALAAGLLWKFMGSKCSNSGIECDSSGTCINPSNWCDGVSHCPGGEDENRCVRLYGPNFILQVYSSQRKSWHPVCQDDWNENYGRAACRDMGYKNNFYSSQGIVDDSGSTSFMKLNTSAGNVDIYKKLYHSDACSSKAVVSLRCIACGVNLNSSRQSRIVGGESALPGAWPWQVSLHVQNVHVCGGSIITPEWIVTAAHCVEKPLNNPWHWTAFAGILRQSFMFYGAGYQVEKVISHPNYDSKTKNNDIALMKLQKPLTFNDLVKPVCLPNPGMMLQPEQLCWISGWGATEEKGKTSEVLNAAKVLLIETQRCNSRYVYDNLITPAMICAGFLQGNVDSCQGDSGGPLVTSKNNIWWLIGDTSWGSGCAKAYRPGVYGNVMVFTDWIYRQMRADG

SEQ ID NO: 4979 - protein, 454 aa, unidentified
MGENDPPAVEAPFSFRSLFGLDDLKISPVAPDADAVAAQILSLLPLKFFPIIVIGIIALILALAIGLGIHFDCSGKYRCRSSFKCIELIARCDGVSDCKDGEDEYRCVRVGGQNAVLQVFTAASWKTMCSDDWKGHYANVACAQLGFPSYVSSDNLRVSSLEGQFREEFVSIDHLLPDDKVTALHHSVYVREGCASGHVVTLQCTACGHRRGYSSRIVGGNMSLLSQWPWQASLQFQGYHLCGGSVITPLWIITAAHCVYDLYLPKSWTIQVGLVSLLDNPAPSHLVEKIVYHSKYKPKRLGNDIALMKLAGPLTFNEMIQPVCLPNSEENFPDGKVCWTSGWGATEDGAGDASPVLNHAAVPLISNKICNHRDVYGGIISPSMLCAGYLTGGVDSCQGDSGGPLVCQERRLWKLVGATSFGIGCAEVNKPGVYTRVTSFLDWIHEQMERDLKT

SEQ ID NO: 4980 - protein, 437 aa, unidentified
MLQDPDSDQPLNSLDVKPLRKPRIPMETFRKVGIPIIIALLSLASIIIVVVLIKVILDKYYFLCGQPLHFIPRKQLCDGELDCPLGEDEEHCVKSFPEGPAVAVRLSKDRSTLQVLDSATGNWFSACFDNFTEALAETACRQMGYSSKPTFRAVEIGPDQDLDVVEITENSQELRMRNSSGPCLSGSLVSLHCLACGKSLKTPRVVGVEEASVDSWPWQVSIQYDKQHVCGGSILDPHWVLTAAHCFRKHTDVFNWKVRAGSDKLGSFPSLAVAKIIIIEFNPMYPKDNDIALMKLQFPLTFSGTVRPICLPFFDEELTPATPLWIIGWGFTKQNGGKMSDILLQASVQVIDSTRCNADDAYQGEVTEKMMCAGIPEGGVDTCQGDSGGPLMYQSDQWHVVGIVSWGYGCGGPSTPGVYTKVSAYLNWIYNVWKAEL

SEQ ID NO: 4981 - protein, 457 aa, unidentified
MSLMLDDQPPMEAQYAEEGPGPGIFRAEPGDQQHPISQAVCWRSMRRGCAVLGALGLLAGAGVGSWLLVLYLCPAASQPISGTLQDEEITLSCSEASAEEALLPALPKTVSFRINSEDFLLEAQVRDQPRWLLVCHEGWSPALGLQICWSLGHLRLTHHKGVNLTDIKLNSSQEFAQLSPRLGGFLEEAWQPRNNCTSGQVVSLRCSECGARPLASRIVGGQSVAPGRWPWQASVALGFRHTCGGSVLAPRWVVTAAHCMHSFRLARLSSWRVHAGLVSHSAVRPHQGALVERIIPHPLYSAQNHDYDVALLRLQTALNFSDTVGAVCLPAKEQHFPKGSRCWVSGWGHTHPSHTYSSDMLQDTVVPLFSTQLCNSSCVYSGALTPRMLCAGYLDGRADACQGDSGGPLVCPDGDTWRLVGVVSWGRGCAEPNHPGVYAKVAEFLDWIHDTAQDSLL

SEQ ID NO: 4982 - protein, 811 aa, unidentified
MLLLFHSKRMPVAEAPQVAGGQGDGGDGEEAEPEGMFKACEDSKRKARGYLRLVPLFVLLALLVLASAGVLLWYFLGYKAEVMVSQVYSGSLRVLNRHFSQDLTRRESSAFRSETAKAQKMLKELITSTRLGTYYNSSSVYSFGEGPLTCFFWFILQIPEHRRLMLSPEVVQALLVEELLSTVNSSAAVPYRAEYEVDPEGLVILEASVKDIAALNSTLGCYRYSYVGQGQVLRLKGPDHLASSCLWHLQGPKDLMLKLRLEWTLAECRDRLAMYDVAGPLEKRLITSVYGCSRQEPVVEVLASGAIMAVVWKKGLHSYYDPFVLSVQPVVFQACEVNLTLDNRLDSQGVLSTPYFPSYYSPQTHCSWHLTVPSLDYGLALWFDAYALRRQKYDLPCTQGQWTIQNRRLCGLRILQPYAERIPVVATAGITINFTSQISLTGPGVRVHYGLYNQSDPCPGEFLCSVNGLCVPACDGVKDCPNGLDERNCVCRATFQCKEDSTCISLPKVCDGQPDCLNGSDEEQCQEGVPCGTFTFQCEDRSCVKKPNPQCDGRPDCRDGSDEEHCDCGLQGPSSRIVGGAVSSEGEWPWQASLQVRGRHICGGALIADRWVITAAHCFQEDSMASTVLWTVFLGKVWQNSRWPGEVSFKVSRLLLHPYHEEDSHDYDVALLQLDHPVVRSAAVRPVCLPARSHFFEPGLHCWITGWGALREGGPISNALQKVDVQLIPQDLCSEVYRYQVTPRMLCAGYRKGKKDACQGDSGGPLVCKALSGRWFLAGLVSWGLGCGRPNYFGVYTRITGVISWIQQVVT

SEQ ID NO: 4983 - protein, 843 aa, unidentified
MDKENSDVSAAPADLKISNISVQVVSAQKKLPVRRPPLPGRRLPLPGRRPPQRPIGKAKPKKQSKKKVPFWNVQNKIILFTVFLFILAVIAWTLLWLYISKTESKDAFYFAGMFRITNIEFLPEYRQKESREFLSVSRTVQQVINLVYTTSAFSKFYEQSVVADVSSNNKGGLLVHFWIVFVMPRAKGHIFCEDCVAAILKDSIQTSIINRTSVGSLQGLAVDMDSVVLNAGLRSDYSSTIGSDKGCSQYFYAEHLSLHYPLEISAASGRLMCHFKLVAIVGYLIRLSIKSIQIEADNCVTDSLTIYDSLLPIRSSILYRICEPTRTLMSFVSTNNLMLVTFKSPHIRRLSGIRAYFEVIPEQKCENTVLVKDITGFEGKISSPYYPSYYPPKCKCTWKFQTSLSTLGIALKFYNYSITKKSMKGCEHGWWEINEHMYCGSYMDHQTIFRVPSPLVHIQLQCSSRLSDKPLLAEYGSYNISQPCPVGSFRCSSGLCVPQAQRCDGVNDCFDESDELFCVSPQPACNTSSFRQHGPLICDGFRDCENGRDEQNCTQSIPCNNRTFKCGNDICFRKQNAKCDGTVDCPDGSDEEGCTCSRSSSALHRIIGGTDTLEGGWPWQVSLHFVGSAYCGASVISREWLLSAAHCFHGNRLSDPTPWTAHLGMYVQGNAKFVSPVRRIVVHEYYNSQTFDYDIALLQLSIAWPETLKQLIQPICIPPTGQRVRSGEKCWVTGWGRRHEADNKGSLVLQQAEVELIDQTLCVSTYGIITSRMLCAGIMSGKRDACKGDSGGPLSCRRKSDGKWILTGIVSWGHGSGRPNFPGVYTRVSNFVPWIHKYVPSLL

SEQ ID NO: 4984 - protein, 1059 aa, unidentified
MEPTVADVHLVPRTTKEVPALDAACCRAASIGVVATSLVVLTLGVLLAFLSTQGFHVDHTAELRGIRWTSSLRRETSDYHRTLTPTLEALLHFLLRPLQTLSLGLEEELLQRGIRARLREHGISLAAYGTIVSAELTGRHKGPLAERDFKSGRCPGNSFSCGNSQCVTKVNPECDDQEDCSDGSDEAHCECGLQPAWRMAGRIVGGMEASPGEFPWQASLRENKEHFCGAAIINARWLVSAAHCFNEFQDPTKWVAYVGATYLSGSEASTVRAQVVQIVKHPLYNADTADFDVAVLELTSPLPFGRHIQPVCLPAATHIFPPSKKCLISGWGYLKEDFLVKPEVLQKATVELLDQALCASLYGHSLTDRMVCAGYLDGKVDSCQGDSGGPLVCEEPSGRFFLAGIVSWGIGCAEARRPGVYARVTRLRDWILEATTKASMPLAPTMAPAPAAPSTAWPTSPESPVVSTPTKSMQALSTVPLDWVTVPKLQECGARPAMEKPTRVVGGFGAASGEVPWQVSLKEGSRHFCGATVVGDRWLLSAAHCFNHTKVEQVRAHLGTASLLGLGGSPVKIGLRRVVLHPLYNPGILDFDLAVLELASPLAFNKYIQPVCLPLAIQKFPVGRKCMISGWGNTQEGNATKPELLQKASVGIIDQKTCSVLYNFSLTDRMICAGFLEGKVDSCQGDSGGPLACEEAPGVFYLAGIVSWGIGCAQVKKPGVYTRITRLKGWILEIMSSQPLPMSPPSTTRMLATTSPRTTAGLTVPGATPSRPTPGAASRVTGQPANSTLSAVSTTARGQTPFPDAPEATTHTQLPDCGLAPAALTRIVGGSAAGRGEWPWQVSLWLRRREHRCGAVLVAERWLLSAAHCFDVYGDPKQWAAFLGTPFLSGAEGQLERVARIYKHPFYNLYTLDYDVALLELAGPVRRSRLVRPICLPEPAPRPPDGTRCVITGWGSVREGGSMARQLQKAAVRLLSEQTCRRFYPVQISSRMLCAGFPQGGVDSCSGDAGGPLACREPSGRWVLTGVTSWGYGCGRPHFPGVYTRVAAVRGWIGQHIQE

SEQ ID NO: 4985 - protein, 882 aa, unidentified
MVVTTSARGGGGDRTPSRRRGCGLAPAGAAALLAGASCLCYGRSLQGEFVHDDVWAIVNNPDVRPGAPLRWGIFTNDFWGKGMAENTSHKSYRPLCVLTFKLNIFLTGMNPFYFHAVNIILHCLVTLVLMYTCDKTVFKNRGLAFVTALLFAVHPIHTEAVAGIVGRADVLACLLFLLAFLSYNRSLDQGCVGGSFPSTVSPFFLLLSLFLGTCAMLVKETGITVFGVCLVYDLFSLSNKQDKSSNGALCPRSPQQPGSPQPSSLPGHPHRENGKQQRFPHKGAWGGCHSPLPPEPKSSGFPVSPRAVWSMMRFLTYSYLLAFNVWLLLAPVTLCYDWQVGSIPLVETIWDMRNLATIFLAVVMALLSLHCLAAFKRLEHKEVLVGLLFLVFPFIPASNLFFRVGFVVAERVLYMPSMGYCILFVHGLSKLCTWLNRCGATTLIVSTVLLLLLFSWKTVKQNEIWLSRESLFRSGVQTLPHNAKVHYNYANFLKDQGRNKEAIYHYRTALKLYPRHASALNNLGTLTRDTAEAKMYYQRALQLHPQHNRALFNLGNLLKSQEKKEEAITLLKDSIKYGPEFADAYSSLASLLAEQERFKEAEEIYQTGIKNCPDSSDLHNNYGVFLVDTGLPEKAVAHYQQAIKLSPSHHVAMVNLGRLYRSLGENSMAEEWYKRALQVAHKAEILSPLGALYYNTGRYEEALQIYQEAAALQPSQRELRLALAQVLAVMGQTKEAEKMTNHIVSEETGCLECYRLLSAIYSKQENHDKALDAIDKALQLKPKDPKVISELFFTKGNQLREQNLLDKAFESYRVAVQLNPDQAQAWMNMGGIQHIKGKYVSARAYYERALQLVPDSKLLKENLAKLDRLEKRLQEVREKDQT

SEQ ID NO: 4986 - protein, 836 aa, unidentified
MIAELVSSALGLALYLNTLSADFCYDDSRAIKTNQDLLPETPWTHIFYNDFWGTLLTHSGSHKSYRPLCTLSFRLNHAIGGLNPWSYHLVNVLLHAAVTGLFTSFSKILLGDGYWTFMAGLMFASHPIHTEAVAGIVGRADVGASLFFLLSLLCYIKHCSTRGYSARTWGWFLGSGLCAGCSMLWKEQGVTVLAVSAVYDVFVFHRLKIKQILPTIYKRKNLSLFLSISLLIFWGSSLLGARLYWMGNKPPSFSNSDNPAADSDSLLTRTLTFFYLPTKNLWLLLCPDTLSFDWSMDAVPLLKTVCDWRNLHTVAFYTGLLLLAYYGLKSPSVDRECNGKTVTNGKQNANGHSCLSDVEYQNSETKSSFASKVENGIKNDVSQRTQLPSTENIVVLSLSLLIIPFVPATNLFFYVGFVIAERVLYIPSMGFCLLITVGARALYVKVQKRFLKSLIFYATATLIVFYGLKTAIRNGDWQNEEMLYRSGIKVNPAKAWGNLGNVLKSQSKISEAESAYRNALYYRSNMADMLYNLGLLLQENSRFAEALHYYKLAIGSRPTLASAYLNTGIILMNQGRTEEARRTFLKCSEIPDENLKDPHAHKSSVTSCLYNLGKLYHEQGHYEEALSVYKEAIQKMPRQFAPQSLYNMMGEAYMRLSKLPEAEHWYMESLRSKTDHIPAHLTYGKLLALTGRKSEAEKLFLKAIELDPTKGNCYMHYGQFLLEEARLIEAAEMAKKAAELDSTEFDVVFNAAHMLRQASLNEAAEKYYDLAARLRPNYPAALMNLGAILHLNGRLQKAEANYLRALQLKPDDVITQSNLRKLWNIMEKQGLKTSKT

SEQ ID NO: 4987 - protein, 915 aa, unidentified
MANINLKEITLIVGVVTACYWNSLFCGFVFDDVSAILDNKDLHPSTPLKTLFQNDFWGTPMSEERSHKSYRPLTVLTFRLNYLLSELKPMSYHLLNMIFHAVVSVIFLKVCKLFLDNKSSVIASLLFAVHPIHTEAVTGVVGRAELLSSIFFLAAFLSYTRSKGPDNSIIWTPIALTVFLVAVATLCKEQGITVVGICCVYEVFIAQGYTLPLLCTTAGQFLRGKGSIPFSMLQTLVKLIVLMFSTLLLVVIRVQVIQSQLPVFTRFDNPAAVSPTPTRQLTFNYLLPVNAWLLLNPSELCCDWTMGTIPLIESLLDIRNLATFTFFCFLGMLGVFSIRYSGDSSKTVLMALCLMALPFIPASNLFFPVGFVVAERVLYVPSMGFCILVAHGWQKISTKSVFKKLSWICLSMVILTHSLKTFHRNWDWESEYTLFMSALKVNKNNAKLWNNVGHALENEKNFERALKYFLQATHVQPDDIGAHMNVGRTYKNLNRTKEAEESYMMAKSLMPQIIPGKKYAARIAPNHLNVYINLANLIRANESRLEEADQLYRQAISMRPDFKQAYISRGELLLKMNKPLKAKEAYLKALELDRNNADLWYNLAIVHIELKEPNEALKKNFNRALELNPKHKLALFNSAIVMQESGEVKLRPEARKRLLSYINEEPLDANGYFNLGMLAMDDKKDNEAEIWMKKAIKLQADFRSALFNLALLYSQTAKELKALPILEELLRYYPDHIKGLILKGDILMNQKKDILGAKKCFERILEMDPSNVQGKHNLCVVYFEEKDLLKAERCLLETLALAPHEEYIQRHLNIVRDKISSSSFIEPIFPTSKISSVEGKKIPTESVKEIRGESRQTQIVKTSDNKSQSKSNKQLGKNGDEETPHKTTKDIKEIEKKRVAALKRLEEIERILNGE

SEQ ID NO: 4988 - protein, 741 aa, unidentified
MAVLDTDLDHILPSSVLPPFWAKLVVGSVAIVCFARSYDGDFVFDDSEAIVNNKDLQAETPLGDLWHHDFWGSRLSSNTSHKSYRPLTVLTFRINYYLSGGFHPVGFHVVNILLHSGISVLMVDVFSVLFGGLQYTSKGRRLHLAPRASLLAALLFAVHPVHTECVAGVVGRADLLCALFFLLSFLGYCKAFRESNKEGAHSSTFWVLLSIFLGAVAMLCKEQGITVLGLNAVFDILVIGKFNVLEIVQKVLHKDKSLENLGMLRNGGLLFRMTLLTSGGAGMLYVRWRIMGTGPPAFTEVDNPASFADSMLVRAVNYNYYYSLNAWLLLCPWWLCFDWSMGCIPLIKSISDWRVIALAALWFCLIGLICQALCSEDGHKRRILTLGLGFLVIPFLPASNLFFRVGFVVAERVLYLPSVGYCVLLTFGFGALSKHTKKKKLIAAVVLGILFINTLRCVLRSGEWRSEEQLFRSALSVCPLNAKVHYNIGKNLADKGNQTAAIRYYREAVRLNPKYVHAMNNLGNILKERNELQEAEELLSLAVQIQPDFAAAWMNLGIVQNSLKRFEAAEQSYRTAIKHRRKYPDCYYNLGRLYADLNRHVDALNAWRNATVLKPEHSLAWNNMIILLDNTGNLAQAEAVGREALELIPNDHSLMFSLANVLGKSQKYKESEALFLKAIKANPNAASYHGNLAVLYHRWGHLDLAKKHYEISLQLDPTASGTKENYGLLRRKLELMQKKAV

SEQ ID NO: 4989 - protein, 246 aa, unidentified
MTLIEGVGDEVTVLFSVLACLLVLALAWVSTHTAEGGDPLPQPSGTPTPSQPSAAMAATDSMRGEAPGAETPSLRHRGQAAQPEPSTGFTATPPAPDSPQEPLVLRLKFLNDSEQVARAWPHDTIGSLKRTQFPGREQQVRLIYQGQLLGDDTQTLGSLHLPPNCVLHCHVSTRVGPPNPPCPPGSEPGPSGLEIGSLLLPLLLLLLLLLWYCQIQYRPFFPLTATLGLAGFTLLLSLLAFAMYRP

SEQ ID NO: 4990 - protein, 321 aa, unidentified
MISRHLQNNLMSVDPASSQAMELSDVTLIEGVGNEVMVVAGVVVLILALVLAWLSTYVADSGSNQLLGAIVSAGDTSVLHLGHVDHLVAGQGNPEPTELPHPSEGNDEKAEEAGEGRGDSTGEAGAGGGVEPSLEHLLDIQGLPKRQAGAGSSSPEAPLRSEDSTCLPPSPGLITVRLKFLNDTEELAVARPEDTVGALKSKYFPGQESQMKLIYQGRLLQDPARTLRSLNITDNCVIHCHRSPPGSAVPGPSASLAPSATEPPSLGVNVGSLMVPVFVVLLGVVWYFRINYRQFFTAPATVSLVGVTVFFSFLVFGMYGR

SEQ ID NO: 4991 - protein, 280 aa, unidentified
MAPSGSLAVPLAVLVLLLWGAPWTHGRRSNVRVITDENWRELLEGDWMIEFYAPWCPACQNLQPEWESFAEWGEDLEVNIAKVDVTEQPGLSGRFIITALPTIYHCKDGEFRRYQGPRTKKDFINFISDKEWKSIEPVSSWFGPGSVLMSSMSALFQLSMWIRTCHNYFIEDLGLPVWGSYTVFALATLFSGLLLGLCMIFVADCLCPSKRRRPQPYPYPSKKLLSESAQPLKKVEEEQEADEEDVSEEEAESKEGTNKDFPQNAIRQRSLGPSLATDKS

SEQ ID NO: 4992 - protein, 296 aa, unidentified
MAVLAPLIALVYSVPRLSRWLAQPYYLLSALLSAAFLLVRKLPPLCHGLPTQREDGNPCDFDWREVEILMFLSAIVMMKNRRSITVEQHIGNIFMFSKVANTILFFRLDIRMGLLYITLCIVFLMTCKPPLYMGPEYIKYFNDKTIDEELERDKRVTWIVEFFANWSNDCQSFAPIYADLSLKYNCTGLNFGKVDVGRYTDVSTRYKVSTSPLTKQLPTLILFQGGKEAMRRPQIDKKGRAVSWTFSEENVIREFNLNELYQRAKKLSKAGDNIPEEQPVASTPTTVSDGENKKDK

SEQ ID NO: 4993 - protein, 454 aa, unidentified
MAAWKSWTALRLCATVVVLDMVVCKGFVEDLDESFKENRNDDIWLVDFYAPWCGHCKKLEPIWNEVGLEMKSIGSPVKVGKMDATSYSSIASEFGVRGYPTIKLLKGDLAYNYRGPRTKDDIIEFAHRVSGALIRPLPSQQMFEHMQKRHRVFFVYVGGESPLKEKYIDAASELIVYTYFFSASEEVVPEYVTLKEMPAVLVFKDETYFVYDEYEDGDLSSWINRERFQNYLAMDGFLLYELGDTGKLVALAVIDEKNTSVEHTRLKSIIQEVARDYRDLFHRDFQFGHMDGNDYINTLLMDELTVPTVVVLNTSNQQYFLLDRQIKNVEDMVQFINNILDGTVEAQGGDSILQRLKRIVFDAKSTIVSIFKSSPLMGCFLFGLPLGVISIMCYGIYTADTDGGYIEERYEVSKSENENQEQIEESKEQQEPSSGGSVVPTVQEPKDVLEKKKD

SEQ ID NO: 4994 - protein, 349 aa, unidentified
MAGGRCGPQLTALLAAWIAAVAATAGPEEAALPPEQSRVQPMTASNWTLVMEGEWMLKFYAPWCPSCQQTDSEWEAFAKNGEILQISVGKVDVIQEPGLSGRFFVTTLPAFFHAKDGIFRRYRGPGIFEDLQNYILEKKWQSVEPLTGWKSPASLTMSGMAGLFSISGKIWHLHNYFTVTLGIPAWCSYVFFVIATLVFGLFMGLVLVVISECFYVPLPRHLSERSEQNRRSEEAHRAEQLQDAEEEKDDSNEEENKDSLVDDEEEKEDLGDEDEAEEEEEEDNLAAGVDEERSEANDQGPPGEDGVTREEVEPEEAEEGISEQPCPADTEVVEDSLRQRKSQHADKGL

SEQ ID NO: 4995 - protein, 468 aa, unidentified
MAPPPARVHLGAFLAVTPNPGSAASGTEAAAATPSKVWGSSAGRIEPRGGGRGALPTSMGQHGPSARARAGRAPGPRPAREASPRLRVHKTFKFVVVGVLLQVVPSSAATIKLHDQSIGTQQWEHSPLGELCPPGSHRSEHPGACNRCTEGVGYTNASNNLFACLPCTACKSDEEERSPCTTTRNTACQCKPGTFRNDNSAEMCRKCSRGCPRGMVKVKDCTPWSDIECVHKESGNGHNIWVILVVTLVVPLLLVAVLIVCCCIGSGCGGDPKCMDRVCFWRLGLLRGPGAEDNAHNEILSNADSLSTFVSEQQMESQEPADLTGVTVQSPGEAQCLLGPAEAEGSQRRRLLVPANGADPTETLMLFFDKFANIVPFDSWDQLMRQLDLTKNEIDVVRAGTAGPGDALYAMLMKWVNKTGRNASIHTLLDALERMEERHAREKIQDLLVDSGKFIYLEDGTGSAVSLE

SEQ ID NO: 4996 - protein, 440 aa, unidentified
MEQRGQNAPAASGARKRHGPGPREARGARPGPRVPKTLVLVVAAVLLLVSAESALITQQDLAPQQRAAPQQKRSSPSEGLCPPGHHISEDGRDCISCKYGQDYSTHWNDLLFCLRCTRCDSGEVELSPCTTTRNTVCQCEEGTFREEDSPEMCRKCRTGCPRGMVKVGDCTPWSDIECVHKESGTKHSGEVPAVEETVTSSPGTPASPCSLSGIIIGVTVAAVVLIVAVFVCKSLLWKKVLPYLKGICSGGGGDPERVDRSSQRPGAEDNVLNEIVSILQPTQVPEQEMEVQEPAEPTGVNMLSPGESEHLLEPAEAERSQRRRLLVPANEGDPTETLRQCFDDFADLVPFDSWEPLMRKLGLMDNEIKVAKAEAAGHRDTLYTMLIKWVNKTGRDASVHTLLDALETLGERLAKQKIEDHLLSSGKFMYLEGNADSAMS

SEQ ID NO: 4997 - protein, 259 aa, unidentified
MARIPKTLKFVVVIVAVLLPVLAYSATTARQEEVPQQTVAPQQQRHSFKGEECPAGSHRSEHTGACNPCTEGVDYTNASNNEPSCFPCTVCKSDQKHKSSCTMTRDTVCQCKEGTFRNENSPEMCRKCSRCPSGEVQVSNCTSWDDIQCVEEFGANATVETPAAEETMNTSPGTPAPAAEETMNTSPGTPAPAAEETMTTSPGTPAPAAEETMTTSPGTPAPAAEETMITSPGTPASSHYLSCTIVGIIVLIVLLIVFV

SEQ ID NO: 4998 - protein, 386 aa, unidentified
MGLWGQSVPTASSARAGRYPGARTASGTRPWLLDPKILKFVVFIVAVLLPVRVDSATIPRQDEVPQQTVAPQQQRRSLKEEECPAGSHRSEYTGACNPCTEGVDYTIASNNLPSCLLCTVCKSGQTNKSSCTTTRDTVCQCEKGSFQDKNSPEMCRTCRTGCPRGMVKVSNCTPRSDIKCKNESAASSTGKTPAAEETVTTILGMLASPYHYLIIIVVLVIILAVVVVGFSCRKKFISYLKGICSGGGGGPERVHRVLFRRRSCPSRVPGAEDNARNETLSNRYLQPTQVSEQEIQGQELAELTGVTVESPEEPQRLLEQAEAEGCQRRRLLVPVNDADSADISTLLDASATLEEGHAKETIQDQLVGSEKLFYEEDEAGSATSCL

SEQ ID NO: 4999 - protein, 616 aa, unidentified
MAPRARRRRPLFALLLLCALLARLQVALQIAPPCTSEKHYEHLGRCCNKCEPGKYMSSKCTTTSDSVCLPCGPDEYLDSWNEEDKCLLHKVCDTGKALVAVVAGNSTTPRRCACTAGYHWSQDCECCRRNTECAPGLGAQHPLQLNKDTVCKPCLAGYFSDAFSSTDKCRPWTNCTFLGKRVEHHGTEKSDAVCSSSLPARKPPNEPHVYLPGLIILLLFASVALVAAIIFGVCYRKKGKALTANLWHWINEACGRLSGDKESSGDSCVSTHTANFGQQGACEGVLLLTLEEKTFPEDMCYPDQGGVCQGTCVGGGPYAQGEDARMLSLVSKTEIEEDSFRQMPTEDEYMDRPSQPTDQLLFLTEPGSKSTPPFSEPLEVGENDSLSQCFTGTQSTVGSESCNCTEPLCRTDWTPMSSENYLQKEVDSGHCPHWAASPSPNWADVCTGCRNPPGEDCEPLVGSPKRGPLPQCAYGMGLPPEEEASRTEARDQPEDGADGRLPSSARAGAGSGSSPGGQSPASGNVTGNSNSTFISSGQVMNFKGDIIVVYVSQTSQEGAAAAAEPMGRPVQEETLARRDSFAGNGPRFPDPCGGPEGLREPEKASRPVQEQGGAKA

SEQ ID NO: 5000 - protein, 129 aa, unidentified
MARGSLRRLLRLLVLGLWLALLRSVAGEQAPGTAPCSRGSSWSADLDKCMDCASCRARPHSDFCLGCAAAPPAPFRLLWPILGGALSLTFVLGLLSGFLVWRRCRRREKFTTPIEETGGEGCPAVALIQ

SEQ ID NO: 5001 - protein, 293 aa, unidentified
MSGLGRSRRGGRSRVDQEERFPQGLWTGVAMRSCPEEQYWDPLLGTCMSCKTICNHQSQRTCAAFCRSLSCRKEQGKFYDHLLRDCISCASICGQHPKQCAYFCENKLRSPVNLPPELRRQRSGEVENNSDNSGRYQGLEHRGSEASPALPGLKLSADQVALVYSTLGLCLCAVLCCFLVAVACFLKKRGDPCSCQPRSRPRQSPAKSSQDHAMEAGSPVSTSPEPVETCSFCFPECRAPTQESAVTPGTPDPTCAGRWGCHTRTTVLQPCPHIPDSGLGIVCVPAQEGGPGA

SEQ ID NO: 5002 - protein, 184 aa, unidentified
MRRGPRSLRGRDAPAPTPCVPAECFDLLVRHCVACGLLRTPRPKPAGASSPAPRTALQPQESVGAGAGEAALPLPGLLFGAPALLGLALVLALVLVGLVSWRRRQRRLRGASSAEAPDGDKDAPEPLDKVIILSPGISDATAPAWPPPGEDPGTTPPGHSVPVPATELGSTELVTTKTAGPEQQ

SEQ ID NO: 5003 - protein, 283 aa, unidentified
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHWVWWFLSGSLVIVIVCSTVGLIICVKRRKPRGDVVKVIVSVQRKRQEAEGEATVIEALQAPPDVTTVAVEETIPSFTGRSPNH

SEQ ID NO: 5004 - protein, 184 aa, unidentified
MLQMAGQCSQNEYFDSLLHACIPCQLRCSSNTPPLTCQRYCNASVTNSVKGTNAILWTCLGLSLIISLAVFVLMFLLRKINSEPLKDEFKNTGSGLLGMANIDLEKSRTGDEIILPRGLEYTVEECTCEDCIKSKPKVDSDHCFPLPAMEEGATILVTTKTNDYCKSLPAALSATEIEKSISAR

SEQ ID NO: 5005 - protein, 241 aa, unidentified
MAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEPLGWLTVVLLAVAACVLLLTSAQLGLHIWQLRSQCMWPRETQLLLEVPPSTEDARSCQFPEEERGERSAEEKGRLGDLWV

SEQ ID NO: 5006 - protein, 423 aa, unidentified
MALKVLLEQEKTFFTLLVLLGYLSCKVTCESGDCRQQEFRDRSGNCVPCNQCGPGMELSKECGFGYGEDAQCVTCRLHRFKEDWGFQKCKPCLDCAVVNRFQKANCSATSDAICGDCLPGFYRKTKLVGFQDMECVPCGDPPPPYEPHCASKVNLVKIASTASSPRDTALAAVICSALATVLLALLILCVIYCKRQFMEKKPSWSLRSQDIQYNGSELSCFDRPQLHEYAHRACCQCRRDSVQTCGPVRLLPSMCCEEACSPNPATLGCGVHSAASLQARNAGPAGEMVPTFFGSLTQSICGEFSDAWPLMQNPMGGDNISFCDSYPELTGEDIHSLNPELESSTSLDSNSSQDLVGGAVPVQSHSENFTAATDLSRYNNTLVESASTQDALTMRSQLDQESGAVIHPATQTSLQVRQRLGSL

SEQ ID NO: 5007 - protein, 455 aa, unidentified
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTVLLPLVIFFGLCLLSLLFIGLMYRYQRWKSKLYSIVCGKSTPEKEGELEGTTTKPLAPNPSFSPTPGFTPTLGFSPVPSSTFTSSSTYTPGDCPNFAAPRREVAPPYQGADPILATALASDPIPNPLQKWEDSAHKPQSLDTDDPATLYAVVENVPPLRWKEFVRRLGLSDHEIDRLELQNGRCLREAQYSMLATWRRRTPRREATLELLGRVLRDMDLLGCLEDIEEALCGPAALPPAPSLLR

SEQ ID NO: 5008 - protein, 461 aa, unidentified
MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDFALPVGLIVGVTALGLLIIGVVNCVIMTQVKKKPLCLQREAKVPHLPADKARGTQGPEQQHLLITAPSSSSSSLESSASALDRRAPTRNQPQAPGVEASGAGEARASTGSSDSSPGGHGTQVNVTCIVNVCSSSDHSSQCSSQASSTMGDTDSSPSESPKDEQVPFSKEECAFRSQLETPETLLGSTEEKPLPLGVPDAGMKPS

SEQ ID NO: 5009 - protein, 655 aa, unidentified
MGTSPSSSTALASCSRIARRATATMIAGSLLLLGFLSTTTAQPEQKASNLIGTYRHVDRATGQVLTCDKCPAGTYVSEHCTNTSLRVCSSCPVGTFTRHENGIEKCHDCSQPCPWPMIEKLPCAALTDRECTCPPGMFQSNATCAPHTVCPVGWGVRKKGTETEDVRCKQCARGTFSDVPSSVMKCKAYTDCLSQNLVVIKPGTKETDNVCGTLPSFSSSTSPSPGTAIFPRPEHMETHEVPSSTYVPKGMNSTESNSSASVRPKVLSSIQEGTVPDNTSSARGKEDVNKTLPNLQVVNHQQGPHHRHILKLLPSMEATGGEKSSTPIKGPKRGHPRQNLHKHFDINEHLPWMIVLFLLLVLVVIVVCSIRKSSRTLKKGPRQDPSAIVEKAGLKKSMTPTQNREKWIYYCNGHGIDILKLVAAQVGSQWKDIYQFLCNASEREVAAFSNGYTADHERAYAALQHWTIRGPEASLAQLISALRQHRRNDVVEKIRGLMEDTTQLETDKLALPMSPSPLSPSPIPSPNAKLENSALLTVEPSPQDKNKGFFVDESEPLLRCDSTSSGSSALSRNGSFITKEKKDTVLRQVRLDPCDLQPIFDDMLHFLNPEELRVIEEIPQAEDKLDRLFEIIGVKSQEASQTLLDSVYSHLPDLL

SEQ ID NO: 5010 - protein, 417 aa, unidentified
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQMFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 5011 - protein, 277 aa, unidentified
MCVGARRLGRGPCAALLLLGLGLSTVTGLHCVGDTYPSNDRCCHECRPGNGMVSRCSRSQNTVCRPCGPGFYNDVVSSKPCKPCTWCNLRSGSERKQLCTATQDTVCRCRAGTQPLDSYKPGVDCAPCPPGHFSPGDNQACKPWTNCTLAGKHTLQPASNSSDAICEDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 5012 - protein, 595 aa, unidentified
MRVLLAALGLLFLGALRAFPQDRPFEDTCHGNPSHYYDKAVRRCCYRCPMGLFPTQQCPQRPTDCRKQCEPDYYLDEADRCTACVTCSRDDLVEKTPCAWNSSRVCECRPGMFCSTSAVNSCARCFFHSVCPAGMIVKFPGTAQKNTVCEPASPGVSPACASPENCKEPSSGTIPQAKPTPVSPATSSASTMPVRGGTRLAQEAASKLTRAPDSPSSVGRPSSDPGLSPTQPCPEGSGDCRKQCEPDYYLDEAGRCTACVSCSRDDLVEKTPCAWNSSRTCECRPGMICATSATNSCARCVPYPICAAETVTKPQDMAEKDTTFEAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 5013 - protein, 255 aa, unidentified
MGNSCYNIVATLLLVLNFERTRSLQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 5014 - protein, 281 aa, unidentified [sequence omitted]

SEQ ID NO: 5015 - protein, 317 aa, unidentified
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDQDATYFGAFKVRDID

SEQ ID NO: 5016 - protein, 285 aa, unidentified
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLL

SEQ ID NO: 5017 - protein, 240 aa, unidentified
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVVHLEAGEKVVVRVLDERLVRLRDGTRSYFGAFMV

SEQ ID NO: 5018 - protein, 199 aa, unidentified
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTNKSKIQNVGGTYELHVGDTIDLIFNSEHQVLKNNTYWGIILLANPQFIS

SEQ ID NO: 5019 - protein, 234 aa, unidentified
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCESGMQTKHVYQNLSQFLLDYLQVNTTISVNVDTFQYIDTSTFPLENVLSIFLYSNSD

SEQ ID NO: 5020 - protein, 317 aa, unidentified
MAKNPPENCEDCHILNAEAFKSKKICKSLKICGLVFGILALTLIVLFWGSKHFWPEVPKKAYDMEHTFYSNGEKKKIYMEIDPVTRTEIFRSGNGTDETLEVHDFKNGYTGIYFVGLQKCFIKTQIKVIPEFSEPEEEIDENEEITTTFFEQSVIWVPAEKPIENRDFLKNSKILEICDNVTMYWINPTLISVSELQDFEEEGEDLHFPANEKKGIEQNEQWVVPQVKVEKTRHARQASEEELPINDYTENGIEFDPMLDERGYCCIYCRRGNRYCRRVCEPLLGYYPYPYCYQGGRVICRVIMPCNWWVARMLGRV

SEQ ID NO: 5021 - protein, 476 aa, unidentified
MAFGKSHRDPYATSVGHLIEKATFAGVQTEDWGQFMHICDIINTTQDGPKDAVKALKKRISKNYNHKEIQLTLSLIDMCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQKLYKTGREMQERIMDLLVVVENEDVTVELIQVNEDLNNAILGYERFTRNQQRILEQNKNQKEATNTTSEPSAPSQDLLDLSPSPRMPRATLGELNTMNNQLSGLNFSLPSSDVTNNLKPSLHPQMNLLALENTEIPPFAQRTSQNLTSSHAYDNFLEHSNSVFLQPVSLQTIAAAPSNQSLPPLPSNHPAMTKSDLQPPNYYEVMEFDPLAPAVTTEAIYEEIDAHQHKGAQNDGD

SEQ ID NO: 5022 - protein, 145 aa, unidentified
MVGRNSAIAAGVCGALFIGYCIYFDRKRRSDPNFKNRLRERRKKQKLAKERAGLSKLPDLKDAEAVQKFFLEEIQLGEELLAQGEYEKGVDHLTNAIAVCGQPQQLLQVLQQTLPPPVFQMLLTKLPTISQRIVSAQSLAEDDVE

SEQ ID NO: 5023 - protein, 152 aa, unidentified
MPSVRSLLRLLAAAAACGAFAFLGYCIYLNRKRRGDPAFKRRLRDKRRAEPQKAEEQGTQLWDPTKNKKLQELFLQEVRMGELWLSRGEHRMGIQHLGNALLVCEQPRELLKVFKHTLPPKVFEMLLHKIPLICQQFEADMNEQDCLEDDPD

SEQ ID NO: 5024 - protein, 142 aa, unidentified
MAAAVAAAGAGEPQSPDELLPKGDAEKPEEELEEDDDEELDETLSERLWGLTEMFPERVRSAAGATFDLSLFVAQKMYRFSRAALWIGTTSFMILVLPVVFETEKLQMEQQQQLQQRQILLGPNTGLSGGMPGALPSLPGKI

SEQ ID NO: 5025 - protein, 55 aa, unidentified
MVKLSKEAKQRLQQLFKGSQFAIRWGFIPLVIYLGFKRGADPGMPEPTVLSLLWG

SEQ ID NO: 5026 - protein, 608 aa, unidentified
MAASKPVEAAVVAAAVPSSGSGVGGGGTAGPGTGGLPRWQLALAVGAPLLLGAGAIYLWSRQQRRREARGRGDASGLKRNSERKTPEGRASPAPGSGHPEGPGAHLDMNSLDRAQAAKNKGNKYFKAGKYEQAIQCYTEAISLCPTEKNVDLSTFYQNRAAAFEQLQKWKEVAQDCTKAVELNPKYVKALFRRAKAHEKLDNKKECLEDVTAVCILEGFQNQQSMLLADKVLKLLGKEKAKEKYKNREPLMPSPQFIKSYFSSFTDDIISQPMLKGEKSDEDKDKEGEALEVKENSGYLKAKQYMEEENYDKIISECSKEIDAEGKYMAEALLLRATFYLLIGNANAAKPDLDKVISLKEANVKLRANALIKRGSMYMQQQQPLLSTQDFNMAADIDPQNADVYHHRGQLKILLDQVEEAVADFDECIRLRPESALAQAQKCFALYRQAYTGNNSSQIQAAMKGFEEVIKKFPRCAEGYALYAQALTDQQQFGKADEMYDKCIDLEPDNATTYVHKGLLQLQWKQDLDRGLELISKAIEIDNKCDFAYETMGTIEVQRGNMEKAIDMFNKAINLAKSEMEMAHLYSLCDAAHAQTEVAKKYGLKPPTL

SEQ ID NO: 5027 - protein, 583 aa, unidentified
MAGDGRRAEAVREGWGVYVTPRAPIREGRGRLAPQNGGSSDAPAYRTPPSRQGRREVRFSDEPPEVYGDFEPLVAKERSPVGKRTRLEEFRSDSAKEEVRESAYYLRSRQRRQPRPQETEEMKTRRTTRLQQQHSEQPPLQPSPVMTRRGLRDSHSSEEDEASSQTDLSQTISKKTVRSIQEAPVSEDLVIRLRRPPLRYPRYEATSVQQKVNFSEEGETEEDDQDSSHSSVTTVKARSRDSDESGDKTTRSSSQYIESFWQSSQSQNFTAHDKQPSVLSSGYQKTPQEWAPQTARIRTRMQNDSILKSELGNQSPSTSSRQVTGQPQNASFVKRNRWWLLPLIAALASGSFWFFSTPEVETTAVQEFQNQMNQLKNKYQGQDEKLWKRSQTFLEKHLNSSHPRSQPAILLLTAARDAEEALRCLSEQIADAYSSFRSVRAIRIDGTDKATQDSDTVKLEVDQELSNGFKNGQNAAVVHRFESFPAGSTLIFYKYCDHENAAFKDVALVLTVLLEEETLGTSLGLKEVEEKVRDFLKVKFTNSNTPNSYNHMDPDKLNGLWSRISHLVLPVQPENALKRGICL

SEQ ID NO: 5028 - protein, 470 aa, unidentified
MADSGLREPQEDSQKDLENDPSVNSQAQETTIIASNAEEAEILHSACGLSKDHQEVETEGPESADTGDKSESPDEANVGKHPKDKTEDENKQSFLDGGKGHHLPSENLGKEPLDPDPSHSPSDKVGRADAHLGSSSVALPKEASDGTGASQEPPTTDSQEAQSPGHSSAGQEGEDTLRRRLLAPEAGSHPQQTQKLEEIKENAQDTMRQINKKGFWSYGPVILVVLVVAVVASSVNSYYSSPAQQVPKNPALEAFLAQFSQLEDKFPGQSSFLWQRGRKFLQKHLNASNPTEPATIIFTAAREGRETLKCLSHHVADAYTSSQKVSPIQIDGAGRTWQDSDTVKLLVDLELSYGFENGQKAAVVHHFESFPAGSTLIFYKYCDHENAAFKDVALVLTVLLEEETLEASVGPRETEEKVRDLLWAKFTNSDTPTSFNHMDSDKLSGLWSRISHLVLPVQPVSSIEEQGCLF

SEQ ID NO: 5029 - protein, 189 aa, unidentified
MAAKQPPPLMKKHSQTDLVSRLKTRKILGVGGEDDDGEVHRSKISQVLGNEIKFTIREPLGLRVWQFVSAVLFSGIAIMALAFPDQLYDAVFDGAQVTSKTPIRLYGGALLSISLIMWNALYTAEKVIIRWTLLTEACYFGVQFLVVTATLAETGLMSLGILLLLVSRLLFVVISIYYYYQVGRRPKKA

SEQ ID NO: 5030 - protein, 393 aa, unidentified
MAPPPPSPQLLLLAALARLLGPSEVMAGPAEEAGAHCPESLWPLPPQVSPRVTYTRVSPGQAEDVTFLYHPCAHPWLKLQLALLAYACMANPSLTPDFSLTQDRPLVLTAWGLALEMAWVEPAWAAHWLMRRRRRKQRKKKAWIYCESLSGPAPSEPTPGRGRLCRRGCVQALALAFALRSWRPPGTEVTSQGPRQPSSSGAKRRRLRAALGPQPTRSALRFPSASPGSLKAKQSMAGIPGRESNAPSVPTVSLLPGAPGGNASSRTEAQVPNGQGSPGGCVCSSQASPAPRAAAPPRAARGPTPRTEEAAWAAMALTFLLVLLTLATLCTRLHRNFRRGESIYWGPTADSQDTVAAVLKRRLLQPSRRVKRSRRRPLLPPTPDSGPEGESSE

SEQ ID NO: 5031 - protein, 420 aa, unidentified
MPGGCSRGPAAGDGRLRLARLALVLLGWVSSSSPTSSASSFSSSAPFLASAVSAQPPLPDQCPALCECSEAARTVKCVNRNLTEVPTDLPAYVRNLFLTGNQLAVLPAGAFARRPPLAELAALNLSGSRLDEVRAGAFEHLPSLRQLDLSHNPLADLSPFAFSGSNASVSAPSPLVELILNHIVPPEDERQNRSFEGMVVAALLAGRALQGLRRLELASNHFLYLPRDVLAQLPSLRHLDLSNNSLVSLTYVSFRNLTHLESLHLEDNALKVLHNGTLAELQGLPHIRVFLDNNPWVCDCHMADMVTWLKETEVVQGKDRLTCAYPEKMRNRVLLELNSADLDCDPILPPSLQTSYVFLGIVLALIGAIFLLVLYLNRKGIKKWMHNIRDACRDHMEGYHYRYEINADPRLTNLSSNSDV

SEQ ID NO: 5032 - protein, 382 aa, unidentified
MAPRAGQPGLQGLLLVAAALSQPAAPCPFQCYCFGGPKLLLRCASGAELRQPPRDVPPDARNLTIVGANLTVLRAAAFAGGDGDGDQAAGVRLPLLSALRLTHNHIEVVEDGAFDGLPSLAALDLSHNPLRALGGGAFRGLPALRSLQLNHALVRGGPALLAALDAALAPLAELRLLGLAGNALSRLPPAALRLARLEQLDVRLNALAGLDPDELRALERDGGLPGPRLLLADNPLRCGCAARPLLAWLRNATERVPDSRRLRCAAPRALLDRPLLDLDGARLRCADSGADARGEEAEAAGPELEASYVFFGLVLALIGLIFLMVLYLNRRGIQRWMRNLREACRDQMEGYHYRYEQDADPRRAPAPAAPAGSRATSPGSGL

SEQ ID NO: 5033 - protein, 816 aa, unidentified
MAVSLDDDVPLILTLDEGGSAPLAPSNGLGQEELPSKNGGSYAIHDSQAPSLSSGGESSPSSPAHNWEMNYQEAAIYLQEGENNDKFFTHPKDAKALAAYLFAHNHLFYLMELATALLLLLLSLCEAPAVPALRLGIYVHATLELFALMVVVFELCMKLRWLGLHTFIRHKRTMVKTSVLVVQFVEAIVVLVRQMSHVRVTRALRCIFLVDCRYCGGVRRNLRQIFQSLPPFMDILLLLLFFMIIFAILGFYLFSPNPSDPYFSTLENSIVSLFVLLTTANFPDVMMPSYSRNPWSCVFFIVYLSIELYFIMNLLLAVVFDTFNDIEKRKFKSLLLHKRTAIQHAYRLLISQRRPAGISYRQFEGLMRFYKPRMSARERYLTFKALNQNNTPLLSLKDFYDIYEVAALKWKAKKNREHWFDELPRTALLIFKGINILVKSKAFQYFMYLVVAVNGVWILVETFMLKGGNFFSKHVPWSYLVFLTIYGVELFLKVAGLGPVEYLSSGWNLFDFSVTVFAFLGLLALALNMEPFYFIVVLRPLQLLRLFKLKERYRNVLDTMFELLPRMASLGLTLLIFYYSFAIVGMEFFCGIVFPNCCNTSTVADAYRWRNHTVGNRTVVEEGYYYLNNFDNILNSFVTLFELTVVNNWYIIMEGVTSQTSHWSRLYFMTFYIVTMVVMTIIVAFILEAFVFRMNYSRKNQDSEVDGGITLEKEISKEELVAVLELYREARGASSDVTRLLETLSQMERYQQHSMVFLGRRSRTKSDLSLKMYQEEIQEWYEEHAREQEQQRQLSSSAAPAAQQPPGSRQRSQTVT

SEQ ID NO: 5034 - protein, 752 aa, unidentified
MAEPQAESEPLLGGARGGGGDWPAGLTTYRSIQVGPGAAARWDLCIDQAVVFIEDAIQYRSINHRVDASSMWLYRRYYSNVCQRTLSFTIFLILFLAFIETPSSLTSTADVRYRAAPWEPPCGLTESVEVLCLLVFAADLSVKGYLFGWAHFQKNLWLLGYLVVLVVSLVDWTVSLSLVCHEPLRIRRLLRPFFLLQNSSMMKKTLKCIRWSLPEMASVGLLLAIHLCLFTMFGMLLFAGGKQDDGQDRERLTYFQNLPESLTSLLVLLTTANNPDVMIPAYSKNRAYAIFFIVFTVIGSLFLMNLLTAIIYSQFRGYLMKSLQTSLFRRRLGTRAAFEVLSSMVGEGGAFPQAVGVKPQNLLQVLQKVQLDSSHKQAMMEKVRSYGSVLLSAEEFQKLFNELDRSVVKEHPPRPEYQSPFLQSAQFLFGHYYFDYLGNLIALANLVSICVFLVLDADVLPAERDDFILGILNCVFIVYYLLEMLLKVFALGLRGYLSYPSNVFDGLLTVVLLVLEISTLAVYRLPHPGWRPEMVGLLSLWDMTRMLNMLIVFRFLRIIPSMKLMAVVASTVLGLVQNMRAFGGILVVVYYVFAIIGINLFRGVIVALPGNSSLAPANGSAPCGSFEQLEYWANNFDDFAAALVTLWNLMVVNNWQVFLDAYRRYSGPWSKIYFVLWWLVSSVIWVNLFLALILENFLHKWDPRSHLQPLAGTPEATYQMTVELLFRDILEEPGEDELTERLSQHPHLWLCR

SEQ ID NO: 5035 - protein, 284 aa, unidentified
MDAIKKKMQMLKLDKENALDRAEQAEADKKAAEDRSKQLEDELVSLQKKLKGTEDELDKYSEALKDAQEKLELAEKKATDAEADVASLNRRIQLVEEELDRAQERLATALQKLEEAEKAADESERGMKVIESRAQKDEEKMEIQEIQLKEAKHIAEDADRKYEEVARKLVIIESDLERAEERAELSEGKCAELEEELKTVTNNLKSLEAQAEKYSQKEDRYEEEIKVLSDKLKEAETRAEFAERSVTKLEKSIDDLEDELYAQKLKYKAISEELDHALNDMTSI

SEQ ID NO: 5036 - protein, 933 aa, unidentified
MRALAVLSVTLVMACTEAFFPFISRGKELLWGKPEESRVSSVLEESKRLVDTAMYATMQRNLKKRGILSPAQLLSFSKLPEPTSGVIARAAEIMETSIQAMKRKVNLKTQQSQHPTDALSEDLLSIIANMSGCLPYMLPPKCPNTCLANKYRPITGACNNRDHPRWGASNTALARWLPPVYEDGFSQPRGWNPGFLYNGFPLPPVREVTRHVIQVSNEVVTDDDRYSDLLMAWGQYIDHDIAFTPQSTSKAAFGGGADCQMTCENQNPCFPIQLPEEARPAAGTACLPFYRSSAACGTGDQGALFGNLSTANPRQQMNGLTSFLDASTVYGSSPALERQLRNWTSAEGLLRVHARLRDSGRAYLPFVPPRAPAACAPEPGIPGETRGPCFLAGDGRASEVPSLTALHTLWLREHNRLAAALKALNAHWSADAVYQEARKVVGALHQIITLRDYIPRILGPEAFQQYVGPYEGYDSTANPTVSNVFSTAAFRFGHATIHPLVRRLDASFQEHPDLPGLWLHQAFFSPWTLLRGGGLDPLIRGLLARPAKLQVQDQLMNEELTERLFVLSNSSTLDLASINLQRGRDHGLPGYNEWREFCGLPRLETPADLSTAIASRSVADKILDLYKHPDNIDVWLGGLAENFLPRARTGPLFACLIGKQMKALRDGDWFWWENSHVFTDAQRRELEKHSLSRVICDNTGLTRVPMDAFQVGKFPEDFESCDSITGMNLEAWRETFPQDDKCGFPESVENGDFVHCEESGRRVLVYSCRHGYELQGREQLTCTQEGWDFQPPLCKDVNECADGAHPPCHASARCRNTKGGFQCLCADPYELGDDGRTCVDSGRLPRVTWISMSLAALLIGGFAGLTSTVICRWTRTGTKSTLPISETGGGTPELRCGKHQAVGTSPQRAAAQDSEQESAGMEGRDTHRLPRAL

SEQ ID NO: 5037 - protein, 373 aa, unidentified
MDTLEEVTWANGSTALPPPLAPNISVPHRCLLLLYEDIGTSRVRYWDLLLLIPNVLFLIFLLWKLPSARAKIRITSSPIFITFYILVFVVALVGIARAVVSMTVSTSNAATVADKILWEITRFFLLAIELSVIILGLAFGHLESKSSIKRVLAITTVLSLAYSVTQGTLEILYPDAHLSAEDFNIYGHGGRQFWLVSSCFFFLVYSLVVILPKTPLKERISLPSRRSFYVYAGILALLNLLQGLGSVLLCFDIIEGLCCVDATTFLYFSFFAPLIYVAFLRGFFGSEPKILFSYKCQVDETEEPDVHLPQPYAVARREGLEAAGAAGASAASYSSTQFDSAGGVAYLDDIASMPCHTGSINSTDSERWKAINA

SEQ ID NO: 5038 - protein, 321 aa, unidentified
MALGACGLLLLLAVPGVSLRTLQPGCGRPQVSDAGGRIVGGHAAPAGAWPWQASLRLRRMHVCGGSLLSPQWVLTAAHCFSGSLNSSDYQVHLGELEITLSPHFSTVRQIILHSSPSGQPGTSGDIALVELSVPVTLSSRILPVCLPEASDDFCPGIRCWVTGWGYTREGEPLPPPYSLREVKVSVVDTETCRRDYPGPGGSILQPDMLCARGPGDACQDDSGGPLVCQVNGAWVQAGTVSWGEGCGRPNRPGVYTRVPAYVNWIRRHITASGGSESGYPRLPLLAGLFLPGLFLLLVSCVLLAKCLLHPSADGTPFPAPD

SEQ ID NO: 5039 - protein, 522 aa, unidentified [sequence omitted]

SEQ ID NO: 5040 - protein, 376 aa, unidentified
MDGEEQQPPHEANVEPVVPSEASEPVPRVLSGDPQNLSDVDAFNLLLEMKLKRRRQRPNLPRTVTQLVAEDGSRVYVVGTAHFSDDSKRDVVKTIREVQPDVVVVELCQYRVSMLKMDESTLLREAQELSLEKLQQAVRQNGLMSGLMQMLLLKVSAHITEQLGMAPGGEFREAFKEASKVPFCKFHLGDRPIPVTFKRAIAALSFWQKVRLAWGLCFLSDPISKDDVERCKQKDLLEQMMAEMIGEFPDLHRTIVSERDVYLTYMLRQAARRLELPRASDAEPRKCVPSVVVGVVGMGHVPGIEKNWSTDLNIQEIMTVPPPSVSGRVSRLAVKAAFFGLLGYSLYWMGRRTASLVLSLPAAQYCLQRVTEARHK

SEQ ID NO: 5041 - protein, 505 aa, unidentified
MSPWSWFLLQTLCLLPTGAASRRGAPGTANCELKPQQSELNSFLWTIKRDPPSYFFGTIHVPYTRVWDFIPDNSKEAFLQSSIVYFELDLTDPYTISALTSCQMLPQGENLQDVLPRDIYCRLKRHLEYVKLMMPLWMTPDQRGKGLYADYLFNAIAGNWERKRPVWVMLMVNSLTEVDIKSRGVPVLDLFLAQEAERLRKQTGAVEKVEEQCHPLNGLNFSQVIFALNQTLLQQESLRAGSLQIPYTTEDLIKHYNCGDLSSVILSHDSSQVPNFINATLPPQERITAQEIDSYLRRELIYKRNERIGKRVKALLEEFPDKGFFFAFGAGHFMGNNTVLDVLRREGYEVEHAPAGRPIHKGKSKKTSTRPTLSTIFAPKVPTLEVPAPEAVSSGHSTLPPLVSRPGSADTPSEAEQRFRKKRRRSQRRPRLRQFSDLWVRLEESDIVPQLQVPVLDRHISTELRLPRRGHSHHSQMVASSACLSLWTPVFWVLVLAFQTETPLL

SEQ ID NO: 5042 - protein, 551 aa, unidentified
MISPDPRPSPGLARWAESYEAKCERRQEIRESRRCRPNVTTCRQVGKTLRIQQREQLQRARLQQFFRRRNLELEEKGKAQHPQAREQGPSRRPGQVTVLKEPLSCARRISSPREQVTGTSSEVFPAQHPPPSGICRDLSDHLSSQAGGLPPQDTPIKKPPKHHRGTQTKAEGPTIKNDASQQTNYGVAVLDKEIIQLSDYLKEALQRELVLKQKMVILQDLLSTLIQASDSSWKGQLNEDKLKGKLRSLENQLYTCTQKYSPWGMKKVLLEMEDQKNSYEQKAKESLQKVLEEKMNAEQQLQSTQRSLALAEQKCEEWRSQYEALKEDWRTLGTQHRELESQLHVLQSKLQGADSRDLQMNQALRFLENEHQQLQAKIECLQGDRDLCSLDTQDLQDQLKRSEAEKLTLVTRVQQLQGLLQNQSLQLQEQEKLLTKKDQALPVWSPKSFPNEVEPEGTGKEKDWDLRDQLQKKTLQLQAKEKECRELHSELDNLSDEYLSCLRKLQHCREELNQSQQLPPRRQCGRWLPVLMVVIAAALAVFLANKDNLMI

SEQ ID NO: 5043 - protein, 374 aa, unidentified
MAIRKKSTKSPPVLSHEFVLQNHADIVSCVAMVFLLGLMFEITAKASIIFVTLQYNVTLPATEEQATESVSLYYYGIKDLATVFFYMLVAIIIHAVIQEYMLDKINRRMHFSKTKHSKFNESGQLSAFYLFACVWGTFILISENYISDPTILWRAYPHNLMTFQMKFFYISQLAYWLHAFPELYFQKTKKEDIPRQLVYIGLYLFHIAGAYLLNLNHLGLVLLVLHYFVEFLFHISRLFYFSNEKYQKGFSLWAVLFVLGRLLTLILSVLTVGFGLARAENQKLDFSTGNFNVLAVRIAVLASICVTQAFMMWKFINFQLRRWREHSAFQAPAVKKKPTVTKGRSSKKGTENGVNGTLTSNVADSPRNKKEKSS

SEQ ID NO: 5044 - protein, 369 aa, unidentified
MGLRKKSTKNPPVLSQEFILQNHADIVSCVGMFFLLGLVFEGTAEASIVFLTLQHSVAVPAAEEQATGSKSLYYYGVKDLATVFFYMLVAIIIHATIQEYVLDKINKRMQFTKAKQNKFNESGQFSVFYFFSCIWGTFILISENCLSDPTLIWKARPHSMMTFQMKFFYISQLAYWFHAFPELYFQKTKKQDIPRQLVYIGLHLFHITGAYLLYLNHLGLLLLVLHYFVELLSHMCGLFYFSDEKYQKGISLWAIVFILGRLVTLIVSVLTVGFHLAGSQNRNPDALTGNVNVLAAKIAVLSSSCTIQAYVTWNLITLWLQRWVEDSNIQASCMKKKRSRSSKKRTENGVGVETSNRVDCPPKRKEKSS

SEQ ID NO: 5045 - protein, 370 aa, unidentified
MAFRRRTKSYPLFSQEFVIHNHADIGFCLVLCVLIGLMFEVTAKTAFLFILPQYNISVPTADSETVHYHYGPKDLVTILFYIFITIILHAVVQEYILDKISKRLHLSKVKHSKFNESGQLVVFHFTSVIWCFYVVVTEGYLTNPRSLWEDYPHVHLPFQVKFFYLCQLAYWLHALPELYFQKVRKEEIPRQLQYICLYLVHIAGAYLLNLSRLGLILLLLQYSTEFLFHTARLFYFADENNEKLFSAWAAVFGVTRLFILTLAVLAIGFGLARMENQAFDPEKGNFNTLFCRLCVLLLVCAAQAWLMWRFIHSQLRHWREYWNEQSAKRRVPATPRLPARLIKRESGYHENGVVKAENGTSPRTKKLKSP

SEQ ID NO: 5046 - protein, 186 aa, unidentified
MSGISGCPFFLWGLLALLGLALVISLIFNISHYVEKQRQDKMYSYSSDHTRVDEYYIEDTPIYGNLDDMISEPMDENCYEQMKARPEKSVNKMQEATPSAQATNETQMCYASLDHSVKGKRRKPRKQNTHFSDKDGDEQLHAIDASVSKTTLVDSFSPESQAVEENIHDDPIRLFGLIRAKREPIN

SEQ ID NO: 5047 - protein, 729 aa, unidentified
MTEITAEGNASTTTTVIDSKNGSVPKSPGKVLKRTVTEDIVTTFSSPAAWLLVIALIITWSAVAIVMFDLVDYKNFSASSIAKIGSDPLKLVRDAMEETTDWIYGFFSLLSDIISSEDEEDDDGDEDTDKGEIDEPPLRKKEIHKDKTEKQEKPERKIQTKVTHKEKEKGKEKVREKEKPEKKATHKEKIEKKEKPETKTLAKEQKKAKTAEKSEEKTKKEVKGGKQEKVKQTAAKVKEVQKTPSKPKEKEDKEKAAVSKHEQKDQYAFCRYMIDIFVHGDLKPGQSPAIPPPLPTEQASRPTPASPALEEKEGEKKKAEKKVTSETKKKEKEDIKKKSEKETAIDVEKKEPGKASETKQGTVKIAAQAAAKKDEKKEDSKKTKKPAEVEQPKGKKQEKKEKHVEPAKSPKKEHSVPSDKQVKAKTERAKEEIGAVSIKKAVPGKKEEKTTKTVEQEIRKEKSGKTSSILKDKEPIKGKEEKVPASLKEKEPETKKDEKMSKAGKEVKPKPPQLQGKKEEKPEPQIKKEAKPAISEKVQIHKQDIVKPEKTVSHGKPEEKVLKQVKAVTIEKTAKPKPTKKAEHREREPPSIKTDKPKPTPKGTSEVTESGKKKTEISEKESKEKADMKHLREEKVSTRKESLQLHNVTKAEKPARVSKDVEDVPASKKAKEGTEDVSPTKQKSPISFFQCVYLDGYNGYGFQFPFTPADRPGESSGQANSPGQKQQGQ

SEQ ID NO: 5048 - protein, 234 aa, unidentified
MRKTRLWGLLWMLFVSELRAATKLTEEKYELKEGQTLDVKCDYTLEKFASSQKAWQIIRDGEMPKTLACTERPSKNSHPVQVGRIILEDYHDHGLLRVRMVNLQVEDSGLYQCVIYQPPKEPHMLFDRIRLVVTKGFSGTPGSNENSTQNVYKIPPTTTKALCPLYTSPRTVTQAPPKSTADVSTPDSEINLTNVTDIIRVPVFNIVILLAGGFLSKSLVFSVLFAVTLRSFVP

SEQ ID NO: 5049 - protein, 230 aa, unidentified
MEPLRLLILLFVTELSGAHNTTVFQGVAGQSLQVSCPYDSMKHWGRRKAWCRQLGEKGPCQRVVSTHNLWLLSFLRRWNGSTAITDDTLGGTLTITLRNLQPHDAGLYQCQSLHGSEADTLRKVLVEVLADPLDHRDAGDLWFPGESESFEDAHVEHSISRSLLEGEIPFPPTSILLLLACIFLIKILAASALWAAAWHGQKPGTHPPSELDCGHDPGYQLQTLPGLRDT

SEQ ID NO: 5050 - protein, 311 aa, unidentified
MGLTLLLLLLLGLEGQGIVGSLPEVLQAPVGSSILVQCHYRLQDVKAQKVWCRFLPEGCQPLVSSAVDRRAPAGRRTFLTDLGGGLLQVEMVTLQEEDAGEYGCMVDGARGPQILHRVSLNILPPEEEEETHKIGSLAENAFSDPAGSANPLEPSQDEKSIPLIWGAVLLVGLLVAAVVLFAVMAKRKQGNRLGVCGRFLSSRVSGMNPSSVVHHVSDSGPAAELPLDVPHIRLDSPPSFDNTTYTSLPLDSPSGKPSLPAPSSLPPLPPKVLVCSKPVTYATVIFPGGNKGGGTSCGPAQNPPNNQTPSS

SEQ ID NO: 5051 - protein, 321 aa, unidentified
MAPAFLLLLLLWPQGCVSGPSADSVYTKVRLLEGETLSVQCSYKGYKNRVEGKVWCKIRKKKCEPGFARVWVKGPRYLLQDDAQAKVVNITMVALKLQDSGRYWCMRNTSGILYPLMGFQLDVSPAPQTERNIPFTHLDNILKSGTVTTGQAPTSGPDAPFTTGVMVFTPGLITLPRLLASTRPASKTGYSFTATSTTSQGPRRTMGSQTVTASPSNARDSSAGPESISTKSGDLSTRSPTTGLCLTSRSLLNRLPSMPSIRHQDVYSTVLGVVLTLLVLMLIMVYGFWKKRHMASYSMCSDPSTRDPPGRPEPYVEVYLI

SEQ ID NO: 5052 - protein, 200 aa, unidentified
MAWGGVHTCCFHLCCCCSWPQGAVPEELHKHPGQTLLLQCQYSPKRGPYQPKSWCQQTSPSRCTLLVTSSKPWTAVQKSHYTIWDKPNAGFFNITMIQLTQNDSGFYWCGIYNASENIITVLRNISLVVSPAPTTSPMWTLPWLPTSTVLITSPEGTSGHPSINGSETRKSRAPACLGSGGPRFLVLVLCGLLLAKGLML

SEQ ID NO: 5053 - protein, 314 aa, unidentified
MGSQALPPGPMQTLIFFDMEATGLPFSQPKVTELCLLAVHRCALESPPTSQGPPPTVPPPPRVVDKLSLCVAPGKACSPAASEITGLSTAVLAAHGRQCFDDNLANLLLAFLRRQPQPWCLVAHNGDRYDFPLLQAELAMLGLTSALDGAFCVDSITALKALERASSPSEHGPRKSYSLGSIYTRLYGQSPPDSHTAEGDVLALLSICQWRPQALLRWVDAHARPFGTIRPMYGVTASARTKPRPSAVTTTAHLATTRNTSPSLGESRGTKDLPPVKDPGALSREGLLAPLGLLAILTLAVATLYGLSLATPGE

SEQ ID NO: 5054 - protein, 1024 aa, unidentified
MGEDDAALRAGSRGLSDPWADSVGVRPRTTERHIAVHKRLVLAFAVSLVALLAVTMLAVLLSLRFDECGASATPGADGGPSGFPERGGNGSLPGSARRNHHAGGDSWQPEAGGVASPGTTSAQPPSEEEREPWEPWTQLRLSGHLKPLHYNLMLTAFMENFTFSGEVNVEIACRNATRYVVLHASRVAVEKVQLAEDRAFGAVPVAGFFLYPQTQVLVVVLNRTLDAQRNYNLKIIYNALIENELLGFFRSSYVLHGERRFLGVTQFSPTHARKAFPCFDEPIYKATFKISIKHQATYLSLSNMPVETSVFEEDGWVTDHFSQTPLMSTYYLAWAICNFTYRETTTKSGVVVRLYARPDAIRRGSGDYALHITKRLIEFYEDYFKVPYSLPKLDLLAVPKHPYAAMENWGLSIFVEQRILLDPSVSSISYLLDVTMVIVHEICHQWFGDLVTPVWWEDVWLKEGFAHYFEFVGTDYLYPGWNMEKQRFLTDVLHEVMLLDGLASSHPVSQEVLQATDIDRVFDWIAYKKGAALIRMLANFMGHSVFQRGLQDYLTIHKYGNAARNDLWNTLSEALKRNGKYVNIQEVMDQWTLQMGYPVITILGNTTAENRIIITQQHFIYDISAKTKALKLQNNSYLWQIPLTIVVGNRSHVSSEAIIWVSNKSEHHRITYLDKGSWLLGNINQTGYFRVNYDLRNWRLLIDQLIRNHEVLSVSNRAGLIDDAFSLARAGYLPQNIPLEIIRYLSEEKDFLPWHAASRALYPLDKLLDRMENYNIFNEYILKQVATTYIKLGWPKNNFNGSLVQASYQHEELRREVIMLACSFGNKHCHQQASTLISDWISSNRNRIPLNVRDIVYCTGVSLLDEDVWEFIWMKFHSTTAVSEKKILLEALTCSDDRNLLNRLLNLSLNSEVVLDQDAIDVIIHVARNPHGRDLAWKFFRDKWKILNTRYGEALFMNSKLISGVTEFLNTEGELKELKNFMKNYDGVAAASFSRAVETVEANVRWKMLYQDELFQWLGKALRH

SEQ ID NO: 5055 - protein, 398 aa, unidentified
MENETVSELNQTQLQPRAVVALEYQVVTILLVLIICGLGIVGNIMVVLVVMRTKHMRTPTNCYLVSLAVADLMVLVAAGLPNITDSIYGSWVYGYVGCLCITYLQYLGINASSCSITAFTIERYIAICHPIKAQFLCTFSRAKKIIIFVWAFTSLYCMLWFFLLDLNISTYKDAIVISCGYKISRNYYSPIYLMDFGVFYVVPMILATVLYGFIARILFLNPIPSDPKENSKTWKNDSTHQNTNLNVNTSNRCFNSTVSSRKQVTKMLAVVVILFALLWMPYRTLVVVNSFLSSPFQENWFLLFCRICIYLNSAINPVIYNLMSQKFRAAFRKLCNCKQKPTEKPANYSVALNYSVIKESDHFSTELDDITVTDTYLSATKVSFDDTCLASEVSFSQS

SEQ ID NO: 5056 - protein, 343 aa, unidentified
MNIHRSTPITIARYGRSRNKTQDFEELSSIRSAEPSQSFSPNLGSPSPPETPNLSHCVSCIGKYLLLEPLEGDHVFRAVHLHSGEELVCKVFDISCYQESLAPCFCLSAHSNINQITEIILGETKAYVFFERSYGDMHSFVRTCKKLREEEAARLFYQIASAVAHCHDGGLVLRDLKLRKFIFKDEERTRVKLESLEDAYILRGDDDSLSDKHGCPAYVSPEILNTSGSYSGKAADVWSLGVMLYTMLVGRYPFHDIEPSSLFSKIRRGQFNIPETLSPKAKCLIRSILRREPSERLTSQEILDHPWFSTDFSVSNSAYGAKEVSDQLVPDVNMEENLDPFFN

SEQ ID NO: 5057 - protein, 407 aa, unidentified
MELLEEDLTCPICCSLFDDPRVLPCSHNFCKKCLEGILEGSVRNSLWRPAPFKCPTCRKETSATGINSLQVNYSLKGIVEKYNKIKISPKMPVCKGHLGQPLNIFCLTDMQLICGICATRGEHTKHVFCSIEDAYAQERDAFESLFQSFETWRRGDALSRLDTLETSKRKSLQLLTKDSDKVKEFFEKLQHTLDQKKNEILSDFETMKLAVMQAYDPEINKLNTILQEQRMAFNIAEAFKDVSEPIVFLQQMQEFREKIKVIKETPLPPSNLPASPLMKNFDTSQWEDIKLVDVDKLSLPQDTGTFISKIPWSFYKLFLLILLLGLVIVFGPTMFLEWSLFDDLATWKGCLSNFSSYLTKTADFIEQSVFYWEQVTDGFFIFNERFKNFTLVVLNNVAEFVCKYKLL

SEQ ID NO: 5058 - protein, 548 aa, unidentified
MSASLNYKSFSKEQQTMDNLEKQLICPICLEMFTKPVVILPCQHNLCRKCASDIFQASNPYLPTRGGTTMASGGRFRCPSCRHEVVLDRHGVYGLQRNLLVENIIDIYKQESTRPEKKSDQPMCEEHEEERINIYCLNCEVPTCSLCKVFGAHKDCQVAPLTHVFQRQKSELSDGIAILVGSNDRVQGVISQLEDTCKTIEECCRKQKQELCEKFDYLYGILEERKNEMTQVITRTQEEKLEHVRALIKKYSDHLENVSKLVESGIQFMDEPEMAVFLQNAKTLLKKISEASKAFQMEKIEHGYENMNHFTVNLNREEKIIREIDFYREDEDEEEEEGGEGEKEGEGEVGGEAVEVEEVENVQTEFPGEDENPEKASELSQVELQAAPGALPVSSPEPPPALPPAADAPVTQGEVVPTGSEQTTESETPVPAAAETADPLFYPSWYKGQTRKATTNPPCTPGSEGLGQIGPPGSEDSNVRKAEVAAAAASERAAVSGKETSAPAATSQIGFEAPPLQGQAAAPASGSGADSEPARHIFSFSWLNSLNE

SEQ ID NO: 5059 - protein, 403 aa, unidentified
MHNFEEELTCPICYSIFEDPRVLPCSHTFCRNCLENILQASGNFYIWRPLRIPLKCPNCRSITEIAPTGIESLPVNFALRAIIEKYQQEDHPDIVTCPEHYRQPLNVYCLLDKKLVCGHCLTIGQHHGHPIDDLQSAYLKEKDTPQKLLEQLTDTHWTDLTHLIEKLKEQKSHSEKMIQGDKEAVLQYFKELNDTLEQKKKSFLTALCDVGNLINQEYTPQIERMKEIREQQLELMALTISLQEESPLKFLEKVDDVRQHVQILKQRPLPEVQPVEIYPRVSKILKEEWSRTEIGQIKNVLIPKMKISPKRMSCSWPGKDEKEVEFLKILNIVVVTLISVILMSILFFNQHIITFLSEITLIWFSEASLSVYQSLSNSLHKVKNILCHIFYLLKEFVWKIVSH

SEQ ID NO: 5060 - protein, 86 aa, unidentified
MGRKDAATIKLPVDQYRKQIGKQDYKKTKPILRATKLKAEAKKTAIGIKEVGLVLAAILALLLAFYAFFYLRLTTDVDPDLDQDED

SEQ ID NO: 5061 - protein, 1119 aa, unidentified
MKRSLRKMWRPGEKKEPQGVVYEDVPDDTEDFKESLKVVFEGSAYGLQNFNKQKKLKRCDDMDTFFLHYAAAEGQIELMEKITRDSSLEVLHEMDDYGNTPLHCAVEKNQIESVKFLLSRGANPNLRNFNMMAPLHIAVQGMNNEVMKVLLEHRTIDVNLEGENGNTAVIIACTTNNSEALQILLKKGAKPCKSNKWGCFPIHQAAFSGSKECMEIILRFGEEHGYSRQLHINFMNNGKATPLHLAVQNGDLEMIKMCLDNGAQIDPVEKGRCTAIHFAATQGATEIVKLMISSYSGSVDIVNTTDGCHETMLHRASLFDHHELADYLISVGADINKIDSEGRSPLILATASASWNIVNLLLSKGAQVDIKDNFGRNFLHLTVQQPYGLKNLRPEFMQMQQIKELVMDEDNDGCTPLHYACRQGGPGSVNNLLGFNVSIHSKSKDKKSPLHFAASYGRINTCQRLLQDISDTRLLNEGDLHGMTPLHLAAKNGHDKVVQLLLKKGALFLSDHNGWTALHHASMGGYTQTMKVILDTNLKCTDRLDEDGNTALHFAAREGHAKAVALLLSHNADIVLNKQQASFLHLALHNKRKEVVLTIIRSKRWDECLKIFSHNSPGNKCPITEMIEYLPECMKVLLDFCMLHSTEDKSCRDYYIEYNFKYLQCPLEFTKKTPTQDVIYEPLTALNAMVQNNRIELLNHPVCKEYLLMKWLAYGFRAHMMNLGSYCLGLIPMTILVVNIKPGMAFNSTGIINETSDHSEILDTTNSYLIKTCMILVFLSSIFGYCKEAGQIFQQKRNYFMDISNVLEWIIYTTGIIFVLPLFVEIPAHLQWQCGAIAVYFYWMNFLLYLQRFENCGIFIVMLEVILKTLLRSTVVFIFLLLAFGLSFYILLNLQDPFSSPLLSIIQTFSMMLGDINYRESFLEPYLRNELAHPVLSFAQLVSFTIFVPIVLMNLLIGLAVGDIAEVQKHASLKRIAMQVELHTSLEKKLPLWFLRKVDQKSTIVYPNKPRSGGMLFHIFCFLFCTGEIRQEIPNADKSLEMEILKQKYRLKDLTFLLEKQHELIKLIIQKMEIISETEDDDSHCSFQDRFKKEQMEQRNSRWNTVLRAVKAKTHHLEP

SEQ ID NO: 5062 - protein, 793 aa, unidentified
MMAALYPSTDLSGASSSSLPSSPSSSSPNEVMALKDVREVKEENTLNEKLFLLACDKGDYYMVKKILEENSSGDLNINCVDVLGRNAVTITIENENLDILQLLLDYGCQSADALLVAIDSEVVGAVDILLNHRPKRSSRPTIVKLMERIQNPEYSTTMDVAPVILAAHRNNYEILTMLLKQDVSLPKPHAVGCECTLCSAKNKKDSLRHSRFRLDIYRCLASPALIMLTEEDPILRAFELSADLKELSLVEVEFRNDYEELARQCKMFAKDLLAQARNSRELEVILNHTSSDEPLDKRGLLEERMNLSRLKLAIKYNQKEFVSQSNCQQFLNTVWFGQMSGYRRKPTCKKIMTVLTVGIFWPVLSLCYLIAPKSQFGRIIHTPFMKFIIHGASYFTFLLLLNLYSLVYNEDKKNTMGPALERIDYLLILWIIGMIWSDIKRLWYEGLEDFLEESRNQLSFVMNSLYLATFALKVVAHNKFHDFADRKDWDAFHPTLVAEGLFAFANVLSYLRLFFMYTTSSILGPLQISMGQMLQDFGKFLGMFLLVLFSFTIGLTQLYDKGYTSKEQKDCVGIFCEQQSNDTFHSFIGTCFALFWYIFSLAHVAIFVTRFSYGEELQSFVGAVIVGTYNVVVVIVLTKLLVAMLHKSFQLIANHEDKEWKFARAKLWLSYFDDKCTLPPPFNIIPSPKTICYMISSLSKWICSHTSKGKVKRQNSLKEWRNLKQKRDENYQKVMCCLVHRYLTSMRQKMQSTDQATVENLNELRQDLSKFRNEIRDLLGFRTSKYAMFYPRN

SEQ ID NO: 5063 - protein, 836 aa, unidentified
MREKGRRQAVRGPAFMFNDRGTSLTAEEERFLDAAEYGNIPVVRKMLEESKTLNVNCVDYMGQNALQLAVGNEHLEVTELLLKKENLARIGDALLLAISKGYVRIVEAILNHPGFAASKRLTLSPCEQELQDDDFYAYDEDGTRFSPDITPIILAAHCQKYEVVHMLLMKGARIERPHDYFCKCGDCMEKQRHDSFSHSRSRINAYKGLASPAYLSLSSEDPVLTALELSNELAKLANIEKEFKNDYRKLSMQCKDFVVGVLDLCRDSEEVEAILNGDLESAEPLEVHRHKASLSRVKLAIKYEVKKFVAHPNCQQQLLTIWYENLSGLREQTIAIKCLVVLVVALGLPFLAIGYWIAPCSRLGKILRSPFMKFVAHAASFIIFLGLLVFNASDRFEGITTLPNITVTDYPKQIFRVKTTQFTWTEMLIMVWVLGMMWSECKELWLEGPREYILQLWNVLDFGMLSIFIAAFTARFLAFLQATKAQQYVDSYVQESDLSEVTLPPEIQYFTYARDKWLPSDPQIISEGLYAIAVVLSFSRIAYILPANESFGPLQISLGRTVKDIFKFMVLFIMVFFAFMIGMFILYSYYLGAKVNAAFTTVEESFKTLFWSIFGLSEVTSVVLKYDHKFIENIGYVLYGIYNVTMVVVLLNMLIAMINSSYQEIEDDSDVEWKFARSKLWLSYFDDGKTLPPPFSLVPSPKSFVYFIMRIVNFPKCRRRRLQKDIEMGMGNSKSRLNLFTQSNSRVFESHSFNSILNQPTRYQQIMKRLIKRYVLKAQVDKENDEVNEGELKEIKQDISSLRYELLEDKSQATEELAILIHKLSEKLNPSMLRCE

SEQ ID NO: 5064 - protein, 977 aa, unidentified
MAQFYYKRNVNAPYRDRIPLRIVRAESELSPSEKAYLNAVEKGDYASVKKSLEEAEIYFKININCIDPLGRTALLIAIENENLELIELLLSFNVYVGDALLHAIRKEVVGAVELLLNHKKPSGEKQVPPILLDKQFSEFTPDITPIILAAHTNNYEIIKLLVQKGVSVPRPHEVRCNCVECVSSSDVDSLRHSRSRLNIYKALASPSLIALSSEDPFLTAFQLSWELQELSKVENEFKSEYEELSRQCKQFAKDLLDQTRSSRELEIILNYRDDNSLIEEQSGNDLARLKLAIKYRQKEFVAQPNCQQLLASRWYDEFPGWRRRHWAVKMVTCFIIGLLFPVFSVCYLIAPKSPLGLFIRKPFIKFICHTASYLTFLFLLLLASQHIDRSDLNRQGPPPTIVEWMILPWVLGFIWGEIKQMWDGGLQDYIHDWWNLMDFVMNSLYLATISLKIVAFVKYSALNPRESWDMWHPTLVAEALFAIANIFSSLRLISLFTANSHLGPLQISLGRMLLDILKFLFIYCLVLLAFANGLNQLYFYYEETKGLTCKGIRCEKQNNAFSTLFETLQSLFWSIFGLINLYVTNVKAQHEFTEFVGATMFGTYNVISLVVLLNMLIAMMNNSYQLIADHADIEWKFARTKLWMSYFEEGGTLPTPFNVIPSPKSLWYLIKWIWTHLCKKKMRRKPESFGTIGRRAADNLRRHHQYQEVMRNLVKRYVAAMIRDAKTEEGLTEENFKELKQDISSFRFEVLGLLRGSKLSTIQSANASKESSNSADSDEKSDSEGNSKDKKKNFSLFDLTTLIHPRSAAIASERHNISNGSALVVQEPPREKQRKVNFVTDIKNFGLFHRRSKQNAAEQNANQIFSVSEEVARQQAAGPLERNIQLESRGLASRGDLSIPGLSEQCVLVDHRERNTDTLGLQVGKRVCPFKSEKVVVEDTVPIIPKEKHAKEEDSSIDYDLNLPDTVTHEDYVTTRL

SEQ ID NO: 5065 - protein, 973 aa, unidentified
MAQLYYKKVNYSPYRDRIPLQIVRAETELSAEEKAFLNAVEKGDYATVKQALQEAEIYYNVNINCMDPLGRSALLIAIENENLEIMELLLNHSVYVGDALLYAIRKEVVGAVELLLSYRRPSGEKQVPTLMMDTQFSEFTPDITPIMLAAHTNNYEIIKLLVQKRVTIPRPHQIRCNCVECVSSSEVDSLRHSRSRLNIYKALASPSLIALSSEDPILTAFRLGWELKELSKVENEFKAEYEELSQQCKLFAKDLLDQARSSRELEIILNHRDDHSEELDPQKYHDLAKLKVAIKYHQKEFVAQPNCQQLLATLWYDGFPGWRRKHWVVKLLTCMTIGFLFPMLSIAYLISPRSNLGLFIKKPFIKFICHTASYLTFLFMLLLASQHIVRTDLHVQGPPPTVVEWMILPWVLGFIWGEIKEMWDGGFTEYIHDWWNLMDFAMNSLYLATISLKIVAYVKYNGSRPREEWEMWHPTLIAEALFAISNILSSLRLISLFTANSHLGPLQISLGRMLLDILKFLFIYCLVLLAFANGLNQLYFYYETRAIDEPNNCKGIRCEKQNNAFSTLFETLQSLFWSVFGLLNLYVTNVKARHEFTEFVGATMFGTYNVISLVVLLNMLIAMMNNSYQLIADHADIEWKFARTKLWMSYFDEGGTLPPPFNIIPSPKSFLYLGNWFNNTFCPKRDPDGRRRRRNLRSFTERNADSLIQNQHYQEVIRNLVKRYVAAMIRNSKTHEGLTEENFKELKQDISSFRYEVLDLLGNRKHPRSFSTSSTELSQRDDNNDGSGGARAKSKSVSFNLGCKKKTCHGPPLIRTMPRSSGAQGKSKAESSSKRSFMGPSLKKLGLLFSKFNGHMSEPSSEPMYTISDGIVQQHCMWQDIRYSQMEKGKAEACSQSEINLSEVELGEVQGAAQSSECPLACSSSLHCASSICSSNSKLLDSSEDVFETWGEACDLLMHKWGDGQEEQVTTRL

SEQ ID NO: 5066 - protein, 931 aa, unidentified
MSQSPAFGPRRGSSPRGAAGAAARRNESQDYLLMDSELGEDGCPQAPLPCYGYYPCFRGSDNRLAHRRQTVLREKGRRLANRGPAYMFSDRSTSLSIEEERFLDAAEYGNIPVVRKMLEECHSLNVNCVDYMGQNALQLAVANEHLEITELLLKKENLSRVGDALLLAISKGYVRIVEAILSHPAFAEGKRLATSPSQSELQQDDFYAYDEDGTRFSHDVTPIILAAHCQEYEIVHTLLRKGARIERPHDYFCKCNDCNQKQKHDSFSHSRSRINAYKGLASPAYLSLSSEDPVMTALELSNELAVLANIEKEFKNDYKKLSMQCKDFVVGLLDLCRNTEEVEAILNGDVETLQSGDHGRPNLSRLKLAIKYEVKKFVAHPNCQQQLLSIWYENLSGLRQQTMAVKFLVVLAVAIGLPFLALIYWFAPCSKMGKIMRGPFMKFVAHAASFTIFLGLLVMNAADRFEGTKLLPNETSTDNAKQLFRMKTSCFSWMEMLIISWVIGMIWAECKEIWTQGPKEYLFELWNMLDFGMLAIFAASFIARFMAFWHASKAQSIIDANDTLKDLTKVTLGDNVKYYNLARIKWDPSDPQIISEGLYAIAVVLSFSRIAYILPANESFGPLQISLGRTVKDIFKFMVIFIMVFVAFMIGMFNLYSYYIGAKQNEAFTTVEESFKTLFWAIFGLSEVKSVVINYNHKFIENIGYVLYGVYNVTMVIVLLNMLIAMINSSFQEIEDDADVEWKFARAKLWFSYFEEGRTLPVPFNLVPSPKSLFYLLLKLKKWISELFQGHKKGFQEDAEMNKINEEKKLGILGSHEDLSKLSLDKKQVGHNKQPSIRSSEDFHLNSFNNPPRQYQKIMKRLIKRYVLQAQIDKESDEVNEGELKEIKQDISSLRYELLEEKSQNTEDLAELIRELGEKLSMEPNQEETNR

SEQ ID NO: 5067 - protein, 862 aa, unidentified
MLRNSTFKNMQRRHTTLREKGRRQAIRGPAYMFNEKGTSLTPEEERFLDSAEYGNIPVVRKMLEESKTLNFNCVDYMGQNALQLAVGNEHLEVTELLLKKENLARVGDALLLAISKGYVRIVEAILNHPAFAQGQRLTLSPLEQELRDDDFYAYDEDGTRFSHDITPIILAAHCQEYEIVHILLLKGARIERPHDYFCKCNECTEKQRKDSFSHSRSRMNAYKGLASAAYLSLSSEDPVLTALELSNELARLANIETEFKNDYRKLSMQCKDFVVGVLDLCRDTEEVEAILNGDVNFQVWSDHHRPSLSRIKLAIKYEVKKFVAHPNCQQQLLTMWYENLSGLRQQSIAVKFLAVFGVSIGLPFLAIAYWIAPCSKLGRTLRSPFMKFVAHAVSFTIFLGLLVVNASDRFEGVKTLPNETFTDYPKQIFRVKTTQFSWTEMLIMKWVLGMIWSECKEIWEEGPREYVLHLWNLLDFGMLSIFVASFTARFMAFLKATEAQLYVDQHVQDDTLHNVSLPPEVAYFTYARDKWWPSDPQIISEGLYAIAVVLSFSRIAYILPANESFGPLQISLGRTVKDIFKFMVIFIMVFVAFMIGMFNLYSYYRGAKYNPAFTTVEESFKTLFWSIFGLSEVISVVLKYDHKFIENIGYVLYGVYNVTMVVVLLNMLIAMINNSYQEIEEDADVEWKFARAKLWLSYFDEGRTLPAPFNLVPSPKSFYYLIMRIKMCLIKLCKSKAKSCENDLEMGMLNSKFKKTRYQAGMRNSENLTANNTLSKPTRYQKIMKRLIKRYVLKAQVDRENDEVNEGELKEIKQDISSLRYELLEEKSQATGELADLIQQLSEKFGKNLNKDHLRVNKGKDI

SEQ ID NO: 5068 - protein, 1603 aa, unidentified
MKDSNRCCCGQFTNQHIPPLPSATPSKNEEESKQVETQPEKWSVAKHTQSYPTDSYGVLEFQGGGYSNKAMYIRVSYDTKPDSLLHLMVKDWQLELPKLLISVHGGLQNFEMQPKLKQVFGKGLIKAAMTTGAWIFTGGVSTGVISHVGDALKDHSSKSRGRVCAIGIAPWGIVENKEDLVGKDVTRVYQTMSNPLSKLSVLNNSHTHFILADNGTLGKYGAEVKLRRLLEKHISLQKINTRLGQGVPLVGLVVEGGPNVVSIVLEYLQEEPPIPVVICDGSGRASDILSFAHKYCEEGGIINESLREQLLVTIQKTFNYNKAQSHQLFAIIMECMKKKELVTVFRMGSEGQQDIEMAILTALLKGTNVSAPDQLSLALAWNRVDIARSQIFVFGPHWPPLGSLAPPTDSKATEKEKKPPMATTKGGRGKGKGKKKGKVKEEVEEETDPRKIELLNWVNALEQAMLDALVLDRVDFVKLLIENGVNMQHFLTIPRLEELYNTRLGPPNTLHLLVRDVKKSNLPPDYHISLIDIGLVLEYLMGGAYRCNYTRKNFRTLYNNLFGPKRPKALKLLGMEDDEPPAKGKKKKKKKKEEEIDIDVDDPAVSRFQYPFHELMVWAVLMKRQKMAVFLWQRGEESMAKALVACKLYKAMAHESSESDLVDDISQDLDNNSKDFGQLALELLDQSYKHDEQIAMKLLTYELKNWSNSTCLKLAVAAKHRDFIAHTCSQMLLTDMWMGRLRMRKNPGLKVIMGILLPPTILFLEFRTYDDFSYQTSKENEDGKEKEEENTDANADAGSRKGDEENEHKKQRSIPIGTKICEFYNAPIVKFWFYTISYLGYLLLFNYVILVRMDGWPSLQEWIVISYIVSLALEKIREILMSEPGKLSQKIKVWLQEYWNITDLVAISTFMIGAILRLQNQPYMGYGRVIYCVDIIFWYIRVLDIFGVNKYLGPYVMMIGKMMIDMLYFVVIMLVVLMSFGVARQAILHPEEKPSWKLARNIFYMPYWMIYGEVFADQIDLYAMEINPPCGENLYDEEGKRLPPCIPGAWLTPALMACYLLVANILLVNLLIAVFNNTFFEVKSISNQVWKFQRYQLIMTFHDRPVLPPPMIILSHIYIIIMRLSGRCRKKREGDQEERDRGLKLFLSDEELKRLHEFEEQCVQEHFREKEDEQQSSSDERIRVTSERVENMSMRLEEINERETFMKTSLQTVDLRLAQLEELSNRMVNALENLAGIDRSDLIQARSRASSECEATYLLRQSSINSADGYSLYRYHFNGEELLFEDTSLSTSPGTGVRKKTCSFRIKEEKDVKTHLVPECQNSLHLSLGTSTSATPDGSHLAVDDLKNAEESKLGPDIGISKEDDERQTDSKKEETISPSLNKTDVIHGQDKSDVQNTQLTVETTNIEGTISYPLEETKITRYFPDETINACKTMKSRSFVYSRGRKLVGGVNQDVEYSSITDQQLTTEWQCQVQKITRSHSTDIPYIVSEAAVQAEHKEQFADMQDEHHVAEAIPRIPRLSLTITDRNGMENLLSVKPDQTLGFPSLRSKSLHGHPRNVKSIQGKLDRSGHASSVSSLVIVSGMTAEEKKVKKEKASTETEC

SEQ ID NO: 5069 - protein, 1503 aa, unidentified
MEPSALRKAGSEQEEGFEGLPRRVTDLGMVSNLRRSNSSLFKSWRLQCPFGNNDKQESLSSWIPENIKKKECVYFVESSKLSDAGKVVCQCGYTHEQHLEEATKPHTFQGTQWDPKKHVQEMPTDAFGDIVFTGLSQKVKKYVRVSQDTPSSVIYHLMTQHWGLDVPNLLISVTGGAKNFNMKPRLKSIFRRGLVKVAQTTGAWIITGGSHTGVMKQVGEAVRDFSLSSSYKEGELITIGVATWGTVHRREGLIHPTGSFPAEYILDEDGQGNLTCLDSNHSHFILVDDGTHGQYGVEIPLRTRLEKFISEQTKERGGVAIKIPIVCVVLEGGPGTLHTIDNATTNGTPCVVVEGSGRVADVIAQVANLPVSDITISLIQQKLSVFFQEMFETFTESRIVEWTKKIQDIVRRRQLLTVFREGKDGQQDVDVAILQALLKASRSQDHFGHENWDHQLKLAVAWNRVDIARSEIFMDEWQWKPSDLHPTMTAALISNKPEFVKLFLENGVQLKEFVTWDTLLYLYENLDPSCLFHSKLQKVLVEDPERPACAPAAPRLQMHHVAQVLRELLGDFTQPLYPRPRHNDRLRLLLPVPHVKLNVQGVSLRSLYKRSSGHVTFTMDPIRDLLIWAIVQNRRELAGIIWAQSQDCIAAALACSKILKELSKEEEDTDSSEEMLALAEEYEHRAIGVFTECYRKDEERAQKLLTRVSEAWGKTTCLQLALEAKDMKFVSHGGIQAFLTKVWWGQLSVDNGLWRVTLCMLAFPLLLTGLISFREKRLQDVGTPAARARAFFTAPVVVFHLNILSYFAFLCLFAYVLMVDFQPVPSWCECAIYLWLFSLVCEEMRQLFYDPDECGLMKKAALYFSDFWNKLDVGAILLFVAGLTCRLIPATLYPGRVILSLDFILFCLRLMHIFTISKTLGPKIIIVKRMMKDVFFFLFLLAVWVVSFGVAKQAILIHNERRVDWLFRGAVYHSYLTIFGQIPGYIDGVNFNPEHCSPNGTDPYKPKCPESDATQQRPAFPEWLTVLLLCLYLLFTNILLLNLLIAMFNYTFQQVQEHTDQIWKFQRHDLIEEYHGRPAAPPPFILLSHLQLFIKRVVLKTPAKRHKQLKNKLEKNEEAALLSWEIYLKENYLQNRQFQQKQRPEQKIEDISNKVDAMVDLLDLDPLKRSGSMEQRLASLEEQVAQTAQALHWIVRTLRASGFSSEADVPTLASQKAAEEPDAEPGGRKKTEEPGDSYHVNARHLLYPNCPVTRFPVPNEKVPWETEFLIYDPPFYTAERKDAAAMDPMGDTLEPLSTIQYNVVDGLRDRRSFHGPYTVQAGLPLNPMGRTGLRGRGSLSCFGPNHTLYPMVTRWRRNEDGAICRKSIKKMLEVLVVKLPLSEHWALPGGSREPGEMLPRKLKRILRQEHWPSFENLLKCGMEVYKGYMDDPRNTDNAWIETVAVSVHFQDQNDVELNRLNSNLHACDSGASIRWQVVDRRIPLYANHKTLLQKAAAEFGAHY

SEQ ID NO: 5070 - protein, 1732 aa, unidentified
MPEPWGTVYFLGIAQVFSFLFSWWNLEGVMNQADAPRPLNWTIRKLCHAAFLPSVRLLKAQKSWIERAFYKRECVHIIPSTKDPHRCCCGRLIGQHVGLTPSISVLQNEKNESRLSRNDIQSEKWSISKHTQLSPTDAFGTIEFQGGGHSNKAMYVRVSFDTKPDLLLHLMTKEWQLELPKLLISVHGGLQNFELQPKLKQVFGKGLIKAAMTTGAWIFTGGVNTGVIRHVGDALKDHASKSRGKICTIGIAPWGIVENQEDLIGRDVVRPYQTMSNPMSKLTVLNSMHSHFILADNGTTGKYGAEVKLRRQLEKHISLQKINTRCLPFFSLDSRLFYSFWGSCQLDSVGIGQGVPVVALIVEGGPNVISIVLEYLRDTPPVPVVVCDGSGRASDILAFGHKYSEEGGLINESLRDQLLVTIQKTFTYTRTQAQHLFIILMECMKKKELITVFRMGSEGHQDIDLAILTALLKGANASAPDQLSLALAWNRVDIARSQIFIYGQQWPVGSLEQAMLDALVLDRVDFVKLLIENGVSMHRFLTISRLEELYNTRHGPSNTLYHLVRDVKKGNLPPDYRISLIDIGLVIEYLMGGAYRCNYTRKRFRTLYHNLFGPKRPKALKLLGMEDDIPLRRGRKTTKKREEEVDIDLDDPEINHFPFPFHELMVWAVLMKRQKMALFFWQHGEEAMAKALVACKLCKAMAHEASENDMVDDISQELNHNSRDFGQLAVELLDQSYKQDEQLAMKLLTYELKNWSNATCLQLAVAAKHRDFIAHTCSQMLLTDMWMGRLRMRKNSGLKVILGILLPPSILSLEFKNKDDMPYMSQAQEIHLQEKEAEEPEKPTKEKEEEDMELTAMLGRNNGESSRKKDEEEVQSKHRLIPLGRKIYEFYNAPIVKFWFYTLAYIGYLMLFNYIVLVKMERWPSTQEWIVISYIFTLGIEKMREILMSEPGKLLQKVKVWLQEYWNVTDLIAILLFSVGMILRLQDQPFRSDGRVIYCVNIIYWYIRLLDIFGVNKYLGPYVMMIGKMMIDMMYFVIIMLVVLMSFGVARQAILFPNEEPSWKLAKNIFYMPYWMIYGEVFADQIDPPCGQNETREDGKIIQLPPCKTGAWIVPAIMACYLLVANILLVNLLIAVFNNTFFEVKSISNQVWKFQRYQLIMTFHERPVLPPPLIIFSHMTMIFQHLCCRWRKHESDPDERDYGLKLFITDDELKKVHDFEEQCIEEYFREKDDRFNSSNDERIRVTSERVENMSMRLEEVNEREHSMKASLQTVDIRLAQLEDLIGRMATALERLTGLERAESNKIRSRTSSDCTDAAYIVRQSSFNSQEGNTFKLQESIDPAGEETMSPTSPTLMPRMRSHSFYSVNMKDKGGIEKLESIFKERSLSLHRATSSHSVAKEPKAPAAPANTLAIVPDSRRPSSCIDIYVSAMDELHCDIDPLDNSVNILGLGEPSFSTPVPSTAPSSSAYATLAPTDRPPSRSIDFEDITSMDTRSFSSDYTHLPECQNPWDSEPPMYHTIERSKSSRYLATTPFLLEEAPIVKSHSFMFSPSRSYYANFGVPVKTAEYTSITDCIDTRCVNAPQAIADRAAFPGGLGDKVEDLTCCHPEREAELSHPSSDSEENEAKGRRATIAISSQEGDNSERTLSNNITVPKIERANSYSAEEPSAPYAHTRKSFSISDKLDRQRNTASLRNPFQRSKSSKPEGRGDSLSMRRLSRTSAFQSFESKHN

SEQ ID NO: 5071 - protein, 1214 aa, unidentified
MVVPEKEQSWIPKIFKKKTCTTFIVDSTDPGGTLCQCGRPRTAHPAVAMEDAFGAAVVTVWDSDAHTTEKPTDAYGELDFTGAGRKHSNFLRLSDRTDPAAVYSLVTRTWGFRAPNLVVSVLGGSGGPVLQTWLQDLLRRGLVRAAQSTGAWIVTGGLHTGIGRHVGVAVRDHQMASTGGTKVVAMGVAPWGVVRNRDTLINPKGSFPARYRWRGDPEDGVQFPLDYNYSAFFLVDDGTHGCLGGENRFRLRLESYISQQKTGVGGTGIDIPVLLLLIDGDEKMLTRIENATQAQLPCLLVAGSGGAADCLAETLEDTLAPGSGGARQGEARDRIRRFFPKGDLEVLQAQVERIMTRKELLTVYSSEDGSEEFETIVLKALVKACGSSEASAYLDELRLAVAWNRVDIAQSELFRGDIQWRSFHLEASLMDALLNDRPEFVRLLISHGLSLGHFLTPMRLAQLYSAAPSNSLIRNLLDQASHSAGTKAPALKGGAAELRPPDVGHVLRMLLGKMCAPRYPSGGAWDPHPGQGFGESMYLLSDKATSPLSLDAGLGQAPWSDLLLWALLLNRAQMAMYFWEMGSNAVSSALGACLLLRVMARLEPDAEEAARRKDLAFKFEGMGVDLFGECYRSSEVRAARLLLRRCPLWGDATCLQLAMQADARAFFAQDGVQSLLTQKWWGDMASTTPIWALVLAFFCPPLIYTRLITFRKSEEEPTREELEFDMDSVINGEGPVGTADPAEKTPLGVPRQSGRPGCCGGRCGGRRCLRRWFHFWGAPVTIFMGNVVSYLLFLLLFSRVLLVDFQPAPPGSLELLLYFWAFTLLCEELRQGLSGGGGSLASGGPGPGHASLSQRLRLYLADSWNQCDLVALTCFLLGVGCRLTPGLYHLGRTVLCIDFMVFTVRLLHIFTVNKQLGPKIVIVSKMMKDVFFFLFFLGVWLVAYGVATEGLLRPRDSDFPSILRRVFYRPYLQIFGQIPQEDMDVALMEHSNCSSEPGFWAHPPGAQAGTCVSQYANWLVVLLLVIFLLVANILLVNLLIAMFSYTFGKVQGNSDLYWKAQRYRLIREFHSRPALAPPFIVISHLRLLLRQLCRRPRSPQPSSPALEHFRVYLSKEAERKLLTWESVHKENFLLARARDKRESDSERLKRTSQKVDLALKQLGHIREYEQRLKVLEREVQQCSRVLGWVAEALSRSALLPPGGPPPPDLPGSKD

SEQ ID NO: 5072 - protein, 1165 aa, unidentified
MQDVQGPRPGSPGDAEDRRELGLHRGEVNFGGSGKKRGKFVRVPSGVAPSVLFDLLLAEWHLPAPNLVVSLVGEEQPFAMKSWLRDVLRKGLVKAAQSTGAWILTSALRVGLARHVGQAVRDHSLASTSTKVRVVAVGMASLGRVLHRRILEEAQEDFPVHYPEDDGGSQGPLCSLDSNLSHFILVEPGPPGKGDGLTELRLRLEKHISEQRAGYGGTGSIEIPVLCLLVNGDPNTLERISRAVEQAAPWLILVGSGGIADVLAALVNQPHLLVPKVAEKQFKEKFPSKHFSWEDIVRWTKLLQNITSHQHLLTVYDFEQEGSEELDTVILKALVKACKSHSQEPQDYLDELKLAVAWDRVDIAKSEIFNGDVEWKSCDLEEVMVDALVSNKPEFVRLFVDNGADVADFLTYGRLQELYRSVSRKSLLFDLLQRKQEEARLTLAGLGTQQAREPPAGPPAFSLHEVSRVLKDFLQDACRGFYQDGRPGDRRRAEKGPAKRPTGQKWLLDLNQKSENPWRDLFLWAVLQNRHEMATYFWAMGQEGVAAALAACKILKEMSHLETEAEAARATREAKYERLALDLFSECYSNSEARAFALLVRRNRCWSKTTCLHLATEADAKAFFAHDGVQAFLTRIWWGDMAAGTPILRLLGAFLCPALVYTNLITFSEEAPLRTGLEDLQDLDSLDTEKSPLYGLQSRVEELVEAPRAQGDRGPRAVFLLTRWRKFWGAPVTVFLGNVVMYFAFLFLFTYVLLVDFRPPPQGPSGPEVTLYFWVFTLVLEEIRQGFFTDEDTHLVKKFTLYVGDNWNKCDMVAIFLFIVGVTCRMLPSAFEAGRTVLAMDFMVFTLRLIHIFAIHKQLGPKIIVVERMMKDVFFFLFFLSVWLVAYGVTTQALLHPHDGRLEWIFRRVLYRPYLQIFGQIPLDEIDEARVNCSTHPLLLEDSPSCPSLYANWLVILLLVTFLLVTNVLLMNLLIAMFSYTFQVVQGNADMFWKFQRYNLIVEYHERPALAPPFILLSHLSLTLRRVFKKEAEHKREHLERDLPDPLDQKVVTWETVQKENFLSKMEKRRRDSEGEVLRKTAHRVDFIAKYLGGLREQEKRIKCLESQINYCSVLVSSVADVLAQGGGPRSSQHCGEGSQLVAADHRGGLDGWEQPGAGQPPSDT

SEQ ID NO: 5073 - protein, 2022 aa, unidentified
MKEQPVLERLQSQKSWIKGVFDKRECSTIIPSSKNPHRCTPVCQVCQNLIRCYCGRLIGDHAGIDYSWTISAAKGKESEQWSVEKHTTKSPTDTFGTINFQDGEHTHHAKYIRTSYDTKLDHLLHLMLKEWKMELPKLVISVHGGIQNFTMPSKFKEIFSQGLVKAAETTGAWIITEGINTGVSKHVGDALKSHSSHSLRKIWTVGIPPWGVIENQRDLIGKDVVCLYQTLDNPLSKLTTLNSMHSHFILSDDGTVGKYGNEMKLRRNLEKYLSLQKIHCRSRQGVPVVGLVVEGGPNVILSVWETVKDKDPVVVCEGTGRAADLLAFTHKHLADEGMLRPQVKEEIICMIQNTFNFSLKQSKHLFQILMECMVHRDCITIFDADSEEQQDLDLAILTALLKGTNLSASEQLNLAMAWDRVDIAKKHILIYEQHWKPDALEQAMSDALVMDRVDFVKLLIEYGVNLHRFLTIPRLEELYNTKQGPTNTLLHHLVQDVKQHTLLSGYRITLIDIGLVVEYLIGRAYRSNYTRKHFRALYNNLYRKYKHQRHSSGNRNESAESTLHSQFIRTAQPYKFKEKSIVLHKSRKKSKEQNVSDDPESTGFLYPYNDLLVWAVLMKRQKMAMFFWQHGEEATVKAVIACILYRAMAHEAKESHMVDDASEELKNYSKQFGQLALDLLEKAFKQNERMAMTLLTYELRNWSNSTCLKLAVSGGLRPFVSHTCTQMLLTDMWMGRLKMRKNSWLKIIISIILPPTILTLEFKSKAEMSHVPQSQDFQFMWYYSDQNASSSKESASVKEYDLERGHDEKLDENQHFGLESGHQHLPWTRKVYEFYSAPIVKFWFYTMAYLAFLMLFTYTVLVEMQPQPSVQEWLVSIYIFTNAIEVVREICISEPGKFTQKVKVWISEYWNLTETVAIGLFSAGFVLRWGDPPFHTAGRLIYCIDIIFWFSRLLDFFAVNQHAGPYVTMIAKMTANMFYIVIIMAIVLLSFGVARKAILSPKEPPSWSLARDIVFEPYWMIYGEVYAGEIDVCSSQPSCPPGSFLTPFLQAVYLFVQYIIMVNLLIAFFNNVYLDMESISNNLWKYNRYRYIMTYHEKPWLPPPLILLSHVGLLLRRLCCHRAPHDQEEGDVGLKLYLSKEDLKKLHDFEEQCVEKYFHEKMEDVNCSCEERIRVTSERVTEMYFQLKEMNEKVSFIKDSLLSLDSQVGHLQDLSALTVDTLKVLSAVDTLQEDEALLAKRKHSTCKKLPHSWSNVICAEVLGSMEIAGEKKYQYYSMPSSLLRSLAGGRHPPRVQRGALLEITNSKREATNVRNDQERQETQSSIVVSGVSPNRQAHSKYGQFLLVPSNLKRVPFSAETVLPLSRPSVPDVLATEQDIQTEVLVHLTGQTPVVSDWASVDEPKEKHEPIAHLLDGQDKAEQVLPTLSCTPEPMTMSSPLSQAKIMQTGGGYVNWAFSEGDETGVFSIKKKWQTCLPSTCDSDSSRSEQHQKQAQDSSLSDNSTRSAQSSECSEVGPWLQPNTSFWINPLRRYRPFARSHSFRFHKEEKLMKICKIKNLSGSSEIGQGAWVKAKMLTKDRRLSKKKKNTQGLQVPIITVNACSQSDQLNPEPGENSISEEEYSKNWFTVSKFSHTGVEPYIHQKMKTKEIGQCAIQISDYLKQSQEDLSKNSLWNSRSTNLNRNSLLKSSIGVDKISASLKSPQEPHHHYSAIERNNLMRLSQTIPFTPVQLFAGEEITVYRLEESSPLNLDKSMSSWSQRGRAAMIQVLSREEMDGGLRKAMRVVSTWSEDDILKPGQVFIVKSFLPEVVRTWHKIFQESTVLHLCLREIQQQRAAQKLIYTFNQVKPQTIPYTPRFLEVFLIYCHSANQWLTIEKYMTGEFRKYNNNNGDEITPTNTLEELMLAFSHWTYEYTRGELLVLDLQGVGENLTDPSVIKPEVKQSRGMVFGPANLGEDAIRNFIAKHHCNSCCRKLKLPDLKRNDYSPERINSTFGLEIKIESAEEPPARETGRNSPEDDMQL

SEQ ID NO: 5074 - protein, 1865 aa, unidentified
MSQKSWIESTLTKRECVYIIPSSKDPHRCLPGCQICQQLVRCFCGRLVKQHACFTASLAMKYSDVKLGDHFNQAIEEWSVEKHTEQSPTDAYGVINFQGGSHSYRAKYVRLSYDTKPEVILQLLLKEWQMELPKLVISVHGGMQKFELHPRIKQLLGKGLIKAAVTTGAWILTGGVNTGVAKHVGDALKEHASRSSRKICTIGIAPWGVIENRNDLVGRDVVAPYQTLLNPLSKLNVLNNLHSHFILVDDGTVGKYGAEVRLRRELEKTINQQRIHARIGQGVPVVALIFEGGPNVILTVLEYLQESPPVPVVVCEGTGRAADLLAYIHKQTEEGGNLPDAAEPDIISTIKKTFNFGQNEALHLFQTLMECMKRKELITVFHIGSDEHQDIDVAILTALLKGTNASAFDQLILTLAWDRVDIAKNHVFVYGQQWLVGSLEQAMLDALVMDRVAFVKLLIENGVSMHKFLTIPRLEELYNTKQGPTNPMLFHLVRDVKQGNLPPGYKITLIDIGLVIEYLMGGTYRCTYTRKRFRLIYNSLGGNNRRSGRNTSSSTPQLRKSHESFGNRADKKEKMRHNHFIKTAQPYRPKIDTVMEEGKKKRTKDEIVDIDDPETKRFPYPLNELLIWACLMKRQVMARFLWQHGEESMAKALVACKIYRSMAYEAKQSDLVDDTSEELKQYSNDFGQLAVELLEQSFRQDETMAMKLLTYELKNWSNSTCLKLAVSSRLRPFVAHTCTQMLLSDMWMGRLNMRKNSWYKVILSILVPPAILLLEYKTKAEMSHIPQSQDAHQMTMDDSENNFQNITEEIPMEVFKEVRILDSNEGKNEMEIQMKSKKLPITRKFYAFYHAPIVKFWFNTLAYLGFLMLYTFVVLVQMEQLPSVQEWIVIAYIFTYAIEKVREIFMSEAGKVNQKIKVWFSDYFNISDTIAIISFFIGFGLRFGAKWNFANAYDNHVFVAGRLIYCLNIIFWYVRLLDFLAVNQQAGPYVMMIGKMVANMFYIVVIMALVLLSFGVPRKAILYPHEAPSWTLAKDIVFHPYWMIFGEVYAYEIDVCANDSVIPQICGPGTWLTPFLQAVYLFVQYIIMVNLLIAFFNNVYLQVKAISNIVWKYQRYHFIMAYHEKPVLPPPLIILSHIVSLFCCICKRRKKDKTSDGPKLFLTEEDQKKLHDFEEQCVEMYFNEKDDKFHSGSEERIRVTFERVEQMCIQIKEVGDRVNYIKRSLQSLDSQIGHLQDLSALTVDTLKTLTAQKASEASKVHNEITRELSISKHLAQNLIDDGPVRPSVWKKHGVVNTLSSSLPQGDLESNNPFHCNILMKDDKDPQCNIFGQDLPAVPQRKEFNFPEAGSSSGALFPSAVSPPELRQRLHGVELLKIFNKNQKLGSSSTSIPHLSSPPTKFFVSTPSQPSCKSHLETGTKDQETVCSKATEGDNTEFGAFVGHRDSMDLQRFKETSNKIKILSNNNTSENTLKRVSSLAGFTDCHRTSIPVHSKQAEKISRRPSTEDTHEVDSKAALIPDWLQDRPSNREMPSEEGTLNGLTSPFKPAMDTNYYYSAVERNNLMRLSQSIPFTPVPPRGEPVTVYRLEESSPNILNNSMSSWSQLGLCAKIEFLSKEEMGGGLRRAVKVQCTWSEHDILKSGHLYIIKSFLPEVVNTWSSIYKEDTVLHLCLREIQQQRAAQKLTFAFNQMKPKSIPYSPRFLEVFLLYCHSAGQWFAVEECMTGEFRKYNNNNGDEIIPTNTLEEIMLAFSHWTYEYTRGELLVLDLQGVGENLTDPSVIKAEEKRSCDMVFGPANLGEDAIKNFRAKHHCNSCCRKLKLPDLKRNDYTPDKIIFPQDEPSDLNLQPGNSTKESESTNSVRLML

SEQ ID NO: 5075 - protein, 1104 aa, unidentified
MSFRAARLSMRNRRNDTLDSTRTLYSSASRSTDLSYSESDLVNFIQANFKKRECVFFTKDSKATENVCKCGYAQSQHMEGTQINQSEKWNYKKHTKEFPTDAFGDIQFETLGKKGKYIRLSCDTDAEILYELLTQHWHLKTPNLVISVTGGAKNFALKPRMRKIFSRLIYIAQSKGAWILTGGTHYGLMKYIGEVVRDNTISRSSEENIVAIGIAAWGMVSNRDTLIRNCDAEGYFLAQYLMDDFTRDPLYILDNNHTHLLLVDNGCHGHPTVEAKLRNQLEKYISERTIQDSNYGGKIPIVCFAQGGGKETLKAINTSIKNKIPCVVVEGSGQIADVIASLVEVEDALTSSAVKEKLVRFLPRTVSRLPEEETESWIKWLKEILECSHLLTVIKMEEAGDEIVSNAISYALYKAFSTSEQDKDNWNGQLKLLLEWNQLDLANDEIFTNDRRWESADLQEVMFTALIKDRPKFVRLFLENGLNLRKFLTHDVLTELFSNHFSTLVYRNLQIAKNSYNDALLTFVWKLVANFRRGFRKEDRNGRDEMDIELHDVSPITRHPLQALFIWAILQNKKELSKVIWEQTRGCTLAALGASKLLKTLAKVKNDINAAGESEELANEYETRAVELFTECYSSDEDLAEQLLVYSCEAWGGSNCLELAVEATDQHFIAQPGVQNFLSKQWYGEISRDTKNWKIILCLFIIPLVGCGFVSFRKKPVDKHKKLLWYYVAFFTSPFVVFSWNVVFYIAFLLLFAYVLLMDFHSVPHPPELVLYSLVFVLFCDEVRQWYVNGVNYFTDLWNVMDTLGLFYFIAGIVFRLHSSNKSSLYSGRVIFCLDYIIFTLRLIHIFTVSRNLGPKIIMLQRMLIDVFFFLFLFAVWMVAFGVARQGILRQNEQRWRWIFRSVIYEPYLAMFGQVPSDVDGTTYDFAHCTFTGNESKPLCVELDEHNLPRFPEWITIPLVCIYMLSTNILLVNLLVAMFGYTVGTVQENNDQVWKFQRYFLVQEYCSRLNIPFPFIVFAYFYMVVKKCFKCCCKEKNMESSVCCFKNEDNETLAWEGVMKENYLVKINTKANDTSEEMRHRFRQLDTKLNDLKGLLKEIANKIK

SEQ ID NO: 5076 - protein, 839 aa, unidentified [sequence omitted]

SEQ ID NO: 5077 - protein, 764 aa, unidentified
MTSPSSSPVFRLETLDGGQEDGSEADRGKLDFGSGLPPMESQFQGEDRKFAPQIRVNLNYRKGTGASQPDPNRFDRDRLFNAVSRGVPEDLAGLPEYLSKTSKYLTDSEYTEGSTGKTCLMKAVLNLKDGVNACILPLLQIDRDSGNPQPLVNAQCTDDYYRGHSALHIAIEKRSLQCVKLLVENGANVHARACGRFFQKGQGTCFYFGELPLSLAACTKQWDVVSYLLENPHQPASLQATDSQGNTVLHALVMISDNSAENIALVTSMYDGLLQAGARLCPTVQLEDIRNLQDLTPLKLAAKEGKIEIFRHILQREFSGLSHLSRKFTEWCYGPVRVSLYDLASVDSCEENSVLEIIAFHCKSPHRHRMVVLEPLNKLLQAKWDLLIPKFFLNFLCNLIYMFIFTAVAYHQPTLKKQAAPHLKAEVGNSMLLTGHILILLGGIYLLVGQLWYFWRRHVFIWISFIDSYFEILFLFQALLTVVSQVLCFLAIEWYLPLLVSALVLGWLNLLYYTRGFQHTGIYSVMIQKVILRDLLRFLLIYLVFLFGFAVALVSLSQEAWRPEAPTGPNATESVQPMEGQEDEGNGAQYRGILEASLELFKFTIGMGELAFQEQLHFRGMVLLLLLAYVLLTYILLLNMLIALMSETVNSVATDSWSIWKLQKAISVLEMENGYWWCRKKQRAGVMLTVGTKPDGSPDERWCFRVEEVNWASWEQTLPTLCEDPSGAGVPRTLENPVLASPPKEDEDGASEENYVPVQLLQSN

SEQ ID NO: 5078 - protein, 790 aa, unidentified
MKAHPKEMVPLMGKRVAAPSGNPAILPEKRPAEITPTKKSAHFFLEIEGFEPNPTVAKTSPPVFSKPMDSNIRQCISGNCDDMDSPQSPQDDVTETPSNPNSPSAQLAKEEQRRKKRRLKKRIFAAVSEGCVEELVELLVELQELCRRRHDEDVPDFLMHKLTASDTGKTCLMKALLNINPNTKEIVRILLAFAEENDILGRFINAEYTEEAYEGQTALNIAIERRQGDIAALLIAAGADVNAHAKGAFFNPKYQHEGFYFGETPLALAACTNQPEIVQLLMEHEQTDITSRDSRGNNILHALVTVAEDFKTQNDFVKRMYDMILLRSGNWELETTRNNDGLTPLQLAAKMGKAEILKYILSREIKEKRLRSLSRKFTDWAYGPVSSSLYDLTNVDTTTDNSVLEITVYNTNIDNRHEMLTLEPLHTLLHMKWKKFAKHMFFLSFCFYFFYNITLTLVSYYRPREEEAIPHPLALTHKMGWLQLLGRMFVLIWAMCISVKEGIAIFLLRPSDLQSILSDAWFHFVFFIQAVLVILSVFLYLFAYKEYLACLVLAMALGWANMLYYTRGFQSMGMYSVMIQKVILHDVLKFLFVYIVFLLGFGVALASLIEKCPKDNKDCSSYGSFSDAVLELFKLTIGLGDLNIQQNSKYPILFLFLLITYVILTFVLLLNMLIALMGETVENVSKESERIWRLQRARTILEFEKMLPEWLRSRFRMGELCKVAEDDFRLCLRINEVKWTEWKTHVSFLNEDPGPVRRTDFNKIQDSSRNNSKTTLNAFEEVEEFPETSV

SEQ ID NO: 5079 - protein, 871 aa, unidentified
MADSSEGPRAGPGEVAELPGDESGTPGGEAFPLSSLANLFEGEDGSLSPSPADASRPAGPGDGRPNLRMKFQGAFRKGVPNPIDLLESTLYESSVVPGPKKAPMDSLFDYGTYRHHSSDNKRWRKKIIEKQPQSPKAPAPQPPPILKVFNRPILFDIVSRGSTADLDGLLPFLLTHKKRLTDEEFREPSTGKTCLPKALLNLSNGRNDTIPVLLDIAERTGNMREFINSPFRDIYYRGQTALHIAIERRCKHYVELLVAQGADVHAQARGRFFQPKDEGGYFYFGELPLSLAACTNQPHIVNYLTENPHKKADMRRQDSRGNTVLHALVAIADNTRENTKFVTKMYDLLLLKCARLFPDSNLEAVLNNDGLSPLMMAAKTGKIGIFQHIIRREVTDEDTRHLSRKFKDWAYGPVYSSLYDLSSLDTCGEEASVLEILVYNSKIENRHEMLAVEPINELLRDKWRKFGAVSFYINVVSYLCAMVIFTLTAYYQPLEGTPPYPYRTTVDYLRLAGEVITLFTGVLFFFTNIKDLFMKKCPGVNSLFIDGSFQLLYFIYSVLVIVSAALYLAGIEAYLAVMVFALVLGWMNALYFTRGLKLTGTYSIMIQKILFKDLFRFLLVYLLFMIGYASALVSLLNPCANMKVCNEDQTNCTVPTYPSCRDSETFSTFLLDLFKLTIGMGDLEMLSSTKYPVVFIILLVTYIILTFVLLLNMLIALMGETVGQVSKESKHIWKLQWATTILDIERSFPVFLRKAFRSGEMVTVGKSSDGTPDRRWCFRVDEVNWSHWNQNLGIINEDPGKNETYQYYGFSHTVGRLRRDRWSSVVPRVVELNKNSNPDEVVVPLDSMGNPRCDGHQQGYPRKWRTDDAPL

SEQ ID NO: 5080 - protein, 729 aa, unidentified
MGGFLPKAEGPGSQLQKLLPSFLVREQDWDQHLDKLHMLQQKRILESPLLRASKENDLSVLRQLLLDCTCDVRQRGALGETALHIAALYDNLEAALVLMEAAPELVFEPTTCEAFAGQTALHIAVVNQNVNLVRALLTRRASVSARATGTAFRRSPRNLIYFGEHPLSFAACVNSEEIVRLLIEHGADIRAQDSLGNTVLHILILQPNKTFACQMYNLLLSYDGHGDHLQPLDLVPNHQGLTPFKLAGVEGNTVMFQHLMQKRRHIQWTYGPLTSILYDLTEIDSWGEELSFLELVVSSDKREARQILEQTPVKELVSFKWNKYGRPYFCILAALYLLYMICFTTCCVYRPLKFRGGNRTHSRDITILQQKLLQEAYETREDIIRLVGELVSIVGAVIILLLEIPDIFRVGASRYFGKTILGGPFHVIIITYASLVLVTMVMRLTNTNGEVVPMSFALVLGWCSVMYFTRGFQMLGPFTIMIQKMIFGDLMRFCWLMAVVILGFASAFYIIFQTEDPTSLGQFYDYPMALFTTFELFLTVIDAPANYDVDLPFMFSIVNFAFAIIATLLMLNLFIAMMGDTHWRVAQERDELWRAQVVATTVMLERKLPRCLWPRSGICGCEFGLGDRWFLRVENHNDQNPLRVLRYVEVFKNSDKEDDQEHPSEKQPSGAESGTLARASLALPTSSLSRTASQSSSHRGWEILRQNTLGHLNLGLNLSEGDGEEVYHF

SEQ ID NO: 5081 - protein, 765 aa, unidentified
MGPLQGDGGPALGGADVAPRLSPVRVWPRPQAPKEPALHPMGLSLPKEKGLILCLWSKFCRWFQRRESWAQSRDEQNLLQQKRIWESPLLLAAKDNDVQALNKLLKYEDCKVHQRGAMGETALHIAALYDNLEAAMVLMEAAPELVFEPMTSELYEGQTALHIAVVNQNMNLVRALLARRASVSARATGTAFRRSPCNLIYFGEHPLSFAACVNSEEIVRLLIEHGADIRAQDSLGNTVLHILILQPNKTFACQMYNLLLSYDRHGDHLQPLDLVPNHQGLTPFKLAGVEGNTVMFQHLMQKRKHTQWTYGPLTSTLYDLTEIDSSGDEQSLLELIITTKKREARQILDQTPVKELVSLKWKRYGRPYFCMLGAIYLLYIICFTMCCIYRPLKPRTNNRTSPRDNTLLQQKLLQEAYMTPKDDIRLVGELVTVIGAIIILLVEVPDIFRMGVTRFFGQTILGGPFHVLIITYAFMVLVTMVMRLISASGEVVPMSFALVLGWCNVMYFARGFQMLGPFTIMIQKMIFGDLMRFCWLMAVVILGFASAFYIIFQTEDPEELGHFYDYPMALFSTFELFLTIIDGPANYNVDLPFMYSITYAAFAIIATLLMLNLLIAMMGDTHWRVAHERDELWRAQIVATTVMLERKLPRCLWPRSGICGREYGLGDRWFLRVEDRQDLNRQRIQRYAQAFHTRGSEDLDKDSVEKLELGCPFSPHLSLPMPSVSRSTSRSSANWERLRQGTLRRDLRGIINRGLEDGESWEYQI

SEQ ID NO: 5082 - protein, 3859 aa, unidentified
MAFVATQGATVVDQTTLMKKYLQFVAALTDVNTPDETKLKMMQEVSENFENVTSSPQYSTFLEHIIPRFLTFLQDGEVQFLQEKPAQQLRKLVLEIIHRIPTNEHLRPHTKNVLSVMFRFLETENEENVLICLRIIIELHKQFRPPITQEIHHFLDFVKQIYKELPKVVNRYFENPQVIPENTVPPPEMVGMITTIAVKVNPEREDSETRTHSIIPRGSLSLKVLAELPIIVVLMYQLYKLNIHNVVAEFVPLIMNTIAIQVSAQARQHKLYNKELYADFIAAQIKTLSFLAYIIRIYQELVTKYSQQMVKGMLQLLSNCPAETAHLRKELLIAAKHILTTELRNQFIPCMDKLFDESILIGSGYTARETLRPLAYSTLADLVHHVRQHLPLSDLSLAVQLFAKNIDDESLPSSIQTMSCKLLLNLVDCIRSKSEQESGNGRDVLMRMLEVFVLKFHTIARYQLSAIFKKCKPQSELGAVEAALPGVPTAPAAPGPAPSPAPVPAPPPPPPPPPPATPVTPAPVPPFEKQGEKDKEDKQTFQVTDCRSLVKTLVCGVKTITWGITSCKAPGEAQFIPNKQLQPKETQIYIKLVKYAMQALDIYQVQIAGNGQTYIRVANCQTVRMKEEKEVLEHFAGVFTMMNPLTFKEIFQTTVPYMVERISKNYALQIVANSFLANPTTSALFATILVEYLLDRLPEMGSNVELSNLYLKLFKLVFGSVSLFAAENEQMLKPHLHKIVNSSMELAQTAKEPYNYFLLLRALFRSIGGGSHDLLYQEFLPLLPNLLQGLNMLQSGLHKQHMKDLFVELCLTVPVRLSSLLPYLPMLMDPLVSALNGSQTLVSQGLRTLELCVDNLQPDFLYDHIQPVRAELMQALWRTLRNPADSISHVAYRVLGKFGGSNRKMLKESQKLHYVVTEVQGPSITVEFSDCKASLQLPMEKAIETALDCLKSANTEPYYRRQAWEVIKCFLVAMMSLEDNKHALYQLLAHPNFTEKTIPNVIISHRYKAQDTPARKTFEQALTGAFMSAVIKDLRPSALPFVASLIRHYTMVAVAQQCGPFLLPCYQVGSQPSTAMFHSEENGSKGMDPLVLIDAIAICMAYEEKELCKIGEVALAVIFDVASIILGSKERACQLPLFSYIVERLCACCYEQAWYAKLGGVVSIKFLMERLPLTWVLQNQQTFLKALLFVMMDLTGEVSNGAVAMAKTTLEQLLMRCATPLKDEERAEEIVAAQEKSFHHVTHDLVREVTSPNSTVRKQAMHSLQVLAQVTGKSVTVIMEPHKEVLQDMVPPKKHLLRHQPANAQIGLMEGNTFCTTLQPRLFTMDLNVVEHKVFYTELLNLCEAEDSALTKLPCYKSLPSLVPLRIAALNALAACNYLPQSREKIIAALFKALNSTNSELQEAGEACMRKFLEGATIEVDQIHTHMRPLLMMLGDYRSLTLNVVNRLTSVTRLFPNSFNDKFCDQMMQHLRKWMEVVVITHKGGQRSDGNESISECGRCPLSPFCQFEEMKICSAIINLFHLIPAAPQTLVKPLLEVVMKTERAMLIEAGSPFREPLIKFLTRHPSQTVELFMMEATLNDPQWSRMFMSFLKHKDARPLRDVLAANPNRFITLLLPGGAQTAVRPGSPSTSTMRLDLQFQAIKIISIIVKNDDSWLASQHSLVSQLRRVWVSENFQERHRKENMAATNWKEPKLLAYCLLNYCKRNYGDIELLFQLLRAFTGRFLCNMTFLKEYMEEEIPKNYSIAQKRALFFRFVDFNDPNFGDELKAKVLQHILNPAFLYSFEKGEGEQLLGPPNPEGDNPESITSVFITKVLDPEKQADMLDSLRIYLLQYATLLVEHAPHHIHDNNKNRNSKLRRLMTFAWPCLLSKACVDPACKYSGHLLLAHIIAKFAIHKKIVLQVFHSLLKAHAMEARAIVRQAMAILTPAVPARMEDGHQMLTHWTRKIIVEEGHTVPQLVHILHLIVQHFKVYYPVRHHLVQHMVSAMQRLGFTPSVTIEQRRLAVDLSEVVIKWELQRIKDQQPDSDMDPNSSGEGVNSVSSSIKRGLSVDSAQEVKRFRTATGAISAVFGRSQSLPGADSLLAKPIDKQHTDTVVNFLIRVACQVNDNTNTAGSPGEVLSRRCVNLLKTALRPDMWPKSELKLQWFDKLLMTVEQPNQVNYGNICTGLEVLSFLLTVLQSPAILSSFKPLQRGIAACMTCGNTKVLRAVHSLLSRLMSIFPTEPSTSSVASKYEELECLYAAVGKVIYEGLTNYEKATNANPSQLFGTLMILKSACSNNPSYIDRLISVFMRSLQKMVREHLNPQAASGSTEATSGTSELVMLSLELVKTRLAVMSMEMRKNFIQAILTSLIEKSPDAKILRAVVKIVEEWVKNNSPMAANQTPTLREKSILLVKMMTYIEKRFPEDLELNAQFLDLVNYVYRDETLSGSELTAKLEPAFLSGLRCAQPLIRAKFFEVFDNSMKRRVYERLLYVTCSQNWEAMGNHFWIKQCIELLLAVCEKSTPIGTSCQGAMLPSITNVINLADSHDRAAFAMVTHVKQEPRERENSESKEEDVEIDIELAPGDQTSTPKTKELSEKDIGNQLHMLTNRHDKFLDTLREVKTGALLSAFVQLCHISTTLAEKTWVQLFPRLWKILSDRQQHALAGEISPFLCSGSHQVQRDCQPSALNCFVEAMSQCVPPIPIRPCVLKYLGKTHNLWFRSTLMLEHQAFEKGLSLQIKPKQTTEFYEQESITPPQQEILDSLAELYSLLQEEDMWAGLWQKRCKYSETATAIAYEQHGFFEQAQESYEKAMDKAKKEHERSNASPAIFPEYQLWEDHWIRCSKELNQWEALTEYGQSKGHINPYLVLECAWRVSNWTAMKEALVQVEVSCPKEMAWKVNMYRGYLAICHPEEQQLSFIERLVEMASSLAIREWRRLPHVVSHVHTPLLQAAQQIIELQEAAQINAGLQPTNLGRNNSLHDMKTVVKTWRNRLPIVSDDLSHWSSIFMWRQHHYQGKPTWSGMHSSSIVTAYENSSQHDPSSNNAMLGVHASASAIIQYGKIARKQGLVNVALDILSRIHTIPTVPIVDCFQKIRQQVKCYLQLAGVMGKNECMQGLEVIESTNLKYFTKEMTAEFYALKGMFLAQINKSEEANKAFSAAVQMHDVLVKAWAMWGDYLENIFVKERQLHLGVSAITCYLHACRHQNESKSRKYLAKVLWLLSFDDDKNTLADAVDKYCIGVPPIQWLAWIPQLLTCLVGSEGKLLLNLISQVGRVYPQAVYFPIRTLYLTLKIEQRERYKSDPGPIRATAPMWRCSRIMHMQRELHPTLLSSLEGIVDQMVWFRENWHEEVLRQLQQGLAKCYSVAFEKSGAVSDAKITPHTLNFVKKLVSTFGVGLENVSNVSTMFSSAASESLARRAQATAQDPVFQKLKGQFTTDFDFSVPGSMKLHNLISKLKKWIKILEAKTKQLPKFFLIEEKCRFLSNFSAQTAEVEIPGEFLMPKPTHYYIKIARFMPRVEIVQKHNTAARRLYIRGHNGKIYPYLVMNDACLTESRREERVLQLLRLLNPCLEKRKETTKRHLFFTVPRVVAVSPQMRLVEDNPSSLSLVEIYKQRCAKKGIEHDNPISRYYDRLATVQARGTQASHQVLRDILKEVQSNMVPRSMLKEWALHTFPNATDYWTFRKMFTIQLALIGFAEFVLHLNRLNPEMLQIAQDTGKLNVAYFRFDINDATGDLDANRPVPFRLTPNISEFLTTIGVSGPLTASMIAVARCFAQPNFKVDGILKTVLRDEIIAWHKKTQEDTSSPLSAAGQPENMDSQQLVSLVQKAVTAIMTRLHNLAQFEGGESKVNTLVAAANSLDNLCRMDPAWHPWL

SEQ ID NO: 5083 - protein, 1164 aa, unidentified
MAQQANVGELLAMLDSPMLGVRDDVTAVFKENLNSDRGPMLVNTLVDYYLETSSQPALHILTTLQEPHDKHLLDRINEYVGKAATRLSILSLLGHVIRLQPSWKHKLSQAPLLPSLLKCLKMDTDVVVLTTGVLVLITMLPMIPQSGKQHLLDFFDIFGRLSSWCLKKPGHVAEVYLVHLHASVYALFHRLYGMYPCNFVSFLRSHYSMKENLETFEEVVKPMMEHVRIHPELVTGSKDHELDPRRWKRLETHDVVIECAKISLDPTEASYEDGYSVSHQISARFPHRSADVTTSPYADTQNSYGCATSTPYSTSRLMLLNMPGQLPQTLSSPSTRLITEPPQATLWSPSMVCGMTTPPTSPGNVPPDLSHPYSKVFGTTAGGKGTPLGTPATSPPPAPLCHSDDYVHISLPQATVTPPRKEERMDSARPCLHRQHHLLNDRGSEEPPGSKGSVTLSDLPGFLGDLASEEDSIEKDKEEAAISRELSEITTAEAEPVVPRGGFDSPFYRDSLPGSQRKTHSAASSSQGASVNPEPLHSSLDKLGPDTPKQAFTPIDLPCGSADESPAGDRECQTSLETSIFTPSPCKIPPPTRVGFGSGQPPPYDHLFEVALPKTAHHFVIRKTEELLKKAKGNTEEDGVPSTSPMEVLDRLIQQGADAHSKELNKLPLPSKSVDWTHFGGSPPSDEIRTLRDQLLLLHNQLLYERFKRQQHALRNRRLLRKVIKAAALEEHNAAMKDQLKLQEKDIQMWKVSLQKEQARYNQLQEQRDTMVTKLHSQIRQLQHDREEFYNQSQELQTKLEDCRNMIAELRIELKKANNKVCHTELLLSQVSQKLSNSESVQQQMEFLNRQLLVLGEVNELYLEQLQNKHSDTTKEVEMMKAAYRKELEKNRSHVLQQTQRLDTSQKRILELESHLAKKDHLLLEQKKYLEDVKLQARGQLQAAESRYEAQKRITQVFELEILDLYGRLEKDGLLKKLEEEKAEAAEAAEERLDCCNDGCSDSMVGHNEEASGHNGETKTPRPSSARGSSGSRGGGGSSSSSSELSTPEKPPHQRAGPFSSRWETTMGEASASIPTTVGSLPSSKSFLGMKARELFRNKSESQCDEDGMTSSLSESLKTELGKDLGVEAKIPLNLDGPHPSPPTPDSVGQLHIMDYNETHHEHS

SEQ ID NO: 5084 - protein, 1807 aa, unidentified
MAKPTSKDSGLKEKFKILLGLGTPRPNPRSAEGKQTEFIITAEILRELSMECGLNNRIRMIGQICEVAKTKKFEEHAVEALWKAVADLLQPERPLEARHAVLALLKAIVQGQGERLGVLRALFFKVIKDYPSNEDLHERLEVFKALTDNGRHITYLEEELADFVLQWMDVGLSSEFLLVLVNLVKFNSCYLDEYIARMVQMICLLCVRTASSVDIEVSLQVLDAVVCYNCLPAESLPLFIVTLCRTINVKELCEPCWKLMRNLLGTHLGHSAIYNMCHLMEDRAYMEDAPLLRGAVFFVGMALWGAHRLYSLRNSPTSVLPSFYQAMACPNEVVSYEIVLSITRLIKKYRKELQVVAWDILLNIIERLLQQLQTLDSPELRTIVHDLLTTVEELCDQNEFHGSQERYFELVERCADQRPESSLLNLISYRAQSIHPAKDGWIQNLQALMERFFRSESRGAVRIKVLDVLSFVLLINRQFYEEELINSVVISQLSHIPEDKDHQVRKLATQLLVDLAEGCHTHHFNSLLDIIEKVMARSLSPPPELEERDVAAYSASLEDVKTAVLGLLVILQTKLYTLPASHATRVYEMLVSHIQLHYKHSYTLPIASSIRLQAFDFLLLLRADSLHRLGLPNKDGVVRFSPYCVCDYMEPERGSEKKTSGPLSPPTGPPGPAPAGPAVRLGSVPYSLLFRVLLQCLKQESDWKVLKLVLGRLPESLRYKVLIFTSPCSVDQLCSALCSMLSGPKTLERLRGAPEGFSRTDLHLAVVPVLTALISYHNYLDKTKQREMVYCLEQGLIHRCASQCVVALSICSVEMPDIIIKALPVLVVKLTHISATASMAVPLLEFLSTLARLPHLYRNFAAEQYASVFAISLPYTNPSKFNQYIVCLAHHVIAMWFIRCRLPFRKDFVPFITKGLRSNVLLSFDDTPEKDSFRARSTSLNERPKSLRIARPPKQGLNNSPPVKEFKESSAAEAFRCRSISVSEHVVRSRIQTSLTSASLGSADENSVAQADDSLKNLHLELTETCLDMMARYVFSNFTAVPKRSPVGEFLLAGGRTKTWLVGNKLVTVTTSVGTGTRSLLGLDSGELQSGPESSSSPGVHVRQTKEAPAKLESQAGQQVSRGARDRVRSMSGGHGLRVGALDVPASQFLGSATSPGPRTAPAAKPEKASAGTRVPVQEKTNLAAYVPLLTQGWAEILVRRPTGNTSWLMSLENPLSPFSSDINNMPLQELSNALMAAERFKEHRDTALYKSLSVPAASTAKPPPLPRSNTVASFSSLYQSSCQGQLHRSVSWADSAVVMEEGSPGEVPVLVEPPGLEDVEAALGMDRRTDAYSRSSSVSSQEEKSLHAEELVGRGIPIERVVSSEGGRPSVDLSFQPSQPLSKSSSSPELQTLQDILGDPGDKADVGRLSPEVKARSQSGTLDGESAAWSASGEDSRGQPEGPLPSSSPRSPSGLRPRGYTISDSAPSRRGKRVERDALKSRATASNAEKVPGINPSFVFLQLYHSPFFGDESNKPILLPNESQSFERSVQLLDQIPSYDTHKIAVLYVGEGQSNSELAILSNEHGSYRYTEFLTGLGRLIELKDCQPDKVYLGGLDVCGEDGQFTYCWHDDIMQAVFHIATLMPTKDVDKHRCDKKRHLGNDFVSIVYNDSGEDFKLGTIKGQFNFVHVIVTPLDYECNLVSLQCRKDMEGLVDTSVAKIVSDRNLPFVARQMALHANMASQVHHSRSNPTDIYPSKWIARLRHIKRLRQRICEEAAYSNPSLPLVHPPSHSKAPAQTPAEPTPGYEVGQRKRLISSVEDFTEFV

SEQ ID NO: 5085 - protein, 764 aa, unidentified
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMGYKFLRIVVWFVSLLALLGNVFVLLILLTSHYKLNVPRFLMCNLAFADFCMGMYLLLIASVDLYTHSEYYNHAIDWQTGPGCNTAGFFTVFASELSVYTLTVITLERWYAITFAMRLDRKIRLRHACAIMVGGWVCCFLLALLPLVGISSYAKVSICLPMDTETPLALAYIVFVLTLNIVAFVIVCCCYVKIYITVRNPQYNPGDKDTKIAKRMAVLIFTDFICMAPISFYALSAILNKPLITVSNSKILLVLFYPLNSCANPFLYAIFTKAFQRDVFILLSKFGICKRQAQAYRGQRVPPKNSTDIQVQKVTHDMRQGLHNMEDVYELIENSHLTPKKQGQISEEYMQTVL

SEQ ID NO: 5086 - protein, 228 aa, unidentified
MSVSEIFVELQGFLAAEQDIREEIRKVVQSLEQTAREILTLLQGVHQGAGFQDIPKRCLKAREHFGTVKTHLTSLKTKFPAEQYYRFHEHWRFVLQRLVFLAAFVVYLETETLVTREAVTEILGIEPDREKGFHLDVEDYLSGVLILASELSRLSVNSVTAGDYSRPLHISTFINELDSGFRLLNLKNDSLRKRYDGLKYDVKKVEEVVYDLSIRGFNKETAAACVEK

SEQ ID NO: 5087 - protein, 513 aa, unidentified
MSYGSIARGGGLGSRGPFGGPSRQGCQPLECARCWTEYGIRHFPCPSPESKLQNRCVGKDGEGDLGPAGTPIVPRARKRGPGVAPEGSRMPEPTSSPTIGPRKDSAAGPHGRMAGPSTTRAKKRKPNFCPQETEVLVSKVSKHHQLLFGTGLLKAEPTRRYRVWSRILQAVNALGYCRRDVVDLKHKWRDLRAVVRRKLGDLRKAAHGPSPGSGKPQALALTPVEQVVAKTFSCQALPSEGFSLEPPRATQVDPCNLQELFQEMSANVFRINSSVTSLERSLQSLGTPSDTQELRDSLHTAQQETNKTIAASASSVKQMAELLRSSCPQERLQQERPQLDRLKTQLSDAIQCYGVVQKKIAEKSRALLPMAQRGSKQSPQAPFAELADDEKVFNGSDNMWQGQEQALLPDITEEDLEAIRLREEAILQMESNLLDVNQIIKDLASMVSEQGEAVDSIEASLEAASSHAEAARQLLAGASRHQLQRHKIKCCFLSAGVTALLVIIIIIATSVRK

SEQ ID NO: 5088 - protein, 241 aa, unidentified
MQCFSFIKTMMILFNLLIFLCGAALLAVGIWVSIDGASFLKIFGPLSSSAMQFVNVGYFLIAAGVVVFALGFLGCYGAKTESKCALVTFFFILLLIFIAEVAAAVVALVYTTMAEHFLTLLVVPAIKKDYGSQEDFTQVWNTTMKGLKCCGFTNYTDFEDSPYFKENSAFPPFCCNDNVTNTANETCTKQKAHDQKVEGCFNQLLYDIRTNAVTVGGVAAGIGGLELAAMIVSMYLYCNLQ

SEQ ID NO: 5089 - protein, 355 aa, unidentified
MEEGERSPLLSQETAGQKPLSVHRPPTSGCLGPVPREDQAEAWGCSCCPPETKHQALSGTPKKGPAPSLSPGSSCVKYLIFLSNFPFSLLGLLALAIGLWGLAVKGSLGSDLGGPLPTDPMLGLALGGLVVSAASLAGCLGALCENTCLLRGFSGGILAFLVLEAVAGALVVALWGPLQDSLEHTLRVAIAHYQDDPDLRFLLDQVQLGLRCCGAASYQDWQQNLYFNCSSPGVQACSLPASCCIDPREDGASVNDQCGFGVLRLDADAAQRVVYLEGCGPPLRRWLRANLAASGGYAIAVVLLQGAELLLAARLLGALAARSGAAYGPGAHGEDRAGPQSPSPGAPPAAKPARG

SEQ ID NO: 5090 - protein, 253 aa, unidentified
MAHYKTEQDDWLIIYLKYLLFVFNFFFWVGGAAVLAVGIWTLVEKSGYLSVLASSTFAASAYILIFAGVLVMVTGFLGFGAILWERKGCLSTYFCLLLVIFLVELVAGVLAHVYYQRLSDELKQHLNRTLAENYGQPGATQITASVDRLQQDFKCCGSNSSADWQHSTYILLREAEGRQVPDSCCKTVVVRCGQRAHPSNIYKVEGGCLTKLEQFLADHLLLMGAVGIGVACLQICGMVLTCCLHQRLQRHFY

SEQ ID NO: 5091 - protein, 305 aa, unidentified
MAREDSVKCLRCLLYALNLLFWLMSISVLAVSAWMRDYLNNVLTLTAETRVEEAVILTYFPVVHPVMIAVCCFLIIVGMLGYCGTVKRNLLLLAWYFGSLLVIFCVELACGVWTYEQELMVPVQWSDMVTLKARMTNYGLPRYRWLTHAWNFFQREFKCCGVVYFTDWLEMTEMDWPPDSCCVREFPGCSKQAHQEDLSDLYQEGCGKKMYSFLRGTKQLQVLRFLGISIGVTQILAMILTITLLWALYYDRREPGTDQMMSLKNDNSQHLSCPSVELLKPSLSRIFEHTSMANSFNTHFEMEEL

SEQ ID NO: 5092 - protein, 204 aa, unidentified
MVCGGFACSKNCLCALNLLYTLVSLLLIGIAAWGIGFGLISSLRVVGVVIAVGIFLFLIALVGLIGAVKHHQVLLFFYMIILLLVFIVQFSVSCACLALNQEQQGQLLEVGWNNTASARNDIQRNLNCCGFRSVNPNDTCLASCVKSDHSCSPCAPIIGEYAGEVLRFVGGIGLFFSFTEILGVWLTYRYRNQKDPRANPSAFL

SEQ ID NO: 5093 - protein, 270 aa, unidentified
MHYYRYSNAKVSCWYKYLLFSYNIIFWLAGVVFLGVGLWAWSEKGVLSDLTKVTRMHGIDPVVLVLMVGVVMFTLGFAGCVGALRENICLLNFFCGTIVLIFFLELAVAVLAFLFQDWVRDRFREFFESNIKSYRDDIDLQNLIDSLQKANQCCGAYGPEDWDLNVYFNCSGASYSREKCGVPFSCCVPDPAQKVVNTQCGYDVRIQLKSKWDESIFTKGCIQALESWLPRNIYIVAGVFIAISLLQIFGIFLARTLISDIEAVKAGHHF

SEQ ID NO: 5094 - protein, 294 aa, unidentified
MPRGDSEQVRYCARFSYLWLKFSLIIYSTVFWLIGALVLSVGIYAEVERQKYKTLESAFLAPAIILILLGVVMFMVSFIGVLASLRDNLYLLQAFMYILGICLIMELIGGVVALTFRNQTIDFLNDNIRRGIENYYDDLDFKNIMDFVQKKFKCCGGEDYRDWSKNQYHDCSAPGPLACGVPYTCCIRNTTEVVNTMCGYKTIDKERFSVQDVIYVRGCTNAVIIWFMDNYTIMAGILLGILLPQFLGVLLTLLYITRVEDIIMEHSVTDGLLGPGAKPSVEAAGTGCCLCYPN

SEQ ID NO: 5095 - protein, 245 aa, unidentified
MAEIHTPYSSLKKLLSLLNGFVAVSGIILVGLGIGGKCGGASLTNVLGLSSAYLLHVGNLCLVMGCITVLLGCAGWYGATKESRGTLLFCILSMVIVLIMEVTAATVVLLFFPIVGDVALEHTFVTLRKNYRGYNEPDDYSTQWNLVMEKLKCCGVNNYTDFSGSSFEMTTGHTYPRSCCKSIGSVSCDGRDVSPNVIHQKGCFHKLLKITKTQSFTLSGSSLGAAVIQRWGSRYVAQAGLELLA

SEQ ID NO: 5096 - protein, 270 aa, unidentified
MPGKHQHFQEPEVGCCGKYFLFGFNIVFWVLGALFLAIGLWAWGEKGVLSNISALTDLGGLDPVWLFVVVGGVMSVLGFAGCIGALRENTFLLKFFSVFLGLIFFLELATGILAFVFKDWIRDQLNLFINNNVKAYRDDIDLQNLIDFAQEYWSCCGARGPNDWNLNIYFNCTDLNPSRERCGVPFSCCVRDPAEDVLNTQCGYDVRLKLELEQQGFIHTKGCVGQFEKWLQDNLIVVAGVFMGIALLQIFGICLAQNLVSDIKAVKANW

SEQ ID NO: 5097 - protein, 248 aa, unidentified
MEGDCLSCMKYLMFVFNFFIFLGGACLLAIGIWVMVDPTGFREIVAANPLLLTGAYILLAMGGLLFLLGFLGCCGAVRENKCLLLFFFLFILIIFLAELSAAILAFIFRENLTREFFTKELTKHYQGNNDTDVFSATWNSVMITFGCCGVNGPEDFKFASVFRLLTLDSEEVPEACCRREPQSRDGVLLSREECLLGRSLFLNKQGCYTVILNTFETYVYLAGALAIGVLAIELFAMIFAMCLFRGIQ

SEQ ID NO: 5098 - protein, 248 aa, unidentified
MLRNNKTIIIKYFLNLINGAFLVLGLLFMGFGAWLLLDRNNFLTAFDENNHFIVPISQILIGMGSSTVLFCLLGYIGIHNEIRWLLIVYAVLITWTFAVQVVLSAFIITKKEEVQQLWHDKIDFVISEYGSKDKPEDITKWTILNALQKTLQCCGQHNYTDWIKNKNKENSGQVPCSCTKSTLRKWFCDEPLNATYLEGCENKISAWYNVNVLTLIGINFGLLTSEVFQVSLTVCFFKNIKNIIHAEM

SEQ ID NO: 5099 - protein, 221 aa, unidentified
MGRFRGGLRCIKYLLLGFNLLFWLAGSAVIAFGLWFRFGGAIKELSSEDKSPEYFYVGLYVLVGAGALMMAVGFFGCCGAMRESQCVLGSFFTCLLVIFAAEVTTGVFAFIGKGVAIRHVQTMYEEAYNDYLKDRGKGNGTLITFHSTFQCCGKESSEQVQPTCPKELLGHKNCIDEIETIISVKLQLIGIVGIGIAGLTIFGMIFSMVLCCAIRNSRDVI

SEQ ID NO: 5100 - protein, 253 aa, unidentified
MGQCGITSSKTVLVFLNLIFWGAAGILCYVGAYVFITYDDYDHFFEDVYTLIPAVVIIAVGALLFIIGLIGCCATIRESRCGLATFVIILLLVFVTEVVVVVLGYVYRAKVENEVDRSIQKVYKTYNGTNPDAASRAIDYVQRQLHCCGIHNYSDWENTDWFKETKNQSVPLSCCRETASNCNGSLAHPSDLYAEGCEALVVKKLQEIMMHVIWAALAFAAIQLLGMLCACIVLCRRSRDPAYELLITGGTYA

SEQ ID NO: 5101 - protein, 210 aa, unidentified
MVCGGFACSKNALCALNVVYMLVSLLLIGVAAWGKGLGLVSSIHIIGGVIAVGVFLLLIAVAGLVGAVNHHQVLLFFYMIILGLVFIFQFVISCSCLAINRSKQTDVINASWWVMSNKTRDELERSFDCCGLFNLTTLYQQDYDFCTAICKSQSPTCQMCGEKFLKHSDEALKILGGVGLFFSFTEILGVWLAMRFRNQKDPRANPSAFL

SEQ ID NO: 5102 - protein, 320 aa, unidentified
MGPWSRVRVAKCQMLVTCFFILLLGLSVATMVTLTYFGAHFAVIRRASLEKNPYQAVHQWAFSAGLSLVGLLTLGAVLSAAATVREAQGLMAGGFLCFSLAFCAQVQVVFWRLHSPTQVEDAMLDTYDLVYEQAMKGTSHVRRQELAAIQDVFLCCGKKSPFSRLGSTEADLCQGEEAAREDCLQGIRSFLRTHQQVASSLTSIGLALTVSALLFSSFLWFAIRCGCSLDRKGKYTLTPRACGRQPQEPSLLRCSQGGPTHCLHSEAVAIGPRGCSGSLRWLQESDAAPLPLSCHLAAHRALQGRSRGGLSGCPERGLSD

SEQ ID NO: 5103 - protein, 283 aa, unidentified
MARRPRAPAASGEEFSFVSPLVKYLLFFFNMLFWVISMVMVAVGVYARLMKHAEAALACLAVDPAILLIVVGVLMFLLTFCGCIGSLRENICLLQTFSLCLTAVFLLQLAAGILGFVFSDKARGKVSEIINNAIVHYRDDLDLQNLIDFGQKKFSCCGGISYKDWSQNMYFNCSEDNPSRERCSVPYSCCLPTPDQAVINTMCGQGMQAFDYLEASKVIYTNGCIDKLVNWIHSNLFLLGGVALGLAIPQLVGILLSQILVNQIKDQIKLQLYNQQHRADPWY

SEQ ID NO: 5104 - protein, 238 aa, unidentified
MARACLQAVKYLMFAFNLLFWLGGCGVLGVGIWLAATQGSFATLSSSFPSLSAANLLIITGAFVMAIGFVGCLGAIKENKCLLLTFFLLLLLVFLLEATIAILFFAYTDKIDRYAQQDLKKGLHLYGTQGNVGLTNAWSIIQTDFRCCGVSNYTDWFEVYNATRVPDSCCLEFSESCGLHAPGTWWKAPCYETVKVWLQENLLAVGIFGLCTALVQILGLTFAMTMYCQVVKADTYCA

SEQ ID NO: 5105 - protein, 268 aa, unidentified
MSGKHYKGPEVSCCIKYFIFGFNVIFWFLGITFLGIGLWAWNEKGVLSNISSITDLGGFDPVWLFLVVGGVMFILGFAGCIGALRENTFLLKFFSVFLGIIFFLELTAGVLAFVFKDWIKDQLYFFINNNIRAYRDDIDLQNLIDFTQEYWQCCGAFGADDWNLNIYFNCTDSNASRERCGVPFSCCTKDPAEDVINTQCGYDARQKPEVDQQIVIYTKGCVPQFEKWLQDNLTIVAGIFIGIALLQIFGICLAQNLVSDIEAVRASW

SEQ ID NO: 5106 - protein, 245 aa, unidentified
MASPSRRLQTKPVITCFKSVLLIYTFIFWITGVILLAVGIWGKVSLENYFSLLNEKATNVPFVLIATGTVIILLGTFGCFATCRASAWMLKLYAMFLTLVFLVELVAAIVGFVFRHEIKNSFKNNYEKALKQYNSTGDYRSHAVDKIQNTLHCCGVTDYRDWTDTNYYSEKGFPKSCCKLEDCTPQRDADKVNNEGCFIKVMTIIESEMGVVAGISFGVACFQLIGIFLAYCLSRAITNNQYEIV

SEQ ID NO: 5107 - protein, 249 aa, unidentified
MASRRMETKPVITCLKTLLIIYSFVFWITGVILLAVGVWGKLTLGTYISLIAENSTNAPYVLIGTGTTIVVFGLFGCFATCRGSPWMLKLYAMFLSLVFLAELVAGISGFVFRHEIKDTFLRTYTDAMQTYNGNDERSRAVDHVQRSLSCCGVQNYTNWSTSPYFLEHGIPPSCCMNETDCNPQDLHNLTVAATKVNQKGCYDLVTSFMETNMGIIAGVAFGIAFSQLIGMLLACCLSRFITANQYEMV

SEQ ID NO: 5108 - protein, 237 aa, unidentified
MAGVSACIKYSMFTFNFLFWLCGILILALAIWVRVSNDSQAIFGSEDVGSSSYVAVDILIAVGAIIMILGFLGCCGAIKESRCMLLLFFIGLLLILLLQVATGILGAVFKSKSDRIVNETLYENTKLLSATGESEKQFQEAIIVFQEEFKCCGLVNGAADWGNNFQHYPELCACLDKQRPCQSYNGKQVYKETCISFIKDFLAKNLIIVIGISFGLAVIEILGLVFSMVLYCQIGNK

SEQ ID NO: 5109 - protein, 239 aa, unidentified
MARGCLCCLKYMMFLFNLIFWLCGCGLLGVGIWLSVSQGNFATFSPSFPSLSAANLVIAIGTIVMVTGFLGCLGAIKENKCLLLSFFIVLLVILLAELILLILFFVYMDKVNENAKKDLKEGLLLYHTENNVGLKNAWNIIQAEMRCCGVTDYTDWYPVLGENTVPDRCCMENSQGCGRNATTPLWRTGCYEKVKMWFDDNKHVLGTVGMCILIMQILGMAFSMTLFQHIHRTGKKYDA

SEQ ID NO: 5110 - protein, 169 aa, unidentified
MAPPWVPAMGFTLAPSLGCFVGSRFVHGEGLRWYAGLQKPSWHPPHWVLGPVWGTLYSAMGYGSYLVWKELGGFTEKAVVPLGLYTGQLALNWAWPPIFFGARQMGWALVDLLLVSGAAAATTVAWYQVSPLAARLLYPYLAWLAFTTTLNYCVWRDNHGWRGGRRLPE

SEQ ID NO: 5111 - protein, 170 aa, unidentified
MRLQGAIFVLLPHLGPILVWLFTRDHMSGWCEGPRMLSWCPFYKVLLLVQTAIYSVVGYASYLVWKDLGGGLGWPLALPLGLYAVQLTISWTVLVLFFTVHNPGLALLHLLLLYGLVVSTALIWHPINKLAALLLLPYLAWLTVTSALTYHLWRDSLCPVHQPQPTEKSD

SEQ ID NO: 5112 - protein, 367 aa, unidentified
MDDAAVLKRRGYLLGINLGEGSYAKVKSAYSERLKFNVAIKIIDRKKAPADFLEKFLPREIEILAMLNHCSIIKTYEIFETSHGKVYIVMELAVQGDLLELIKTRGALHEDEARKKFHQLSLAIKYCHDLDVVHRDLKCDNLLLDKDFNIKLSDFSFSKRCLRDDSGRMALSKTFCGSPAYAAPEVLQGIPYQPKVYDIWSLGVILYIMVCGSMPYDDSNIKKMLRIQKEHRVNFPRSKHLTGECKDLIYHMLQPDVNRRLHIDEILSHCWMQPKARGSPSVAINKEGESSRGTEPLWTPEPGSDKKSATKLEPEGEAQPQAQPETKPEGTAMQMSRQSEILGFPSKPSTMETEEGPPQQPPETRAQ

SEQ ID NO: 5113 - protein, 358 aa, unidentified
MDDATVLRKKGYIVGINLGKGSYAKVKSAYSERLKFNVAVKIIDRKKTPTDFVERFLPREMDILATVNHGSIIKTYEIFETSDGRIYIIMELGVQGDLLEFIKCQGALHEDVARKMFRQLSSAVKYCHDLDIVHRDLKCENLLLDKDFNIKLSDFGFSKRCLRDSNGRIILSKTFCGSAAYAAPEVLQSIPYQPKVYDIWSLGVILYIMVCGSMPYDDSDIRKMLRIQKEHRVDFPRSKNLTCECKDLIYRMLQPDVSQRLHIDEILSHSWLQPPKPKATSSASFKREGEGKYRAECKLDTKTGLRPDHRPDHKLGAKTQHRLLVVPENENRMEDRLAETSRAKDHHISGAEVGKAST

SEQ ID NO: 5114 - protein, 328 aa, unidentified
MGKGDVLEAAPTTTAYHSLMDEYGYEVGKAIGHGSYGSVYEAFYTKQKVMVAVKIISKKKASDDYLNKFLPREIQVMKVLRHKYLINFYRAIESTSRVYIILELAQGGDVLEWIQRYGACSEPLAGKWFSQLTLGIAYLHSKSIVHRDLKLENLLLDKWENVKISDFGFAKMVPSNQPVGCSPSYRQVNCFSHLSQTYCGSFAYACPEILRGLPYNPFLSDTWSMGVILYTLVVAHLPFDDTNLKKLLRETQKEVTFPANHTISQECKNLILQMLRQATKRATILDIIKDSWVLKFQPEQPTHEIRLLEAMCQLHNTTKQHQSLQITT

SEQ ID NO: 5115 - protein, 860 aa, unidentified
MAPAGCCCCCCFWGGAVAAAGAARRVLLLLLLGVLSAGLRPGALATEHYSPLSLLKQELQHRQQQEAPAGGGGCSPQSGDWGDQYSAECGESSFLNFHDSDCEPKGSSPCDSLLSLNTEKILSQAKSIAEQKRFPFATDNDSTNEELAIAYVLIGSGLYDEAIRHFSTMLQEEPDLVSAIYGRGIAYGKKGLHDIKNAELALFELSRVITLEPDRPEVFEQRAEILSPLGRINEAVNDLTKAIQLQPSARLYRHRGTLYFISEDYATAHEDFQQSLELNKNQPIAMLYKGLTFFHRGLLKEAIESFKEALKQKVDFIDAYKSLGQAYRELGNFEAATESFQKALLLNQNHVQTLQLRGMMLYHHGSLQEALKNFKRCLQLEPYNEVCQYMKGLSHVAMGQFYEGIKAQTKVMLNDPLPGQKASPEYLKVKYLREYSRYLHAHLDTPLTEYNIDVDLPGSFKDHWAKNLPFLIEDYEEQPGLQPHIKDVLHQNFESYKPEVQELICVADRLGSLMQYETPGFLPNKRIHRAMGLAALEVMQAVQRTWTNSKVRMNGKTRLMQWRDMFDIAVKWRRIADPDQPVLWLDQMPARSLSRGFNNHINLIRGQVINMRYLEYFEKILHFIKDRILVYHGANNPKGLLEVREALEKVHKVEDLLPIMKQFNTKTKDGFTVNTKVPSLKDQGKEYDGFTITITGDKVGNILFSVETQTTEERTQLYHAEIDALYKDLTAKGKVLILSSEFGEADAVCNLILSLVYYFYNLMPLSRGSSVIAYSVIVGALMASGKEVAGKIPKGKLVDFEAMTAPGSEAFSKVAKSWMNLKSISPSYKTLPSVSETFPTLRSMIEVLNTDSSPRCLKKL

SEQ ID NO: 5116 - protein, 770 aa, unidentified
MDRDLLRQSLNCHGSSLLSLLRSEQQDNPHFRSLLGSAAEPARGPPPQHPLQGRKEKRVDNIEIQKFISKKADLLFALSWKSDAPATSEINEDSEDHYAIMPPLEQFMEIPSMDRRELFFRDIERGDIVIGRISSIREFGFFMVLICLGSGIMRDIAHLEITALCPLRDVPSHSNHGDPLSYYQTGDIIRAGIKDIDRYHEKLAVSLYSSSLPPHLSGIKLGVISSEELPLYYRRSVELNSNSLESYENVMQSSLGFVNPGVVEFLLEKLGIDESNPPSLMRGLQSKNFSEDDFASALRKKQSASWALKCVKIGVDYFKVGRHVDAMNEYNKALEIDKQNVEALVARGALYATKGSLNKAIEDFELALENCPTHRNARKYLCQTLVERGGQLEEEEKFLNAESYYKKALALDETFKDAEDALQKLHKYMQKSLELREKQAEKEEKQKTKKIETSAEKLRKLLKEEKRLKKKRRKSTSSSSVSSADESVSSSSSSSSSGHKRHKKHKRNRSESSRSSRRHSSRASSNQIDQNRKDECYPVPANTSASFLNHKQEVEKLLGKQDRLQYEKTQIKEKDRCPLSSSSLEIPDDFGGRSEDPRDFYNSYKTQAGSSKTEKPYKSERHFSSRRNSSDSFCRNSEDKIYGYRRFEKDIEGRKEHYRRWEPGSVRHSTSPASSEYSWKSVEKYKKYAHSGSRDFSRHEQRYRLNTNQGEYEREDNYGEDIKTEVPEEDALSSKEHSESSVKKNLPQNLLNIFNQIAEFEKEKGNKSKN

SEQ ID NO: 5117 - protein, 2025 aa, unidentified
MDNFAEGDFTVADYALLEDCPHVDDCVFAAEFMSNDYVRVTQLYCDGVGVQYKDYIQSERNLEFDICSIWCSKPISVLQDYCDAIKINIFWPLLFQHQNSSVISRLHPCVDANNSRASEINLKKLQHLELMEDIVDLAKKVANDSFLIGGLLRIGCKIENKILAMEEALNWIKYAGDVTILTKLGSIDNCWPMLSIFFTEYKYHITKIVMEDCNLLEELKTQSCMDCIEEGELMKMKGNEEFSKERFDIAIIYYTRAIEYRPENYLLYGNRALCFLRTGQFRNALGDGKRATILKNTWPKGHYRYCDALSMLGEYDWALQANIKAQKLCKNDPEGIKDLIQQHVKLQKQIEDLQGRTANKDPIKAFYENRAYTPRSLSAPIFTTSLNFVEKERDFRKINHEMANGGNQNLKVADEALKVDDCDCHPEFSPPSSQPPKHKGKQKSRNNESEKFSSSSPLTLPADLKNILEKQFSKSSRAAHQDFANIMKMLRSLIQDGYMALLEQRCRSAAQAFTELLNGLDPQKIKQLNLAMINYVLVVYGLAISLLGIGQPEELSEAENQFKRIIEHYPSEGLDCLAYCGIGKVYLKKNRFLEALNHFEKARTLIYRLPGVLTWPTSNVIIEESQPQKIKMLLEKFVEECKFPPVPDAICCYQKCHGYSKIQIYITDPDFKGFIRISCCQYCKIEFHMNCWKKLKTTTFNDKIDKDFLQGICLTPDCEGVISKIIIFSSGGEVKCEFEHKVIKEKVPPRPILKQKCSSLEKLRLKEDKKLKRKIQKKEAKKLAQERMEEDLRESNPPKNEEQKETVDNVQRCQFLDDRILQCIKQYADKIKSGIQNTAMLLKELLSWKVLSTEDYTTCFSSRNFLNEAVDYVIRHLIQENNRVKTRIFLHVLSELKEVEPKLAAWIQKLNSFGLDATGTFFSRYGASLKLLDFSIMTFLWNEKYGHKLDSIEGKQLDYFSEPASLKEARCLIWLLEEHRDKFPALHSALDEFFDIMDSRCTVLRKQDSGEAPFSSTKVKNKSKKKKPKDSKPMLVGSGTTSVTSNNEIITSSEDHSNRNSDSAGPFAVPDHLRQDVEEFEALYDQHSNEYVVRNKKLWDMNPKQKCSTLYDYFSQFLEEHGPLDMSNKMFSAEYEFFPEETRQILEKAGGLKPFLLGCPRFVVIDNCIALKKVASRLKKKRKKKNIKTKVEEISKAGEYVRVKLQLNPAAREFKPDVKSKPVSDSSSAPAFENVKPKPVSANSPKPACEDVKAKPVSDNSSRQVSEDGQPKGVSSNSPKPGSEDANYKRVSCNSPKPVLEDVKPTYWAQSHLVTGYCTYLPFQRFDITQTPPAYINVLPGLPQYTSIYTPLASLSPEYQLPRSVPVVPSFVANDRADKNAAAYFEGHHLNAENVAGHQIASETQILEGSLGISVKSHCSTGDAHTVLSESNRNDEHCGNSNNKCEVIPESTSAVTNIPHVQMVAIQVSWNIIHQEVNTEPYNPFEERQGEISRIEKEHQVLQDQLQEVYENYEQIKLKGLEETRDLEEKLKRHLEENKISKTELDWFLQDLEREIKKWQQEKKEIQERLKSLKKKIKKVSNASEMYTQKNDGKEKEHELHLDQSLEISNTLTNEKMKIEEYIKKGKEDYEESHQRAVAAEVSVLENWKESEVYKLQIMESQAEAFLKKLGLISRDPAAYPDMESDIRSWELFLSNVTKEIEKAKSQFEEQIKAIKNGSRLSELSKVQISELSFPACNTVHPELLPESSGDDGQGLVTSASDVTGNHAALHRDPSVFSAGDSPGEAPSALLPGPPPGQPEATQLTGPKRAGQAALSERSPVADRKQPVPPGRAARSSQSPKKPFNSIIEHLSVVFPCYNSTELAGFIKKVRSKNKNSLSGLSIDEIVQRVTEHILDEQKKKKPNPGKDKRTYEPSSATPVTRSSQGSPSVVVAPSPKTKGQKAEDVPVRIALGASSCEICHEVFKSKNVRVLKCGHKYHKGCFKQWLKGQSACPACQGRDLLTEESPSGRGWPSQNQELPSCSSR

SEQ ID NO: 5118 - protein, 262 aa, unidentified
MASFGWKRKIGEKVSKVTSQQFEAEAADEKDVVDNDEGNWLHAIKRRKEILLEGCAEKSKQLKDEGASLAENKRYREAIQKWDEALQLTPNDATLYEMKSQVLMSLHEMFPAVHAAEMAVQQNPHSWESWQTLGRAQLGLGEIILAIRSFQVALHIYPMNPEIWKEDLSWARTLQEQQKVAQRIKKSEAPAEVTHFSPKSIPDYDFESDEIVAVCAAIAEKEKTVSANKTMVIVSASGAIETVTEKEDGATPPDGSVFIKAR

SEQ ID NO: 5119 - protein, 613 aa, unidentified
MGQKGHKDSLYPCGGTPESSLHEALDQCMTALDLFLTNQFSEALSYLKPRTKESMYHSLTYATILEMQAMMTFDPQDILLAGNMMKEAQMLCQRHRRKSSVTDSFSSLVNRPTLGQFTEEEIHAEVCYAECLLQRAALTFLQGSSHGGAVRPRALHDPSHACSCPPGPGRQHLFLLQDENMVSFIKGGIKVRNSYQTYKELDSLVQSSQYCKGENHPHFEGGVKLGVGAFNLTLSMLPTRILRLLEFVGFSGNKDYGLLQLEEGASGHSFRSVLCVMLLLCYHTFLTFVLGTGNVNIEEAEKLLKPYLNRYPKGAIFLFFAGRIEVIKGNIDAAIRRFEECCEAQQHWKQFHHMCYWELMWCFTYKGQWKMSYFYADLLSKENCWSKATYIYMKAAYLSMFGKEDHKPFGDDEVELFRAVPGLKLKIAGKSLPTEKFAIRKSRRYFSSNPISLPVPALEMMYIWNGYAVIGKQPKLTDGILEIITKAEEMLEKGPENEYSVDDECLVKLLKGLCLKYLGRVQEAEENFRSISANEKKIKYDHYLIPNALLELALLLMEQDRNEEAIKLLESAKQNYKNYSMESRTHFRIQAATLQAKSSLENSSRSMVSSVSL

SEQ ID NO: 5120 - protein, 682 aa, unidentified
MDAVLACRLRGRGNRVAALRPRPRPGGSAGPSPFALLCAGLSPEPRAGVGSEFPAWFLGGSSQRRNMALLGSRAELEADEDVFEDALETISISSHSDMATSSLHFASCDTQQAPRQRGASTVSSSSSTKVDLKSGLEECAVALNLFLSNKFTDALELLRPWAKESMYHALGYSTIVVLQAVLTFEQQDIQNGISAMKDALQTCQKYRKKYTVVESFSSLLSRGSLEQLSEEEMHAEICYAECLLQKAALTFVQDENMINFIKGGLKIRTSYQIYKECLSILHEIQKNKLQQEFFYEFEGGVKLGSGAFNLMLSLLPARIIRLLEFIGFSGNRELGLLQLREGASGRSMRSALCCLTILAFHTYISLILGTGEVNVAEAERLLAPFLQQFPNGSLVLFYHARIELLKGNLEEAQEVFQKCISVQEEWKQFHHLCYWELMWINVFQQNWMQAYYYSDLLCKESKWSKATYVFLKAAILSMLPEEDVVATNENVVTLFRQVDSLKQRIAGKSIPTEKFAVRKARRYSASLPAPVKLILPALEMMYVWNGFSIVSKRKDLSENLLVTVEKAEAALQSQNFNSFSVDDECLVKLLKGCCLKNLQRPLQAELCYNHVVESEKLLKYDHYLVPFTLFELASLYKSQGEIDKAIKFLETARNNYKDYSLESRLHFRIQAALHLWRKPSSD

SEQ ID NO: 5121 - protein, 583 aa, unidentified
MAGSEQQRPRRRDDGDSDAAAAAAAPLQDAELALAGINMLLNNGFRESDQLFKQYRNHSPLMSFGASFVSFLNAMMTFEEEKMQLACDDLKTTEKLCESEEAGVIETIKNKIKKNVDVRKSAPSMVDRLQRQIIIADCQVYLAVLSFVKQELSAYIKGGWILRKAWKIYNKCYLDINALQELYQKKLTEESLTSDAANDNHIVAEGVSEESLNRLKGAVSFGYGLFHLCISMVPPNLLKIINLLGFPGDRLQGLSSLMYASESKDMKAPLATLALLWYHTVVRPFFALDGSDNKAGLDEAKEILLKKEAAYPNSSLFMFFKGRIQRLECQINSALTSFHTALELAVDQREIQHVCLYEIGWCSMIELNFKDAFDSFERLKNESRWSQCYYAYLTAVCQGATGDVDGAQIVFKEVQKLFKRKNNQIEQFSVKKAERFRKQTPTKALCVLASIEVLYLWKALPNCSFPNLQRMSQACHEVDDSSVVGLKYLLLGAIHKCLGNSEDAVQYFQRAVKDELCRQNNLYVQPYACYELGCLLLDKPETVGRGRALLLQAKEDFSGYDFENRLHVRIHAALASLRELVPQ

SEQ ID NO: 5122 - protein, 541 aa, unidentified
MSSEMEPLLLAWSYFRRRKFQLCADLCTQMLEKSPYDQEPDPELPVHQAAWILKARALTEMVYIDEIDVDQEGIAEMMLDENAIAQVPRPGTSLKLPGTNQTGGPSQAVRPITQAGRPITGFLRPSTQSGRPGTMEQAIRTPRTAYTARPITSSSGRFVRLGTASMLTSPDGPFINLSRLNLTKYSQKPKLAKALFEYIFHHENDVKTIHLEDVVLHLGIYPFLLRNKNHIEKNALDLAALSTEHSQYKDWWWKVQIGKCYYRLGMYREAEKQFKSALKQQEMVDTFLYLAKVYVSLDQPVTALNLFKQGLDKFPGEVTLLCGIARIYEEMNNMSSAAEYYKEVLKQDNTHVEAIACIGSNHFYSDQPEIALRFYRRLLQMGIYNGQLFNNLGLCCFYAQQYDMTLTSFERALSLAENEEEAADVWYNLGHVAVGIGDTNLAHQCFRLALVNNNNHAEAYNNLAVLEMRKGHVEQARALLQTASSLAPHMYEPHFNFATISDKIGDLQRSYVAAQKSEAAFPDHVDTQHLIKQLRQHFAML

SEQ ID NO: 5123 - protein, 508 aa, unidentified
MELDSALEAPSQEDSNLSEELSHSAFGQAFSKILHCLARPEARRGNVKDAVLKDLGDLIEATEFDRLFEGTGARLRGMPETLGQVAKALEKYAAPSKEEEGGGDGHSEAAEKAAQVGLLFLKLLGKVETAKNSLVGPAWQTGLHHLAGPVYIFAITHSLEQPWTTPRSREVAREVLTSLLQVTECGSVAGFLHGENEDEKGRLSVILGLLKPDLYKESWKNNPAIKHVFSWTLQQVTRPWLSQHLERVLPASLVISDDYQTENKILGVHCLHHIVLNVPAADLLQYNRAQVLYHAISNHLYTPEHHLIQAVLLCLLDLFPILEKTLHWKGDGARPTTHCDEVLRLILTHMEPEHRLLLRRTYARNLPAFVNRLGILTVRHLKRLERVIIGYLEVYDGPEEEARLKILETLKLLMQHTWPRVSCRLVVLLKALLKLICDVARDPNLTPESVKSALLQEATDCLILLDRCSQGRVKGLLAKIPQSCEDRKVVNYIRKVQQVSEGAPYNGT

SEQ ID NO: 5124 - protein, 32759 aa, unidentified
MTTQAPTFTQPLQSVVVLEGSTATFEAHISGFPVPEVSWFRDGQVISTSTLPGVQISFSDGRAKLTIPAVTKANSGRYSLKATNGSGQATSTAELLVKAETAPPNFVQRLQSMTVRQGSQVRLQVRVTGIPTPVVKFYRDGAEIQSSLDFQISQEGDLYSLLIAEAYPEDSGTYSVNATNSVGRATSTAELLVQGEEEVPAKKTKTIVSTAQISESRQTRIEKKIEAHFDARSIATVEMVIDGAAGQQLPHKTPPRIPPKPKSRSPTPPSIAAKAQLARQQSPSPIRHSPSPVRHVRAPTPSPVRSVSPAARISTSPIRSVRSPLLMRKTQASTVATGPEVPPPWKQEGYVASSSEAEMRETTLTTSTQIRTEERWEGRYGVQEQVTISGAAGAAASVSASASYAAEAVATGAKEVKQDADKSAAVATVVAAVDMARVREPVISAVEQTAQRTTTTAVHIQPAQEQVRKEAEKTAVTKVVVAADKAKEQELKSRTKEVITTKQEQMHVTHEQIRKETEKTFVPKVVISAAKAKEQETRISEEITKKQKQVTQEAIRQETEITAASMVVVATAKSTKLETVPGAQEETTTQQDQMHLSYEKIMKETRKTVVPKVIVATPKVKEQDLVSRGREGITTKREQVQITQEKMRKEAEKTALSTIAVATAKAKEQETILRTRETMATRQEQIQVTHGKVDVGKKAEAVATVVAAVDQARVREPREPGHLEESYAQQTTLEYGYKERISAAKVAEPPQRPASEPHVVPKAVKPRVIQAPSETHIKTTDQKGMHISSQIKKTTDLTTERLVHVDKRPRTASPHFTVSKISVPKTEHGYEASIAGSAIATLQKELSATSSAQKITKSVKAPTVKPSETRVRAEPTPLPQFPFADTPDTYKSEAGVEVKKEVGVSITGTTVREERFEVLHGREAKVTETARVPAPVEIPVTPPTLVSGLKNVTVIEGESVTLECHISGYPSPTVTWYREDYQIESSIDFQITFQSGIARLMIREAFAEDSGRFTCSAVNEAGTVSTSCYLAVQVSEEFEKETTAVTEKFTTEEKRFVESRDVVMTDTSLTEEQAGPGEPAAPYFITKPVVQKLVEGGSVVFGCQVGGNPKPHVYWKKSGVPLTTGYRYKVSYNKQTGECKLVISMTFADDAGEYTIVVRNKHGETSASASLLEEADYELLMKSQQEMLYQTQVTAFVQEPKVGETAPGFVYSEYEKEYEKEQALIRKKMAKDTVVVRTYVEDQEFHISSFEERLIKEIEYRIIKTTLEELLEEDGEEKMAVDISESEAVESGFDSRIKNYRILEGMGVTFHCKMSGYPLPKIAWYKDGKRIKHGERYQMDFLQDGRASLRIPVVLPEDEGIYTAFASNIKGNAICSGKLYVEPAAPLGAPTYIPTLEPVSRIRSLSPRSVSRSPIRMSPARMSPARMSPARMSPARMSPGRRLEETDESQLERLYKPVFVLKPVSFKCLEGQTARFDLKVVGRPMPETFWFHDGQQIVNDYTHKVVIKEDGTQSLIIVPATPSDSGEWTVVAQNRAGRSSISVILTVEAVEHQVKPMFVEKLKNVNIKEGSRLEMKVRATGNPNPDIVWLKNSDIIVPHKYPKIRIEGTKGEAALKIDSTVSQDSAWYTATAINKAGRDTTRCKVNVEVEFAEPEPERKLIIPRGTYRAKEIAAPELEPLHLRYGQEQWEEGDLYDKEKQQKPFFKKKLTSLRLKRFGPAHFECRLTPIGDPTMVVEWLHDGKPLEAANRLRMINEFGYCSLDYGVAYSRDSGIITCRATNKYGTDHTSATLIVKDEKSLVEESQLPEGRKGLQRIEELERMAHEGALTGVTTDQKEKQKPDIVLYPEPVRVLEGETARFRCRVTGYPQPKVNWYLNGQLIRKSKRFRVRYDGIHYLDIVDCKSYDTGEVKVTAENPEGVIEHKVKLEIQQREDFRSVLRRAPEPRPEFHVHEPGKLQFEVQKVDRPVDTTETKEVVKLKRAERITHEKVPEESEELRSKFKRRTEEGYYEAITAVELKSRKKDESYEELLRKTKDELLHWTKELTEEEKKALAEEGKITIPTFKPDKIELSPSMEAPKIFERIQSQTVGQGSDAHFRVRVVGKPDPECEWYKNGVKIERSDRIYWYWPEDNVCELVIRDVTAEDSASIMVKAINIAGETSSHAFLLVQAKQLITFTQELQDVVAKEKDTMATFECETSEPFVKVKWYKDGMEVHEGDKYRMHSDRKVHFLSILTIDTSDAEDYSCVLVEDENVKTTAKLIVEGAVVEFVKELQDIEVPESYSGELECIVSPENIEGKWYHNDVELKSNGKYTITSRRGRQNLTVKDVTKEDQGEYSFVIDGKKTTCKLKMKPRPIAILQGLSDQKVCEGDIVQLEVKVSLESVEGVWMKDGQEVQPSDRVHIVIDKQSHMLLIEDMTKEDAGNYSFTIPALGLSTSGRVSVYSVDVITPLKDVNVIEGTKAVLECKVSVPDVTSVKWYLNDEQIKPDDRVQAIVKGTKQRLVINRTHASDEGPYKLIVGRVETNCNLSVEKIKIIRGLRDLTCTETQNVVFEVELSHSGIDVLWNFKDKEIKPSSKYKIEAHGKIYKLTVLNMMKDDEGKYTFYAGENMTSGKLTVAGGAISKPLTDQTVAESQEAVFECEVANPDSKGEWLRDGKHLPLTNNIRSESDGHKRRLIIAATKLDDIGEYTYKVATSKTSAKLKVEAVKIKKTLKNLTVTETQDAVFTVELTHPNVKGVQWIKNGVVLESNEKYAISVKGTIYSLRIKNCAIVDESVYGFRLGRLGASARLHVETVKIIKKPKDVTALENATVAFEVSVSHDTVPVKWFHKSVEIKPSDKHRLVSERKVHKLMLQNISPSDAGEYTAVVGQLECKAKLFVETLHITKTMKNIEVPETKTASFECEVSHFNVPSMWLKNGVEIEMSEKFKIVVQGKLHQLIIMNTSTEDSAEYTFVCGNDQVSATLTVTPIMITSMLKDINAEEKDTITFEVTVNYEGISYKWLKNGVEIKSTDKCQMRTKKLTHSLNIRNVHFGDAADYTFVAGKATSTATLYVEARHIEFRKHIKDIKVLEKKRAMFECEVSEPDITVQWMKDDQELQITDRIKIQKEKYVHRLLIPSTRMSDAGKYTVVAGGNVSTAKLFVEGRDVRIRSIKKEVQVIEKQRAVVEFEVNEDDVDAHWYKDGIEINFQVQERHKYVVERRIHRMFISETRQSDAGEYTFVAGRNRSSVTLYVNAPEPPQVLQELQPVTVQSGKPARFCAVISGRPQPKISWYKEEQLLSTGFKCKFLHDGQEYTLLLIEAFPEDAAVYTCEAKNDYGVATTSASLSVEVPEVVSPDQEMPVYPPAIITPLQDTVTSEGQPARFQCRVSGTDLKVSWYSKDKKIKPSRFFRMTQFEDTYQLEIAEAYPEDEGTYTFVASNAVGQVSSTANLSLEAPESILHERIEQEIEMEMKEFSSSFLSAEEEGLHSAELQLSKINETLELLSESPVYPTKFDSEKEGTGPIFIKEVSNADISMGDVATLSVTVIGIPKPKIQWFFNGVLLTPSADYKFVFDGDDHSLIILFTKLEDEGEYTCMASNDYGKTICSAYLKINSKGEGHKDTETESAVAKSLEKLGGPCPPHFLKELKPIRCAQGLPAIFEYTVVGEPAPTVTWFKENKQLCTSVYYTIIHNPNGSGTFIVNDPQREDSGLYICKAENMLGESTCAAELLVLLEDTDMTDTPCKAKSTPEAPEDFPQTPLKGPAVEALDSEQEIATFVKDTILKAALITEENQQLSYEHIAKANELSSQLPLGAQELQSILEQDKLTPESTREFLCINGSIHFQPLKEPSPNLQLQIVQSQKTFSKEGILMPEEPETQAVLSDTEKIFPSAMSIEQINSLTVEPLKTLLAEPEGNYPQSSIEPPMHSYLTSVAEEVLSPKEKTVSDTNREQRVTLQKQEAQSALILSQSLAEGHVESLQSPDVMISQVNYEPLVPSEHSCTEGGKILIESANPLENAGQDSAVRIEEGKSLRFPLALEEKQVLLKEEHSDNVVMPPDQIIESKREPVAIKKVQEVQGRDLLSKESLLSGIPEEQRLNLKIQICRALQAAVASEQPGLFSEWLRNIEKVEVEAVNITQEPRHIMCMYLVTSAKSVTEEVTIIIEDVDPQMANLKMELRDALCAIIYEEIDILTAEGPRIQQGAKTSLQEEMDSFSGSQKVEPITEPEVESKYLISTEEVSYFNVQSRVKYLDATPVTKGVASAVVSDEKQDESLKPSEEKEESSSESGTEEVATVKIQEAEGGLIKEDGPMIHTPLVDTVSEEGDIVHLTTSITNAKEVNWYFENKLVPSDEKFKCLQDQNTYTLVIDKVNTEDHQGEYVCEALNDSGKTATSAKLTVVKRAAPVIKRKIEPLEVALGHLAKFTCEIQSAPNVRFQWFKAGREIYESDKCSIRSSKYISSLEILRTQVVDCGEYTCKASNEYGSVSCTATLTVTEAYPPTFLSRPKSLTTFVGKAAKFICTVTGTPVIETIWQKDGAALSPSPNWRISDAENKHILELSNLTIQDRGVYSCKASNKFGADICQAELIIIDKPHFIKELEPVQSAINKKVHLECQVDEDRKVTVTWSKDGQKLPPGKDYKICFEDKIATLEIPLAKLKDSGTYVCTASNEAGSSSCSATVTVREPPSFVKKVDPSYLMLPGESARLHCKLKGSPVIQVTWFKNNKELSESNTVRMYFVNSEAILDITDVKVEDSGSYSCEAVNDVGSDSCSTEIVIKEPPSFIKTLEPADIVRGTNALLQCEVSGTGPFEISWFKDKKQIRSSKKYRLFSQKSLVCLEIFSFNSADVGEYECVVANEVGKCGCMATHLLKEPPTFVKKVDDLIALGGQTVTLQAAVRGSEPISVTWMKGQEVIREDGKIKMSFSNGVAVLIIPDVQISFGGKYTCLAENEAGSQTSVGELIVKEPAKIIERAELIQVTAGDPATLEYTVAGTPELKPKWYKDGRPLVASKKYRISFKNNVAQLKFYSAELHDSGQYTFEISNEVGSSSCETTFTVLDRDIAPFFTKPLRNVDSVVNGTCRLDCKIAGSLPMRVSWFKDGKEIAASDRYRIAFVEGTASLEIIRVDMNDAGNFTCRATNSVGSKDSSGALIVQEPPSFVTKPGSKDVLPGSAVCLKSTFQGSTPLTIRWFKGNKELVSGGSCYITKEALESSLELYLVKTSDSGTYTCKVSNVAGGVECSANLFVKEPATFVEKLEPSQLLKKGDATQLACKVTGTPPIKITWFANDREIKESSKHRMSFVESTAVLRLTDVGIEDSGEYMCEAQNEAGSDHCSSIVIVKESPYFTKEFKPIEVLKEYDVMLLAEVAGTPPFEITWFKDNTILRSGRKYKTFIQDHLVSLQILKFVAADAGEYQCRVTNEVGSSICSARVTLREPPSFIKKIESTSSLRGGTAAFQATLKGSLPITVTWLKDSDEITEDDNIRMTFENNVASLYLSGIEVKHDGKYVCQAKNDAGIQRCSALLSVKEPATITEEAVSIDVTQGDPATLQVKFSGTKEITAKWFKDGQELTLGSKYKISVTDTVSILKIISTEKKDSGEYTFEVQNDVGRSSCKARINVLDLIIPPSFTKKLKKMDSIKGSFIDLECIVAGSHPISIQWFKDDQEISASEKYKFSFHDNTAFLEISQLEGTDSGTYTCSATNKAGHNQCSGHLTVKEPPYFVEKPQSQDVNPNTRVQLKALVGGTAPMTIKWFKDNKELHSGAARSVWKDDTSTSLELFAAKATDSGTYICQLSNDVGTATSKATLFVKEPPQFIKKPSPVLVLRNGQSTTFECQITGTPKIRVSWYLDGNEITAIQKHGISFIDGLATFQISGARVENSGTYVCEARNDAGTASCSIELKVKEPPTFIRELKPVEVVKYSDVELECEVTGTPPFEVTWLKNNREIRSSKKYTLTDRVSVFNLHITKCDPSDTGEYQCIVSNEGGSCSCSTRVALKEPPSFIKKIENTTTVLKSSATFQSTVAGSPPISITWLKDDQILDEDDNVYISFVDSVATLQIRSVDNGHSGRYTCQAKNESGVERCYAFLLVQEPAQIVEKAKSVDVTEKDPMTLECVVAGTPELKVKWLKDGKQIVPSRYFSMSFENNVASFRIQSVMKQDSGQYTFKVENDFGSSSCDAYLRVLDQNIPPSFTKKLTKMDKVLGSSIHMECKVSGSLPISAQWFKDGKEISTSAKYRLVCHERSVSLEVNNLELEDTANYTCKVSNVAGDDACSGILTVKEPPSFLVKPGRQQAIPDSTVEFKAILKGTPPFKIKWFKDDVELVSGPKCFIGLEGSTSFLNLYSVDASKTGQYTCHVTNDVGSDSCTTMLLVTEPPKFVKKLEASKIVKAGDSSRLECKIAGSPEIRVVWFRNEHELPASDKYRMTFIDSVAVIQMNNLSTEDSGDFICEAQNPAGSTSCSTKVIVKEPPVFSSFPPIVETLKNAEVSLECELSGTPPFEVVWYKDKRQLRSSKKYKIASKNFHTSIHILNVDTSDIGEYHCKAQNEVGSDTCVCTVKLKEPPRFVSKLNSLTVVAGEPAELQASIEGAQPIFVQWLKEKEEVIRESENIRITFVENVATLQFAKAEPANAGKYICQIKNDGGMRENMATLMVLEPAVIVEKAGPMTVTVGETCTLECKVAGTPELSVEWYKDGKLLTSSQKHKFSFYNKISSLRILSVERQDAGTYTFQVQNNVGKSSCTAVVDVSDRAVPPSFTRRLKNTGGVLGASCILECKVAGSSPISVAWFHEKTKIVSGAKYQTTFSDNVCTLQLNSLDSSDMGNYTCVAANVAGSDECRAVLTVQEPPSFVKEPEPLEVLPGKNVTFTSVIRGTPPFKVNWFRGARELVKGDRCNIYFEDTVAELELFNIDISQSGEYTCVVSNNAGQASCTTRLFVKEPAAFLKRLSDHSVEPGKSIILESTYTGTLPISVTWKKDGFNITTSEKCNIVTTEKTCILEILNSTKRDAGQYSCEIENEAGRDVCGALVSTLEPPYFVTELEPLEAAVGDSVSLQCQVAGTPEITVSWYKGDTKLRPTPEYRTYFTNNVATLVFNKVNINDSGEYTCKAENSIGTASSKTVFRIQERQLPPSFARQLKDIEQTVGLPVTLTCRLNGSAPIQVCWYRDGVLLRDDENLQTSFVDNVATLKILQTDLSHSGQYSCSASNPLGTASSSARLTAREPKKSPFFDIKPVSIDVIAGESADFECHVTGAQPMRITWSKDNKEIRPGGNYTITCVGNTPHLRILKVGKGDSGQYTCQATNDVGKDMCSAQLSVKEPPKFVKKLEASKVAKQGESIQLECKISGSPEIKVSWFRNDSELHESWKYNMSFINSVALLTINEASAEDSGDYICEAHNGVGDASCSTALTVKAPPVFTQKPSPVGALKGSDVILQCEISGTPPFEVVWVKDRKQVRNSKKFKITSKHFDTSLHILNLEASDVGEYHCKATNEVGSDTCSCSVKFKEPPRFVKKLSDTSTLIGDAVELRAIVEGFQPISVVWLKDRGEVIRESENTRISFIDNIATLQLGSPEASNSGKYICQIKNDAGMRECSAVLTVLEPARIIEKPEPMTVTTGNPFALECVVTGTPELSAKWFKDGRELSADSKHHITFINKVASLKIPCAEMSDKGLYSFEVKNSVGKSNCTVSVHVSDRIVPPSFIRKLKDVNAILGASVVLECRVSGSAPISVGWFQDGNEIVSGPKCQSSFSENVCTLNLSLLEPSDTGIYTCVAANVAGSDECSAVLTVQEPPSFEQTPDSVEVLPGMSLTFTSVIRGTPPFKVKWFKGSRELVPGESCNISLEDFVTELELFEVQPLESGDYSCLVTNDAGSASCTTHLFVKEPATFVKRLADFSVETGSPIVLEATYTGTPPISVSWIKDEYLISQSERCSITMTEKSTILEILESTIEDYAQYSCLIENEAGQDICEALVSVLEPPYFIEPLEHVEAVIGEPATLQCKVDGTPEIRISWYKEHTKLRSAPAYKMQFKNNVASLVINKVDHSDVGEYSCKADNSVGAVASSAVLVIKARKLPPFFARKLKDVHETLGFPVAFECRINGSEPLQVSWYKDGVLLKDDANLQTSFVHNVATLQILQTDQSHIGQYNCSASNPLGTASSSAKLILSEHEVPPFFDLKPVSVDLALGESGTFKCHVTGTAPIKITWAKDNREIRPGGNYKMTLVENTATLTVLKVGKGDAGQYTCYASNIAGKDSCSAQLGVQEPPRFIKKLEPSRIVKQDEFTRYECKIGGSPEIKVLWYKDETEIQESSKFRMSFVDSVAVLEMHNLSVEDSGDYTCEAHNAAGSASSSTSLKVKEPPIFRKKPHPIETLKGADVHLECELQGTPPFHVSWYKDKRELRSGKKYKIMSENFLTSIHILNVDAADIGEYQCKATNDVGSDTCVGSIALKAPPRFVKKLSDISTVVGKEVQLQTTIEGAEPISVVWFKDKGEIVRESDNIWISYSENIATLQFSRVEPANAGKYTCQIKNDAGMQECFATLSVLEPATIVEKPESIKVTTGDTCTLECTVAGTPELSTKWFKDGKELTSDNKYKISFFNKVSGLKIINVAPSDSGVYSFEVQNPVGKDSCTASLQVSDRTVPPSFTRKLKETNGLSGSSVVMECKVYGSPPISVSWFHEGNEISSGRKYQTTLTDNTCALTVNMLEESDSGDYTCIATNMAGSDECSAPLTVREPPSFVQKPDPMDVLTGTNVTFTSIVKGTPPFSVSWFKGSSELVPGDRCNVSLEDSVAELELFDVDTSQSGEYTCIVSNEAGKASCTTHLYIKAPAKFVKRLNDYSIEKGKPLILEGTFTGTPPISVTWKKNGINVTPSQRCNITTTEKSAILEIPSSTVEDAGQYNCYIENASGKDSCSAQILILEPPYFVKQLEPVKVSVGDSASLQCQLAGTPEIGVSWYKGDTKLRPTTTYKMHFRNNVATLVFNQVDINDSGEYICKAENSVGEVSASTFLTVQEQKLPPSFSRQLRDVQETVGLPVVFDCAISGSEPISVSWYKDGKPLKDSPNVQTSFLDNTATLNIFKTDRSLAGQYSCTATNPIGSASSSARLILTEGKNPPFFDIRLAPVDAVVGESADFECHVTGTQPIKVSWAKDSREIRSGGKYQISYLENSAHLTVLKVDKGDSGQYTCYAVNEVGKDSCTAQLNIKERLIPPSFTKRLSETVEETEGNSFKLEGRVAGSQPITVAWYKNNIEIQPTSNCEITFKNNTLVLQVRKAGMNDAGLYTCKVSNDAGSALCTSSIVIKEPKKPPVFDQHLTPVTVSEGEYVQLSCHVQGSEPIRIQWLKAGREIKPSDRCSFSFASGTAVLELRDVAKADSGDYVCKASNVAGSDTTKSKVTIKDKPAVAPATKKAAVDGRLFFVSEPQSIRVVEKTTATFIAKVGGDPIPNVKWTKGKWRQLNQGGRVFIHQKGDEAKLEIRDTTKTDSGLYRCVAFNEHGEIESNVNLQVDERKKQEKIEGDLRAMLKKTPILKKGAGEEEEIDIMELLKNVDPKEYEKYARMYGITDFRGLLQAFELLKQSQEEETHRLEIEEIERSERDEKEFEELVSFIQQRLSQTEPVTLIKDIENQTVLKDNDAVFEIDIKINYPEIKLSWYKGTEKLEPSDKFEISIDGDRHTLRVKNCQLKDQGNYRLVCGPHIASAKLTVIEPAWERHLQDVTLKEGQTCTMTCQFSVPNVKSEWFRNGRILKPQGRHKTEVEHKVHKLTIADVRAEDQGQYTCKYEDLETSAELRIEAEPIQFTKRIQNIVVSEHQSATFECEVSFDDAIVTWYKGPTELTESQKYNFRNDGRCHYMTIHNVTPDDEGVYSVIARLEPRGEARSTAELYLTTKEIKLELKPPDIPDSRVPIPTMPIRAVPPEEIPPVVAPPIPLLLPTPEEKKPPPKRIEVTKKAVKKDAKKVVAKPKEMTPREEIVKKPPPPTTLIPAKAPEIIDVSSKAEEVKIMTITRKKEVQKEKEAVYEKKQAVHKEKRVFIESFEEPYDELEVEPYTEPFEQPYYEEPDEDYEEIKVEAKKEVHEEWEEDFEEGQEYYEREEGYDEGEEEWEEAYQEREVIQVQKEVYEESHERKVPAKVPEKKAPPPPKVIKKPVIEKIEKTSRRMEEEKVQVTKVPEVSKKIVPQKPSRTPVQEEVIEVKVPAVHTKKMVISEEKMFFASHTEEEVSVTVPEVQKEIVTEEKIHVAISKRVEPPPKVPELPEKPAPEEVAPVPIPKKVEPPAPKVPEVPKKPVPEEKKPVPVPKKEPAAPPKVPEVPKKPVPEEKIPVPVAKKKEAPPAKVPEVQKGVVTEEKITIVTQREESPPPAVPEIPKKKVPEERKPVPRKEEEVPPPPKVPALPKKPVPEEKVAVPVPVAKKAPPPRAEVSKKTVVEEKRFVAEEKLSFAVPQRVEVTRHEVSAEEEWSYSEEEEGVSISVYREEEREEEEEAEVTEYEVMEEPEEYVVEEKLHIISKRVEAEPAEVTERQEKKIVLKPKIPAKIEEPPPAKVPEAPKKIVPEKKVPAPVPKKEKVPPPKVPEEPKKPVPEKKVPPKVIKMEEPLPAKVTERHMQITQEEKVLVAVTKKEAPPKARVPEEPKRAVPEEKVLKLKPKREEEPPAKVTEFRKRVVKEEKVSIEAPKREPQPIKEVTIMEEKERAYTLEEEAVSVQREEEYEEYEEYDYKEFEEYEPTEEYDQYEEYEEREYERYEEHEEYITEPEKPIPVKPVPEEPVPTKPKAPPAKVLKKAVPEEKVPVPIPKKLKPPPPKVPEEPKKVFEEKIRISITKREKEQVTEPAAKVPMKPKRVVAEEKVPVPRKEVAPPVRVPEVPKELEPEEVAFEEEVVTHVEEYLVEEEEEYIHEEEEFITEEEVVPVIPVKVPEVPRKPVPEEKKPVPVPKKKEAPPAKVPEVPKKPEEKVPVLIPKKEKPPPAKVPEVPKKPVPEEKVPVPVPKKVEAPPAKVPEVPKKPVPEKKVPVPAPKKVEAPPAKVPEVPKKLIPEEKKPTPVPKKVEAPPPKVPKKREPVPVPVALPQEEEVLFEEEIVPEEEVLPEEEEVLPEEEEVLPEEEEVLPEEEEIPPEEEEVPPEEEYVPEEEEFVPEEEVLPEVKPKVPVPAPVPEIKKKVTEKKVVIPKKEEAPPAKVPEVPKKVEEKRIILPKEEEVLPVEVTEEPEEEPISEEEIPEEPPSIEEVEEVAPPRVPEVIKKAVPEAPTPVPKKVEAPPAKVSKKIPEEKVPVPVQKKEAPPAKVPEVPKKVPEKKVLVPKKEAVPPAKGRTVLEEKVSVAFRQEVVVKERLELEVVEAEVEEIPEEEEFHEVEEYFEEGEFHEVEEFIKLEQHRVEEEHRVEKVHRVIEVFEAEEVEVFEKPKAPPKGPEISEKIIPPKKPPTKVVPRKEPPAKVPEVPKKIVVEEKVRVPEEPRVPPTKVPEVLPPKEVVPEKKVPVPPAKKPEAPPPKVPEAPKEVVPEKKVPVPPPKKPEVPPTKVPEVPKAAVPEKKVPEAIPPKPESPPPEVPEAPKEVVPEKKVPAAPPKKPEVTPVKVPEAPKEVVPEKKVPVPPPKKPEVPPTKVPEVPKVAVPEKKVPEAIPPKPESPPPEVFEEPEEVALEEPPAEVVEEPEPAAPPQVTVPPKKPVPEKKAPAVVAKKPELPPVKVPEVPKEVVPEKKVPLVVPKKPEAPPAKVPEVPKEVVPEKKVAVPKKPEVPPAKVPEVPKKPVLEEKPAVPVPERAESPPPEVYEEPEEIAPEEEIAPEEEKPVPVAEEEEPEVPPPAVPEEPKKIIPEKKVPVIKKPEAPPPKEPEPEKVIEKPKLKPRPPPPPPAPPKEDVKEKIFQLKAIPKKKVPEKPQVPEKVELTPLKVPGGEKKVRKLLPERKPEPKEEVVLKSVLRKRPEEEEPKVEPKKLEKVKKPAVPEPPPPKPVEEVEVPTVTKRERKIPEPTKVPEIKPAIPLPAPEPKPKPEAEVKTIKPPPVEPEPTPIAAPVTVPVVGKKAEAKAPKEEAAKPKGPIKGVPKKTPSPIEAERRKLRPGSGGEKPPDEAPFTYQLKAVPLKFVKEIKDIILTESEFVGSSAIFECLVSPSTAITTWMKDGSNIRESPKHRFIADGKDRKLHIIDVQLSDAGEYTCVLRLGNKEKTSTAKLVVEELPVRFVKTLEEEVTVVKGQPLYLSCELNKERDVVWRKDGKIVVEKPGRIVPGVIGLMRALTINDADDTDAGTYTVTVENANNLECSSCVKVVEVIRDWLVKPIRDQHVKPKGTAIFACDIAKDTPNIKWFKGYDEIPAEPNDKTEILRDGNHLYLKIKNAMPEDIAEYAVEIEGKRYPAKLTLGEREVELLKPIEDVTIYEKESASFDAEISEADIPGQWKLKGELLRPSPTCEIKAEGGKRFLTLHKVKLDQAGEVLYQALNAITTAILTVKEIELDFAVPLKDVTVPERRQARFECVLTREANVIWSKGPDIIKSSDKFDIIADGKKHILVINDSQFDDEGVYTAEVEGKKTSARLFVTGIRLKFMSPLEDQTVKEGETATFVCELSHEKMHVVWFKNDAKLHTSRTVLISSEGKTHKLEMKEVTLDDISQIKAQVKELSSTAQLKVLEADPYFTVKLHDKTAVEKDEITLKCEVSKDVPVKWFKDGEEIVPSPKYSIKADGLRRILKIKKADLKDKGEYVCDCGTDKTKANVTVEARLIKVEKPLYGVEVFVGETAHFEIELSEPDVHGQWKLKGQPLTASPDCEIIEDGKKHILILHNCQLGMTGEVSFQAANAKSAANLKVKELPLIFITPLSDVKVFEKDEAKFECEVSREPKTFRWLKGTQEITGDDRFELIKDGTKHSMVIKSAAFEDEAKYMFEAEDKHTSGKLIIEGIRLKFLTPLKDVTAKEKESAVFTVELSHDNIRVKWFKNDQRLHTTRSVSMQDEGKTHSITFKDLSIDDTSQIRVEAMGMSSEAKLTVLEGDPYFTGKLQDYTGVEKDEVILQCEISKADAPVKWFKDGKEIKPSKNAVIKADGKKRMLILKKALKSDIGQYTCDCGTDKTSGKLDIEDREIKLVRPLHSVEVMETETARFETEISEDDIHANWKLKGEALLQTPDCEIKEEGKIHSLVLHNCRLDQTGGVDFQAANVKSSAHLRVKPRVIGLLRPLKDVTVTAGETATFDCELSYEDIPVEWYLKGKKLEPSDKVVPRSEGKVHTLTLRDVKLEDAGEVQLTAKDFKTHANLFVKEPPVEFTKPLEDQTVEEGATAVLECEVSRENAKVKWFKNGTEILKSKKYEIVADGRVRKLVIHDCTPEDIKTYTCDAKDFKTSCNLNVVPPHVEFLRPLTDLQVREKEMARFECELSRENAKVKWFKDGAEIKKGKKYDIISKGAVRILVINKCLLDDEAEYSCEVRTARTSGMLTVLEEEAVFTKNLANIEVSETDTIKLVCEVSKPGAEVIWYKGDEEIIETGRYEILTEGRKRILVIQNAHLEDAGNYNCRLPSSRTDGKVKVHELAAEFISKPQNLEILEGEKAEFVCSISKESFPVQWKRDDKTLESGDKYDVIADGKKRVLVVKDATLQDMGTYVVMVGAARAAAHLTVIEKLRIVVPLKDTRVKEQQEVVFNCEVNTEGAKAKWFRNEEAIFDSSKYIILQKDLVYTLRIRDAHLDDQANYNVSLTNHRGENVKSAANLIVEEEDLRIVEPLKDIETMEKKSVTFWCKVNRLNVTLKWTKNGEEVPFDNRVSYRVDKYKHMLTIKDCGFPDEGEYIVTAGQDKSVAELLIIEAPTEFVEHLEDQTVTEFDDAVFSCQLSREKANVKWYRNGREIKEGKKYKFEKDGSIHRLIIKDCRLDDECEYACGVEDRKSRARLFVEEIPVEIIRPPQDILEAPGADVVFLAELNKDKVEVQWLRNNMVVVQGDKHQMMSEGKIHRLQICDIKPRDQGEYRFIAKDKEARAKLELAAAPKIKTADQDLVVDVGKPLTMVVPYDAYPKAEAEWFKENEPLSTKTIDTTAEQTSFRILEAKKGDKGRYKIVLQNKHGKAEGFINLKVIDVPGPVRNLEVTETFDGEVSLAWEEPLTDGGSKIIGYVVERRDIKRKTWVLATDRAESCEFTVTGLQKGGVEYLFRVSARNRVGTGEPVETDNPVEARSKYDVPGPPLNVTITDVNRFGVSLTWEPPEYDGGAEITNYVIELRDKTSIRWDTAMTVRAEDLSATVTDVVEGQEYSFRVRAQNRIGVGKPSAATPFVKVADPIERPSPPVNLTSSDQTQSSVQLKWEPPLKDGGSPILGYIIERCEEGKDNWIRCNMKLVPELTYKVTGLEKGNKYLYRVSAENKAGVSDPSEILGPLTADDAFVEPTMDLSAFKDGLEVIVPNPITILVPSTGYPRPTATWCFGDKVLETGDRVKMKTLSAYAELVISPSERSDKGIYTLKLENRVKTISGEIDVNVIARPSAPKELKFGDITKDSVHLTWEPPDDDGGSPLTGYVVEKREVSRKTWTKVMDFVTDLEFTVPDLVQGKEYLFKVCARNKCGPGEPAYVDEPVNMSTPATVPDPPENVKWRDRTANSIFLTWDPPKNDGGSRIKGYIVERCPRGSDKWVACGEPVAETKMEVTGLEEGKWYAYRVKALNRQGASKPSRPTEEIQAVDTQEAPEIFLDVKLLAGLTVKAGTKIELPATVTGKPEPKITWTKADMILKQDKRITIENVPKKSTVTIVDSKRSDTGTYIIEAVNVCGRATAVVEVNVLDKPGPPAAFDITDVTNESCLLTWNPPRDDGGSKITNYVVERRATDSEVWHKLSSTVKDTNFKATKLIPNKEYIFRVAAENMYGVGEPVQASPITAKYQFDPPGPPTRLEPSDITKDAVTLTWCEPDDDGGSPITGYWVERLDPDTDKWVRCNKMPVKDTTYRVKGLTNKKKYRFRVLAENLAGPGKPSKSTEPILIKDPIDPPWPPGKPTVKDVGKTSVRLNWTKPEHDGGAKIESYVIEMLKTGTDEWVRVAEGVPTTQHLLPGLMEGQEYSFRVRAVNKAGESEPSEPSDPVLCREKLYPPSPPRWLEVINITKNTADLKWTVPEKDGGSPITNYIVEKRDVRRKGWQTVDTTVKDTKCTVTPLTEGSLYVFRVAAENAIGQSDYTEIEDSVLAKDTFTTPGPPYALAVVDVTKRHVDLKWEPPKNDGGRPIQRYVIEKKERLGTRWVKAGKTAGPDCNFRVTDVIEGTEVQFQVRAENEAGVGHPSEPTEILSIEDPTSPPSPPLDLHVTDAGRKHIAIAWKPPEKNGGSPIIGYHVEMCPVGTEKWMRVNSRPIKDLKFKVEEGVVPDKEYVLRVRAVNAIGVSEPSEISENVVAKDPDCKPTIDLETHDIIVIEGEKLSIPVPFRAVPVPTVSWHKDGKEVKASDRLTMKNDHISAHLEVPKSVRADAGIYTITLENKLGSATASINVKVIGLPGPCKDIKASDITKSSCKLTWEPPEFDGGTPILHYVLERREAGRRTYIPVMSGENKLSWTVKDLIPNGEYFFRVKAVNKVGGGEYIELKNPVIAQDPKQPPDPPVDVEVHNPTAEAMTITWKPPLYDGGSKIMGYIIEKIAKGEERWKRCNEHLVPILTYTAKGLEEGKEYQFRVRAENAAGISEPSRATPPTKAVDPIDAPKVILRTSLEVKRGDEIALDASISGSPYPTITWIKDENVIVPEEIKKRAAPLVRRRKGEVQEEEPFVLPLTQRLSIDNSKKGESQLRVRDSLRPDHGLYMIKVENDHGIAKAPCTVSVLDTPGPPINFVFEDIRKTSVLCKWEPPLDDGGSEIINYTLEKKDKTKPDSEWIVVTSTLRHCKYSVTKLIEGKEYLFRVRAENRFGPGPPCVSKPLVAKDPFGPPDAPDKPIVEDVTSNSMLVKWNEPKDNGSPILGYWLEKREVNSTHWSRVNKSLLNALKANVDGLLEGLTYVFRVCAENAAGPGKFSPPSDPKTAHDPISPPGPPIPRVTDTSSTTIELEWEPPAFNGGGEIVGYFVDKQLVGTNEWSRCTEKMIKVRQYTVKEIREGADYKLRVSAVNAAGEGPPGETQPVTVAEPQEPPAVELDVSVKGGIQIMAGKTLRIPAVVTGRPVPTKVWTKEEGELDKDRVVIDNVGTKSELIIKDALRKDHGRYVITATNSCGSKFAAARVEVFDVPGPVLDLKPVVTNRKMCLLNWSDPEDDGGSEITGFIIERKDAKMHTWRQPIETERSKCDITGLLEGQEYKFRVIAKNKFGCGPPVEIGPILAVDPLGPPTSPERLTYTERTKSTITLDWKEPRSNGGSPIQGYIIEKRRHDKPDFERVNKRLCPTTSFLVENLDEHQMYEFRVKAVNEIGESEPSLPLNVVIQDDEVPPTIKLRLSVRGDTIKVKAGEPVHIPADVTGLPMPKIEWSKNETVIEKPTDALQITKEEVSRSEAKTELSIPKAVREDKGTYTVTASNRLGSVFRNVHVEVYDRPSPPRNLAVTDIKAESCYLTWDAPLDNGGSEITHYVIDKRDASRKKAEWEEVTNTAVEKRYGIWKLIPNGQYEFRVRAVNKYGISDECKSDKVVIQDPYRLPGPPGKPKVLARTKGSMLVSWTPPLDNGGSPITGYWLEKREEGSPYWSRVSRAPITKVGLKGVEFNVPRLLEGVKYQFRAMAINAAGIGPPSEPSDPEVAGDPIFPPGPPSCPEVKDKTKSSISLGWKPPAKDGGSPIKGYIVEMQEEGTTDWKRVNEPDKLITTCECVVPNLKELRKYRFRVKAVNEAGESEPSDTTGEIPATDIQEEPEVFIDIGAQDCLVCKAGSQIRIPAVIKGRPTPKSSWEFDGKAKKAMKDGVHDIPEDAQLETAENSSVIIIPECKRSHTGKYSITAKNKAGQKTANCRVKVMDVPGPPKDLKVSDITRGSCRLSWKMPDDDGGDRIKGYVIEKRTIDGKAWTKVNPDCGSTTFVVPDLLSEQQYFFRVRAENRFGIGPPVETIQRTTARDPIYPPDPPIKLKIGLITKNTVHLSWKPPKNDGGSPVTHYIVECLAWDPTGTKKEAWRQCNKRDVEELQFTVEDLVEGGEYEFRVKAVNAAGVSKPSATVGPVTVKDQTCPPSIDLKEFMEVEEGTNVNIVAKIKGVPFPTLTWFKAPPKKPDNKEPVLYDTHVNKLVVDDTCTLVIPQSRRSDTGLYTITAVNNLGTASKEMRLNVLGRPGPPVGPIKFESVSADQMTLSWFPPKDDGGSKITNYVIEKREANRKTWVHVSSEPKECTYTIPKLLEGHEYVFRIMAQNKYGIGEPLDSEPETARNLFSVPGAPDKPTVSSVTRNSMTVNWEEPEYDGGSPVTGYWLEMKDTTSKRWKRVNRDPIKAMTLGVSYKVTGLIEGSDYQFRVYAINAAGVGPASLPSDPATARDPIAPPGPPFPKVTDWTKSSADLEWSPPLKDGGSKVTGYIVEYKEEGKEEWEKGKDKEVRGTKLVVTGLKEGAFYKFRVRAVNIAGIGEPGEVTDVIEMKDRLVSPDLQLDASVRDRIVVHAGGVIRIIAYVSGKPPPTVTWNMNERTLPQEATIETTAISSSMVIKNCQRSHQGVYSLLAKNEAGERKKTIIVDVLDVPGPVGTPFLAHNLTNESCKLTWFSPEDDGGSPITNYVIEKRESDRRAWTPVTYTVTRQNATVQGLIQGKAYFFRIAAENSIGMGPFVETSEALVIREPITVPERPEDLEVKEVTKNTVTLTWNPPKYDGGSEIINYVLESRLIGTEKFHKVTNDNLLSRKYTVKGLKEGDTYEYRVSAVNIVGQGKPSFCTKPITCKDELAPPTLHLDFRDKLTIRVGEAFALTGRYSGKPKPKVSWFKDEADVLEDDRTHIKTTPATLALEKIKAKRSDSGKYCVVVENSTGSRKGFCQVNVVDRPGPPVGPVSFDEVTKDYMVISWKPPLDDGGSKITNYIIEKKEVGKDVWMPVTSASAKTTCKVSKLLEGKDYIFRIHAENLYGISDPLVSDSMKAKDRFRVPDAPDQPIVTEVTKDSALVTWNKPHDGGKPITNYILEKRETMSKRWARVTKDPIHPYTKFRVPDLLEGCQYEFRVSAENEIGIGDPSPPSKPVFAKDPIAKPSPPVNPEAIDTTCNSVDLTWQPPRHDGGSKILGYIVEYQKVGDEEWRRANHTPESCPETKYKVTGLRDGQTYKFRVLAVNAAGESDPAHVPEPVLVKDRLEPPELILDANMAREQHIKVGDTLRLSAIIKGVPFPKVTWKKEDRDAPTKARIDVTPVGSKLEIRNAAHEDGGIYSLTVENPAGSKTVSVKVLVLDKPGPPRDLEVSEIRKDSCYLTWKEPLDDGGSVITNYVVERRDVASAQWSPLSATSKKKSHFAKHLNEGNQYLFRVAAENQYGRGPFVETPKPIKALDPLHPPGPPKDLHHVDVDKTEVSLVWNKPDRDGGSPITGYLVEYQEEGTQDWIKFKTVTNLECVVTGLQQGKTYRFRVKAENIVGLGLPDTTIPIECQEKLVPPSVELDVKLIEGLVVKAGTTVRFPAIIRGVPVPTAKWTTDGSEIKTDEHYTVETDNFSSVLTIKNCLRRDTGEYQITVSNAAGSKTVAVHLTVLDVPGPPTGPINILDVTPEHMTISWQPPKDDGGSPVINYIVEKQDTRKDTWGVVSSGSSKTKLKIPHLQKGCEYVFRVRAENKIGVGPPLDSTPTVAKHKFSPPSPPGKPVVTDITENAATVSWTLPKSDGGSPITGYYMERREVTGKWVRVNKTPIADLKFRVTGLYEGNTYEFRVFAENLAGLSKPSPSSDPIKACRPIKPPGPPINPKLKDKSRETADLVWTKPLSDGGSPILGYVVECQKPGTAQWNRINKDELIRQCAFRVPGLIEGNEYRFRIKAANIVGEGEPRELAESVIAKDILHPPEVELDVTCRDVITVRVGQTIRILARVKGRPEPDITWTKEGKVLVREKRVDLIQDLPRVELQIKEAVRADHGKYIISAKNSSGHAQGSAIVNVLDRPGPCQNLKVTNVTKENCTISWENPLDNGGSEITNFIVEYRKPNQKGWSIVASDVTKRLIKANLLANNEYYFRVCAENKVGVGPTIETKTPILAINPIDRPGEPENLHIADKGKTFVYLKWRRPDYDGGSPNLSYHVERRLKGSDDWERVHKGSIKETHYMVDRCVENQIYEFRVQTKNEGGESDWVKTEEVVVKEDLQKPVLDLKLSGVLTVKAGDTIRLEAGVRGKPFPEVAWTKDKDATDLTRSPRVKIDTRADSSKFSLTKAKRSDGGKYVVTATNTAGSFVAYATVNVLDKPGPVRNLKIVDVSSDRCTVCWDPPEDDGGCEIQNYILEKCETKRMVWSTYSATVLTPGTTVTRLIEGNEYIFRVRAENKIGTGPPTESKPVIAKTKYDKPGRPDPPEVTKVSKEEMTVVWNPPEYDGGKSITGYFLEKKEKHSTRWVPVNKSAIPERRMKVQNLLPDHEYQFRVKAENEIGIGEPSLPSRPVVAKDPIEPPGPPTNFRVVDTTKHSITLGWGKPVYDGGAPIIGYVVEMRPKIADASPDEGWKRCNAAAQLVRKEFTVTSLDENQEYEFRVCAQNQVGIGRPAELKEAIKPKEILEPPEIDLDASMRKLVIVRAGCPIRLFAIVRGRPAPKVTWRKVGIDNVVRKGQVDLVDTMAFLVIPNSTRDDSGKYSLTLVNPAGEKAVFVNVRVLDTPGPVSDLKVSDVTKTSCHVSWAPPENDGGSQVTHYIVEKREADRKTWSTVTPEVKKTSFHVTNLVPGNEYYFRVTAVNEYGPGVPTDVPKPVLASDPLSEPDPPRKLEVTEMTKNSATLAWLPPLRDGGAKIDGYITSYREEEQPADRWTEYSVVKDLSLVVTGLKEGKKYKFRVAARNAVGVSLPREAEGVYEAKEQLLPPKILMPEQITIKAGKKLRIEAHVYGKPHPTCKWKKGEDEVVTSSHLAVHKADSSSILIIKDVTRKDSGYYSLTAENSSGTDTQKIKVVVMDAPGPPQPPFDISDIDADACSLSWHIPLEDGGSNITNYIVEKCDVSRGDWVTALASVTKTSCRVGKLIPGQEYIFRVRAENRFGISEPLTSPKMVAQFPFGVPSEPKNARVTKVNKDCIFVAWDRPDSDGGSPIIGYLIERKERNSLLWVKANDTLVRSTEYPCAGLVEGLEYSFRIYALNKAGSSPPSKPTEYVTARMPVDPPGKPEVIDVTKSTVSLIWARPKHDGGSKIIGYFVEACKLPGDKWVRCNTAPHQIPQEEYTATGLEEKAQYQFRAIARTAVNISPPSEPSDPVTILAENVPPRIDLSVAMKSLLTVKAGTNVCLDATVFGKPMPTVSWKKDGTLLKPAEGIKMAMQRNLCTLELFSVNRKDSGDYTITAENSSGSKSATIKLKVLDKPGPPASVKINKMYSDRAMLSWEPPLEDGGSEITNYIVDKRETSRPNWAQVSATVPITSCSVEKLIEGHEYQFRICAENKYGVGDPVFTEPAIAKNPYDPPGRCDPPVISNITKDHMTVSWKPPADDGGSPITGYLLEKRETQAVNWTKVNRKPIIERTLKATGLQEGTEYEFRVTAINKAGPGKPSDASKAAYARDPQYPPGPPAFPKVYDTTRSSVSLSWGKPAYDGGSPIIGYLVEVKRADSDNWVRCNLPQNLQKTRFEVTGLMEDTQYQFRVYAVNKIGYSDPSDVPDKHYPKDILIPPEGELDADLRKTLILRAGVTMRLYVPVKGRPPPKITWSKPNVNLRDRIGLDIKSTDFDTFLRCENVNKYDAGKYILTLENSCGKKEYTIVVKVLDTPGPPVNVTVKEISKDSAYVTWEPPIIDGGSPIINYVVQKRDAERKSWSTVTTECSKTSFRVANLEEGKSYFFRVFAENEYGIGDPGETRDAVKASQTPGPVVDLKVRSVSKSSCSIGWKKPHSDGGSRIIGYVVDFLTEENKWQRVMKSLSLQYSAKDLTEGKEYTFRVSAENENGEGTPSEITVVARDDVVAPDLDLKGLPDLCYLAKENSNFRLKIPIKGKPAPSVSWKKGEDPLATDTRVSVESSAVNTTLIVYDCQKSDAGKYTITLKNVAGTKEGTISIKVVGKPGIPTGPIKFDEVTAEAMTLKWAPPKDDGGSEITNYILEKRDSVNNKWVTCASAVQKTTFRVTRLHEGMEYTFRVSAENKYGVGEGLKSEPIVARHPFDVPDAPPPPNIVDVRHDSVSLTWTDPKKTGGSPITGYHLEFKERNSLLWKRANKTPIRMRDFKVTGLTEGLEYEFRVMAINLAGVGKPSLPSEPVVALDPIDPPGKPEVINITRNSVTLIWTEPKYDGGHKLTGYIVEKRDLPSKSWMKANHVNVPECAFTVTDLVEGGKYEFRIRAKNTAGAISAPSESTETIICKDEYEAPTIVLDPTIKDGLTIKAGDTIVLNAISILGKPLPKSSWSKAGKDIRPSDITQITSTPTSSMLTIKYATRKDAGEYTITATNPFGTKVEHVKVTVLDVPGPPGPVEISNVSAEKATLTWTPPLEDGGSPIKSYILEKRETSRLLWTVVSEDIQSCRHVATKLIQGNEYIFRVSAVNHYGKGEPVQSEPVKMVDRFGPPGPPEKPEVSNVTKNTATVSWKRPVDDGGSEITGYHVERREKKSLRWVRAIKTPVSDLRCKVTGLQEGSTYEFRVSAENRAGIGPPSEASDSVLMKDAAYPPGPPSNPHVTDTTKKSASLAWGKPHYDGGLEITGYVVEHQKVGDEAWIKDTTGTALRITQFVVPDLQTKEKYNFRISAINDAGVGEPAVIPDVEIVEREMAPDFELDAELRRTLVVRAGLSIRIFVPIKGRPAPEVTWTKDNINLKNRANIENTESFTLLIIPECNRYDTGKFVMTIENPAGKKSGFVNVRVLDTPGPVLNLRPTDITKDSVTLHWDLPLIDGGSRITNYIVEKREATRKSYSTATTKCHKCTYKVTGLSEGCEYFFRVMAENEYGIGEPTETTEPVKASEAPSPPDSLNIMDITKSTVSLAWPKPKHDGGSKITGYVIEAQRKGSDQWTHITTVKGLECVVRNLTEGEEYTFQVMAVNSAGRSAPRESRPVIVKEQTMLPELDLRGIYQKLVIAKAGDNIKVEIPVLGRPKPTVTWKKGDQILKQTQRVNFETTATSTILNINECVRSDSGPYPLTARNIVGEVGDVITIQVHDIPGPPTGPIKFDEVSSDFVTFSWDPPENDGGVPISNYVVEMRQTDSTTWVELATTVIRTTYKATRLTTGLEYQFRVKAQNRYGVGPGITSACIVANYPFKVPGPPGTPQVTAVTKDSMTISWHEPLSDGGSPILGYHVERKERNGILWQTVSKALVPGNIFKSSGLTDGIAYEFRVIAENMAGKSKPSKPSEPMLALDPIDPPGKPVPLNITRHTVTLKWAKPEYTGGFKITSYIVEKRDLPNGRWLKANFSNILENEFTVSGLTEDAAYEFRVIAKNAAGAISPPSEPSDAITCRDDVEAPKIKVDVKFKDTVILKAGEAFRLEADVSGRPPPTMEWSKDGKELEGTAKLEIKIADFSTNLVNKDSTRRDSGAYTLTATNPGGFAKHIFNVKVLDRPGPPEGPLAVTEVTSEKCVLSWFPPLDDGGAKIDHYIVQKRETSRLAWTNVASEVQVTKLKVTKLLKGNEYIFRVMAVNKYGVGEPLESEPVLAVNPYGPPDPPKNPEVTTITKDSMVVCWGHPDSDGGSEIINYIVERRDKAGQRWIKCNKKTLTDLRYKVSGLTEGHEYEFRIMAENAAGISAPSPTSPFYKACDTVFKPGPPGNPRVLDTSRSSISIAWNKPIYDGGSEITGYMVEIALPEEDEWQIVTPPAGLKATSYTITGLTENQEYKIRIYAMNSEGLGEPALVPGTPKAEDRMLPPEIELDADLRKVVTIRACCTLRLFVPIKGRPAPEVKWARDHGESLDKASIESTSSYTLLIVGNVNRFDSGKYILTVENSSGSKSAFVNVRVLDTPGPPQDLKVKEVTKTSVTLTWDPPLLDGGSKIKNYIVEKRESTRKAYSTVATNCHKTSWKVDQLQEGCSYYFRVLAENEYGIGLPAETAESVKASERPLPPGKITLMDVTRNSVSLSWEKPEHDGGSRILGYIVEMQTKGSDKWATCATVKVTEATITGLIQGEEYSFRVSAQNEKGISDPRQLSVPVIAKDLVIPPAFKLLFNTFTVLAGEDLKVDVPFIGRPTPAVTWHKDNVPLKQTTRVNAESTENNSLLTIKDACREDVGHYVVKLTNSAGEAIETLNVIVLDKPGPPTGPVKMDEVTADSITLSWGPPKYDGGSSINNYIVEKRDTSTTTWQIVSATVARTTIKACRLKTGCEYQFRIAAENRYGKSTYLNSEPTVAQYPFKVPGPPGTPVVTLSSRDSMEVQWNEPISDGGSRVIGYHLERKERNSILWVKLNKTPIPQTKFKTTGLEEGVEYEFRVSAENIVGIGKPSKVSECYVARDPCDPPGRPEAIIVTRNSVTLQWKKPTYDGGSKITGYIVEKKELPEGRWMKASFTNIIDTHFEVTGLVEDHRYEFRVIARNAAGVFSEPSESTGAITARDEVDPPRISMDPKYKDTIVVHAGESFKVDADIYGKPIPTIQWIKGDQELSNTARLEIKSTDFATSLSVKDAVRVDSGNYILKAKNVAGERSVTVNVKVLDRPGPPEGPVVISGVTAEKCTLAWKPPLQDGGSDIINYIVERRETSRLVWTVVDANVQTLSCKVTKLLEGNEYTFRIMAVNKYGVGEPLESEPVVAKNPFVVPDAPKAPEVTTVTKDSMIVVWERPASDGGSEILGYVLEKRDKEGIRWTRCHKRLIGELRLRVTGLIENHDYEFRVSAENAAGLSEPSPPSAYQKACDPIYKPGPPNNPKVIDITRSSVFLSWSKPIYDGGCEIQGYIVEKCDVSVGEWTMCTPPTGINKTNIEVEKLLEKHEYNFRICAINKAGVGEHADVPGPIIVEEKLEAPDIDLDLELRKIINIRAGGSLRLFVPIKGRPTPEVKWGKVDGEIRDAAIIDVTSSFTSLVLDNVNRYDSGKYTLTLENSSGTKSAFVTVRVLDTPSPPVNLKVTEITKDSVSITWEPPLLDGGSKIKNYIVEKREATRKSYAAVVTNCHKNSWKIDQLQEGCSYYFRVTAENEYGIGLPAQTADPIKVAEVPQPPGKITVDDVTRNSVSLSWTKPEHDGGSKIIQYIVEMQAKHSEKWSECARVKSLQAVITNLTQGEEYLFRVVAVNEKGRSDPRSLAVPIVAKDLVIEPDVKPAFSSYSVQVGQDLKIEVPISGRPKPTITWTKDGLPLKQTTRINVTDSLDLTTLSIKETHKDDGGQYGITVANVVGQKTASIEIVTLDKPDPPKGPVKFDDVSAESITLSWNPPLYTGGCQITNYIVQKRDTTTTVWDVVSATVARTTLKVTKLKTGTEYQFRIFAENRYGQSFALESDPIVAQYPYKEPGPPGTPFATAISKDSMVIQWHEPVNNGGSPVIGYHLERKERNSILWTKVNKTIIHDTQFKAQNLEEGIEYEFRVYAENIVGVGKASKNSECYVARDPCDPPGTPEPIMVKRNEITLQWTKPVYDGGSMITGYIVEKRDLPDGRWMKASFTNVIETQFTVSGLTEDQRYEFRVIAKNAAGAISKPSDSTGPITAKDEVELPRISMDPKFRDTIVVNAGETFRLEADVHGKPLPTIEWLRGDKEIEESARCEIKNTDFKALLIVKDAIRIDGGQYILRASNVAGSKSFPVNVKVLDRPGPPEGPVQVTGVTSEKCSLTWSPPLQDGGSDISHYVVEKRETSRLAWTVVASEVVTNSLKVTKLLEGNEYVFRIMAVNKYGVGEPLESAPVLMKNPFVLPGPPKSLEVTNIAKDSMTVCWNRPDSDGGSEIIGYIVEKRDRSGIRWIKCNKRRITDLRLRVTGLTEDHEYEFRVSAENAAGVGEPSPATVYYKACDPVFKPGPPTNAHIVDTTKNSITLAWGKPIYDGGSEILGYVVEICKADEEEWQIVTPQTGLRVTRFEISKLTEHQEYKIRVCALNKVGLGEATSVPGTVKPEDKLEAPELDLDSELRKGIVVRAGGSARIHIPFKGRPTPEITWSREEGEFTDKVQIEKGVNYTQLSIDNCDRNDAGKYILKLENSSGSKSAFVTVKVLDTPGPPQNLAVKEVRKDSAFLVWEPPIIDGGAKVKNYVIDKRESTRKAYANVSSKCSKTSFKVENLTEGAIYYFRVMAENEFGVGVPVETVDAVKAAEPPSPPGKVTLTDVSQTSASLMWEKPEHDGGSRVLGYVVEMQPKGTEKWSIVAESKVCNAVVTGLSSGQEYQFRVKAYNEKGKSDPRVLGVPVIAKDLTIQPSLKLPFNTYSIQAGEDLKIEIPVIGRPRPNISWVKDGEPLKQTTRVNVEETATSTVLHIKEGNKDDFGKYTVTATNSAGTATENLSVIVLEKPGPPVGPVRFDEVSADFVVISWEPPAYTGGCQISNYIVEKRDTTTTTWHMVSATVARTTIKITKLKTGTEYQFRIFAENRYGKSAPLDSKAVIVQYPFKEPGPPGTPFVTSISKDQMLVQWHEPVNDGGTKIIGYHLEQKEKNSILWVKLNKTPIQDTKFKTTGLDEGLEYEFKVSAENIVGIGKPSKVSECFVARDPCDPPGRPEAIVITRNNVTLKWKKPAYDGGSKITGYIVEKKDLPDGRWMKASFTNVLETEFTVSGLVEDQRYEFRVIARNAAGNFSEPSDSSGAITARDEIDAPNASLDPKYKDVIVVHAGETFVLEADIRGKPIPDVVWSKDGKELEETAARMEIKSTIQKTTLVVKDCIRTDGGQYILKLSNVGGTKSIPITVKVLDRPGPPEGPLKVTGVTAEKCYLAWNPPLQDGGANISHYIIEKRETSRLSWTQVSTEVQALNYKVTKLLPGNEYIFRVMAVNKYGIGEPLESGPVTACNPYKPPGPPSTPEVSAITKDSMVVTWARPVDDGGTEIEGYILEKRDKEGVRWTKCNKKTLTDLRLRVTGLTEGHSYEFRVAAENAAGVGEPSEPSVFYRACDALYPPGPPSNPKVTDTSRSSVSLAWSKPIYDGGAPVKGYVVEVKEAAADEWTTCTPPTGLQGKQFTVTKLKENTEYNFRICAINSEGVGEPATLPGSVVAQERIEPPEIELDADLRKVVVLRASATLRLFVTIKGRPEPEVKWEKAEGILTDRAQIEVTSSFTMLVIDNVTRFDSGRYNLTLENNSGSKTAFVNVRVLDSPSAPVNLTIREVKKDSVTLSWEPPLIDGGAKITNYIVEKRETTRKAYATITNNCTKTTFRIENLQEGCSYYFRVLASNEYGIGLPAETTEPVKVSEPPLPPGRVTLVDVTRNTATIKWEKPESDGGSKITGYVVEMQTKGSEKWSTCTQVKTLEATISGLTAGEEYVFRVAAVNEKGRSDPRQLGVPVIARDIEIKPSVELPFHTFNVKAREQLKIDVPFKGRPQATVNWRKDGQTLKETTRVNVSSSKTVTSLSIKEASKEDVGTYELCVSNSAGSITVPITIIVLDRPGPPGPIRIDEVSCDSITISWNPPEYDGGCQISNYIVEKKETTSTTWHIVSQAVARTSIKIVRLTTGSEYQFRVCAENRYGKSSYSESSAVVAEYPFSPPGPPGTPKVVHATKSTMLVTWQVPVNDGGSRVIGYHLEYKERSSILWSKANKILIADTQMKVSGLDEGLMYEYRVYAENIAGIGKCSKSCEPVPARDPCDPPGQPEVTNITRKSVSLKWSKPHYDGGAKITGYIVERRELPDGRWLKCNYTNIQETYFEVTELTEDQRYEFRVFARNAADSVSEPSESTGPIIVKDDVEPPRVMMDVKFRDVIVVKAGEVLKINADIAGRPLPVISWAKDGIEIEERARTEIISTDNHTLLTVKDCIRRDTGQYVLTLKNVAGTRSVAVNCKVLDKPGPPAGPLEINGLTAEKCSLSWGRPQEDGGADIDYYIVEKRETSHLAWTICEGELQMTSCKVTKLLKGNEYIFRVTGVNKYGVGEPLESVAIKALDPFTVPSPPTSLEITSVTKESMTLCWSRPESDGGSEISGYIIERREKNSLRWVRVNKKPVYDLRVKSTGLREGCEYEYRVYAENAAGLSLPSETSPLIRAEDPVFLPSPPSKPKIVDSGKTTITIAWVKPLFDGGAPITGYTVEYKKSDDTDWKTSIQSLRGTEYTISGLTTGAEYVFRVKSVNKVGASDPSDSSDPQIAKEREEEPLFDIDSEMRKTLIVKAGASFTMTVPFRGRPVPNVLWSKPDTDLRTRAYVDTTDSRTSLTIENANRNDSGKYTLTIQNVLSAASLTLVVKVLDTPGPPTNITVQDVTKESAVLSWDVPENDGGAPVKNYHIEKREASKKAWVSVTNNCNRLSYKVTNLQEGAIYYFRVSGENEFGVGIPAETKEGVKITEKPSPPEKLGVTSISKDSVSLTWLKPEHDGGSRIVHYVVEALEKGQKNWVKCAVAKSTHHVVSGLRENSEYFFRVFAENQAGLSDPRELLLPVLIKEQLEPPEIDMKNFPSHTVYVRAGSNLKVDIPISGKPLPKVTLSRDGVPLKATMRFNTEITAENLTINLKESVTADAGRYEITAANSSGTTKAFINIVVLDRPGPPTGPVVISDITEESVTLKWEPPKYDGGSQVTNYILLKRETSTAVWTEVSATVARTMMKVMKLTTGEEYQFRIKAENRFGISDHIDSACVTVKLPYTTPGPPSTPWVTNVTRESITVGWHEPVSNGGSAVVGYHLEMKDRNSILWQKANKLVIRTTHFKVTTISAGLIYEFRVYAENAAGVGKPSHPSEPVLAIDACEPPRNVRITDISKNSVSLSWQQPAFDGGSKITGYIVERRDLPDGRWTKASFTNVTETQFIISGLTQNSQYEFRVFARNAVGSISNPSEVVGPITCIDSYGGPVIDLPLEYTEVVKYRAGTSVKLRAGISGKPAPTIEWYKDDKELQTNALVCVENTTDLASILIKDADRLNSGCYELKLRNAMGSASATIRVQILDKPGPPGGPIEFKTVTAEKITLLWRPPADDGGAKITHYIVEKRETSRVVWSMVSEHLEECIITTTKIIKGNEYIFRVRAVNKYGIGEPLESDSVVAKNAFVTPGPPGIPEVTKITKNSMTVVWSRPIADGGSDISGYFLEKRDKKSLGWFKVLKETIRDTRQKVTGLTENSDYQYRVCAVNAAGQGPFSEPSEFYKAADPIDPPGPPAKIRIADSTKSSITLGWSKPVYDGGSAVTGYVVEIRQGEEEEWTTVSTKGEVRTTEYVVSNLKPGVNYYFRVSAVNCAGQGEPIEMNEPVQAKDILEAPEIDLDVALRTSVIAKAGEDVQVLIPFKGRPPPTVTWRKDEKNLGSDARYSIENTDSSSLLTIPQVTRNDTGKYILTIENGVGEPKSSTVSVKVLDTPAACQKLQVKHVSRGTVTLLWDPPLIDGGSPIINYVIEKRDATKRTWSVVSHKCSSTSFKLIDLSEKTPFFFRVLAENEIGIGEPCETTEPVKAAEVPAPIRDLSMKDSTKTSVILSWTKPDFDGGSVITEYVVERKGKGEQTWSHAGISKTCEIEVSQLKEQSVLEFRVFAKNEKGLSDPVTIGPITVKELIITPEVDLSDIPGAQVTVRIGHNVHLELPYKGKPKPSISWLKDGLPLKESEFVRFSKTENKITLSIKNAKKEHGGKYTVILDNAVCRIAVPITVITLGPPSKPKGPIRFDEIKADSVILSWDVPEDNGGGEITCYSIEKRETSQTNWKMVCSSVARTTFKVPNLVKDAEYQFRVRAENRYGVSQPLVSSIIVAKHQFRIPGPPGKPVIYNVTSDGMSLTWDAPVYDGGSEVTGFHVEKKERNSILWQKVNTSPISGREYRATGLVEGLDYQFRVYAENSAGLSSPSDPSKFTLAVSPVDPPGTPDYIDVTRETITLKWNPPLRDGGSKIVGYSIEKRQGNERWVRCNFTDVSECQYTVTGLSPGDRYEFRIIARNAVGTISPPSQSSGIIMTRDENVPPIVEFGPEYFDGLIIKSGESLRIKALVQGRPVPRVTWFKDGVEIEKRMNMEITDVLGSTSLFVRDATRDHRGVYTVEAKNASGSAKAEIKVKVQDTPGKVVGPIRFTNITGEKMTLWWDAPLNDGCAPITHYIIEKRETSRLAWALIEDKCEAQSYTAIKLINGNEYQFRVSAVNKFGVGRPLDSDPVVAQIQYTVPDAPGIPEPSNITGNSITLTWARPESDGGSEIQQYILERREKKSTRWVKVISKRPISETRFKVTGLTEGNEYEFHVMAENAAGVGPASGISRLIKCREPVNPPGPPTVVKVTDTSKTTVSLEWSKPVFDGGMEIIGYIIEMCKADLGDWHKVNAEACVKTRYTVTDLQAGEEYKFRVSAINGAGKGDSCEVTGTIKAVDRLTAPELDIDANFKQTHVVRAGASIRLFIAYQGRPTPTAVWSKPDSNLSLRADIHTTDSFSTLTVENCNRNDAGKYTLTVENNSGSKSITFTVKVLDTPGPPGPITFKDVTRGSATLMWDAPLLDGGARIHHYVVEKREASRRSWQVISEKCTRQIFKVNDLAEGVPYYFRVSAVNEYGVGEPYEMPEPIVATEQPAPPRRLDVVDTSKSSAVLAWLKPDHDGGSRITGYLLEMRQKGSDFWVEAGHTKQLTFTVERLVEKTEYEFRVKAKNDAGYSEPREAFSSVIIKEPQIEPTADLTGITNQLITCKAGSPFTIDVPISGRPAPKVTWKLEEMRLKETDRVSITTTKDRTTLTVKDSMRGDSGRYFLTLENTAGVKTFSVTVVVIGRPGPVTGPIEVSSVSAESCVLSWGEPKDGGGTEITNYIVEKRESGTTAWQLVNSSVKRTQIKVTHLTKYMEYSFRVSSENRFGVSKPLESAPIIAEHPFVPPSAPTRPEVYHVSANAMSIRWEEPYHDGGSKIIGYWVEKKERNTILWVKENKVPCLECNYKVTGLVEGLEYQFRTYALNAAGVSKASEASRPIMAQNPVDAPGRPEVTDVTRSTVSLIWSAPAYDGGSKVVGYIIERKPVSEVGDGRWLKCNYTIVSDNFFTVTALSEGDTYEFRVLAKNAAGVISKGSESTGPVTCRDEYAPPKAELDARLHGDLVTIRAGSDLVLDAAVGGKPEPKIIWTKGDKELDLCEKVSLQYTGKRATAVIKFCDRSDSGKYTLTVKNASGTKAVSVMVKVLDSPGPCGKLTVSRVTQEKCTLAWSLPQEDGGAEITHYIVERRETSRLNWVIVEGECPTLSYVVTRLIKNNEYIFRVRAVNKYGPGVPVESEPIVARNSFTIPSPPGIPEEVGTGKEHIIIQWTKPESDGGNEISNYLVDKREKKSLRWTRVNKDYVVYDTRLKVTSLMEGCDYQFRVTAVNAAGNSEPSEASNFISCREPSYTPGPPSAPRVVDTTKHSISLAWTKPMYDGGTDIVGYVLEMQEKDTDQWYRVHTNATIRNTEFTVPDLKMGQKYSFRVAAVNVKGMSEYSESIAEIEPVERIEIPDLELADDLKKTVTIRAGASLRLMVSVSGRPPPVITWSKQGIDLASRAIIDTTESYSLLIVDKVNRYDAGKYTIEAENQSGKKSATVLVKVYDTPGPCPSVKVKEVSRDSVTITWEIPTIDGGAPVNNYIVEKREAAMRAFKTVTTKCSKTLYRISGLVEGTMYYFRVLPENIYGIGEPCETSDAVLVSEVPLVPAKLEVVDVTKSTVTLAWEKPLYDGGSRLTGYVLEACKAGTERWMKVVTLKPTVLEHTVTSLNEGEQYLFRIRAQNEKGVSEPRETVTAVTVQDLRVLPTIDLSTMPQKTIHVPAGRPVELVIPIAGRPPPAASWFFAGSKLRESERVTVETHTKVAKLTIRETTIRDTGEYTLELKNVTGTTSETIKVIILDKPGPPTGPIKIDEIDATSITISWEPPELDGGAPLSGYVVEQRDAHRPGWLPVSESVTRSTFKFTRLTEGNEYVFRVAATNRFGIGSYLQSEVIECRSSIRIPGPPETLQIFDVSRDGMTLTWYPPEDDGGSQVTGYIVERKEVRADRWVRVNKVPVTMTRYRSTGLTEGLEYEHRVTAINARGSGKPSRPSKPIVAMDPIAPPGKPQNPRVTDTTRTSVSLAWSVPEDEGGSKVTGYLIEMQKVDQHEWTKCNTTPTKIREYTLTHLPQGAEYRFRVLACNAGGPGEPAEVPGTVKVTEMLEYPDYELDERYQEGIFVRQGGVIRLTIPIKGKPFPICKWTKEGQDISKRAMIATSETHTELVIKEADRGDSGTYDLVLENKCGKKAVYIKVRVIGSPNSPEGPLEYDDIQVRSVRVSWRPPADDGGADILGYILERREVPKAAWYTIDSRVRGTSLVVKGLKENVEYHFRVSAENQFGISKPLKSEEPVTPKTPLNPPEPPSNPPEVLDVTKSSVSLSWSRPKDDGGSRVTGYYIERKETSTDKWVRHNKTQITTTMYTVTGLVPDAEYQFRIIAQNDVGLSETSPASEPVVCKDPFDKPSQPGELEILSISKDSVTLQWEKPECDGGKEILGYWVEYRQSGDSAWKKSNKERIKDKQFTIGGLLEATEYEFRVFAENETGLSRPRRTAMSIKTKLTSGEAPGIRKEMKDVTTKLGEAAQLSCQIVGRPLPDIKWYRFGKELIQSRKYKMSSDGRTHTLTVMTEEQEDEGVYTCIATNEVGEVETSSKLLLQATPQFHPGYPLKEKYYGAVGSTLRLHVMYIGRPVPAMTWFHGQKLLQNSENITIENTEHYTHLVMKNVQRKTHAGKYKVQLSNVFGTVDAILDVEIQDKPDKPTGPIVIEALLKNSAVISWKPPADDGGSWITNYVVEKCEAKEGAEWQLVSSAISVTTCRIVNLTENAGYYFRVSAQNTFGISDPLEVSSVVIIKSPFEKPGAPGKPTITAVTKDSCVVAWKPPASDGGAKIRNYYLEKREKKQNKWISVTTEEIRETVFSVKNLIEGLEYEFRVKCENLGGESEWSEISEPITPKSDVPIQAPHFKEELRNLNVRYQSNATLVCKVTGHPKPIVKWYRQGKEIIADGLKYRIQEFKGGYHQLIIASVTDDDATVYQVRATNQGGSVSGTASLEVEVPAKIHLPKTLEGMGAVHALRGEVVSIKIPFSGKPDPVITWQKGQDLIDNNGHYQVIVTRSFTSLVFPNGVERKDAGFYVVCAKNRFGIDQKTVELDVADVPDPPRGVKVSDVSRDSVNLTWTEPASDGGSKITNYIVEKCATTAERWLRVGQARETRYTVINLFGKTSYQFRVIAENKFGLSKPSEPSEPTITKEDKTRAMNYDEEVDETREVSMTKASHSSTKELYEKYMIAEDLGRGEFGIVHRCVETSSKKTYMAKFVKVKGTDQVLVKKEISILNIARHRNILHLHESFESMEELVMIFEFISGLDIFERINTSAFELNEREIVSYVHQVCEALQFLHSHNIGHFDIRPENIIYQTRRSSTIKIIEFGQARQLKPGDNFRLLFTAPEYYAPEVHQHDVVSTATDMWSLGTLVYVLLSGINPFLAETNQQIIENIMNAEYTFDEEAFKEISIEAMDFVDRLLVKERKSRMTASEALQHPWLKQKIERVSTKVIRTLKHRRYYHTLIKKDLNMVVSAARISCGGAIRSQKGVSVAKVKVASIEIGPVSGQIMHAVGEEGGHVKYVCKIENYDQSTQVTWYFGVRQLENSEKYEITYEDGVAILYVKDITKLDDGTYRCKVVNDYGEDSSYAELFVKGVREVYDYYCRRTMKKIKRRTDTMRLLERPPEFTLPLYNKTAYVGENVRFGVTITVHPEPHVTWYKSGQKIKPGDNDKKYTFESDKGLYQLTINSVTTDDDAEYTVVARNKYGEDSCKAKLTVTLHPPPTDSTLRPMFKRLLANAECQEGQSVCFEIRVSGIPPPTLKWEKDG

SEQ ID NO: 5125 - protein, 1590 aa, Homo sapiens
PLSLGPNIEIIHEGLDYYALHIRDTLPEDTGYYRVTATNTAGSTSCQAHLQVERLRYKKQEFKSKEEHERHVQKQIDKTLRMAEILSGTESVPLTQVAKEALREAAVLYKPAVSTKTVKGEFRLEIEEKKEERKLRMPYDVPEPRKYKQTTIEEDQRIKQFVPMSDMKWYKKIRDQYEMPGKLDRVVQKRPKRIRLSRWEQFYVMPLPRITDQYRPKWRIPKLSQDDLEIVRPARRRTPSPDYDFYYRPRRRSLGDISDEELLLPIDDYLAMKRTEEERLRLEEELELGFSASPPSRSPPHFELSSLRYSSPQAHVKVEETRKDFRYSTYHIPTKAEASTSYAELRERHAQAAYRQPKQRQRIMAEREDEELLRPVTTTQHLSEYKSELDFMSKEEKSRKKSRRQREVTEITEIEEEYEISKHAQRESSSSASRLLRRRRSLSPTYIELMRPVSELIRSRPQPAEEYEDDTERRSPTPERTRPRSPSPVSSERSLSRFERSARFDIFSRYESMKAALKTQKTSERKYEVLSQQPFTLDHAPRITLRMRSHRVPCGQNTRFILNVQSKPTAEVKWYHNGVELQESSKIHYTNTSGVLTLEILDCHTDDSGTYRAVCTNYKGEASDYATLDVTGGDYTTYASQRRDEEVPRSVFPELTRTEAYAVSSFKKTSEMEASSSVREVKSQMTETRESLSSYEHSASAEMKSAALEEKSLEEKSTTRKIKTTLAARILTKPRSMTVYEGESARFSCDTDGEPVPTVTWLRKGQVLSTSARHQVTTTKYKSTFEISSVQASDEGNYSVVVENSEGKQEAEFTLTIQKARVTEKAVTSPPRVKSPEPRVKSPEAVKSPKRVKSPEPSHPKAVSPTETKPTPTEKVQHLPVSAPPKITQFLKAEASKEIAKLTCVVESSVLRAKEVTWYKDGKKLKENGHFQFHYSADGTYELKINNLTESDQGEYVCEISGEGGTSKTNLQFMGQAFKSIHEKVSKISETKKSDQKTTESTVTRKTEPKAPEPISSKPVIVTGLQDTTVSSDSVAKFAVKATGEPRPTAIWTKDGKAITQGGKYKLSEDKGGFFLEIHKTDTSDSGLYTCTVKNSAGSVSSSCKLTIKAIKDTEAQKVSTQKTSEITPQKKAVVQEEISQKALRSEEIKMSEAKSQEKLALKEEASKVLISEEVKKSAATSLEKSIVHEEITKTSQASEEVRTHAEIKAFSTQMSINEGQRLVLKANIAGATDVKWVLNGVELTNSEEYRYGVSGSDQTLTIKQASHRDEGILTCISKTKEGIVKCQYDLTLSKELSDAPAFISQPRSQNINEGQNVLFTCEISGEPSPEIEWFKNNLPISISSNVSISRSRNVYSLEIRNASVSDSGKYTIKAKNFRGQCSATASLMVLPLVEEPSREVVLRTSGDTSLQGSFSSQSVQMSASKQEASFSSFSSSSASSMTEMKFASMSAQSMSSMQESFVEMSSSSFMGISNMTQLESSTSKMLKAGIRGIPPKIEALPSDISIDEGKVLTVACAFTGEPTPEVTWSCGGRKIHSQEQGRFHIENTDDLTTLIIMDVQKQDGGLYTLSLGNEFGSDSATVNIHIRSI

SEQ ID NO: 5126 - protein, 450 aa, unidentified
MGAPPGYRPSAWVHLLHQLPRADFQLRPVPSVFAPQEQEYQQALLLVAALAGLGLGLSLIFIAVYLIRFCCCRPPEPPGSKIPSPGGGCVTWSCIVALLAGCTGIGIGFYGNSETSDGVSQLSSALLHANHTLSTIDHLVLETVERLGEAVRTELTTLEEVLEPRTELVAAARGARRQAEAAAQQLQGLAFWQGVPLSPLQVAENVSFVEEYRWLAYVLLLLLELLVCLFTLLGLAKQSKWLVIVMTVMSLLVLVLSWGSMGLEAATAVGLSDFCSNPDPYVLNLTQEETGLSSDILSYYLLCNRAVSNPFQQRLTLSQRALANIHSQLLGLEREAVPQFPSAQKPLLSLEETLNVTEGNFHQLVALLHCRSLHKDYGAALRGLCEDALEGLLFLLLFSLLSAGALATALCSLPRAWALFPPSDDYDDTDDDDPFNPQESKRFVQWQSSI

SEQ ID NO: 5127 - protein, 534 aa, unidentified
MQAARVDYIAPWWVVWLHSVPHVGLRLQPVNSTFSPGDESYQESLLFLGLVAAVCLGLNLIFLVAYLVCACHCRRDDAVQTKQHHSCCITWTAVVAGLICCAAVGVGFYGNSETNDGAYQLMYSLDDANHTFSGIDALVSGTTQKMKVDLEQHLARLSEIFAARGDYLQTLKFIQQMAGSVVVQLSGLPVWREVTMELTKLSDQTGYVEYYRWLSYLLLFILDLVICLIACLGLAKRSKCLLASMLCCGALSLLLSWASLAADGSAAVATSDFCVAPDTFILNVTEGQISTEVTRYYLYCSQSGSSPFQQTLTTFQRALTTMQIQVAGLLQFAVPLFSTAEEDLLAIQLLLNSSESSLHQLTAMVDCRGLHKDYLDALAGICYDGLQGLLYLGLFSFLAALAFSTMICAGPRAWKHFTTRNRDYDDIDDDDPFNPQAWRMAAHSPPRGQLHSFCSYSSGLGSQTSLQPPAQTISNAPVSEYMNQAMLFGRNPRYENVPLIGRASPPPTYSPSMRATYLSVADEHLRHYGNQFPA

SEQ ID NO: 5128 - protein, 523 aa, unidentified
MAGVSYAAPWWVSLLHRLPHFDLSWEATSSQFRPEDTDYQQALLLLGAAALACLALDLLFLLFYSFWLCCRRRKSEEHLDADCCCTAWCVIIATLVCSAGIAVGFYGNGETSDGIHRATYSLRHANRTVAGVQDRVWDTAVGLNHTAEPSLQTLERQLAGRPEPLRAVQRLQGLLETLLGYTAAIPFWRNTAVSLEVLAEQVDLYDWYRWLGYLGLLLLDVIICLLVLVGLIRSSKGILVGVCLLGVLALVISWGALGLELAVSVGSSDFCVDPDAYVTKMVEEYSVLSGDILQYYLACSPRAANPFQQKLSGSHKALVEMQDVVAELLRTVPWEQPATKDPLLRVQEVLNGTEVNLQHLTALVDCRSLHLDYVQALTGFCYDGVEGLIYLALFSFVTALMFSSIVCSVPHTWQQKRGPDEDGEEEAAPGPRQAHDSLYRVHMPSLYSCGSSYGSETSIPAAAHTVSNAPVTEYMSQNANFQNPRCENTPLIGRESPPPSYTSSMRAKYLATSQPRPDSSGSH

SEQ ID NO: 5129 - protein, 449 aa, unidentified
MRECISVHVGQAGVQIGNACWELFCLEHGIQADGTFDAQASKINDDDSFTTFFSETGNGKHVPRAVMIDLEPTVVDEVRAGTYRQLFHPEQLITGKEDAANNYARGHYTVGKESIDLVLDRIRKLTDACSGLQGFLIFHSFGGGTGSGFTSLLMERLSLDYGKKSKLEFAIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLVTYAPIISAEKAYHEQLSVAEITSSCFEPNSQMVKCDPRHGKYMACCMLYRGDVVPKDVNVAIAAIKTKRTIQFVDWCPTGFKVGINYQPPTVVPGGDLAKVQRAVCMLSNTTAIAEAWARLDHKFDLMYAKRAFVHWYVGEGMEEGEFSEAREDLAALEKDYEEVGTDSFEEENEGEEF

SEQ ID NO: 5130 - protein, 348 aa, unidentified
MGARGAPSRRRQAGRRLRYLPTGSFPFLLLLLLLCIQLGGGQKKKENLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVSYIHGSSQAQFVAESHIILVLNAAITMGMVLLNEAATSKGDVGKRRIICLVGLGLVVFFFSFLLSIFRSKYHGYPYSDLDFE

SEQ ID NO: 5131 - protein, 177 aa, unidentified
MAHPVQSEFPSAQEPGSAAFLDLPEMEILLTKAENKDDKTLNLSKTLSGPLDLEQNSQGLPFKAISEGHLEAPLPRSPSRASSRRASSIATTSYAQDQEAPRDYLILAVVACFCPVWPLNLIPLIISIMSRSSMQQGNVDGARRLGRLARLLSITLIIMGIVIIMVAVTVNFTVQKK

SEQ ID NO: 5132 - protein, 213 aa, unidentified
MKQALVDDTEDVSLDFGNEEELAFRKAKIRHPLATFFHLFFRVSAIVTYVSCDWFSKSFVGCFVMVLLLLSLDFWSVKNVTGRLLVGLRWWNQIDEDGKSHWIFEARKVSPNSIAATEAEARIFWLGLIICPMIWIVFFFSTLFSLKLKWLALVVAGISLQAANLYGYILCKMGGNSDIGKVTASFLSQTVFQTACPGDFQKPGLEGLEIHQH

SEQ ID NO: 5133 - protein, 205 aa, unidentified
MLQQDSNDDTEDVSLFDAEEETTNRPRKAKIRHPVASFFHLFFRVSAIIVYLLCGLLSSSFITCMVTIILLLSCDFWAVKNVTGRLMVGLRWWNHIDEDGKSHWVFESRKESSQENKTVSEAESRIFWLGLIACPVLWVIFAFSALFSFRVKWLAVVIMGVVLQGANLYGYIRCKVRSRKHLTSMATSYFGKQFLRQNTGDDQTS

SEQ ID NO: 5134 - protein, 276 aa, unidentified
MLQQDSNDDTEDVSLFDAEEETTNRPRKAKIRHPVASFFHLFFRVSAIIVCLLCELLSSSFITCMVTIILLLSCDFWAVKNVTGRLMVGLRWWNHIDEDGKSHWVFESRKESSQENKTVSEAESRIFWLGLIACSVLWVIFAFSALFSFTVKWLRRSRHIAQTGLKVLGSRDPPASAFQSAGITGVSRCPGHPSRKFHQVDINSFTRITDRALYWKPAPRLSSPPLRAAPGNCQQMAPARLFLSLRLWAWRGGGESPNSRGTGEPGPKFHLASGMH

SEQ ID NO: 5135 - protein, 985 aa, unidentified
MSECGGRGGGSSSSEDAEDEGGGGGGPAGSDCLSSSPTLATASSAGRLRRGLRGAFLMARQRPELLCGAVALGCALLLALKFTCSRAKDVIIPAKPPVSFFSLRSPVLDLFQGQLDYAEYVRRDSEVVLLFFYAPWCGQSIAARAEIEQAASRLSDQVLFVAINCWWNQGKCRKQKHFFYFPVIYLYHRSFGPIEYKGPMSAVYIEKFVRRVMKPLLYIPSQSELLDFLSNYEPGVLGYFEFSGSPQPPGYLTFFTSALHSLKKALESTSSPRALVSFTGEWHLETKIYVLDYLGTVRFGVITNKHLAKLVSLVHSGSVYLHRHFNTSLVFPREVLNYTAENICKWALENQETLFRWLRPHGGKSLLLNNELKKGPALFLFIPFNPLAESHPLIDEITEVALEYNNCHGDQVVERLLQHLRRVDAPVLESLALEVPAQLPDPPTITASPCCNTVVLPQWHSFSRTHNVCELCVNQTSGGMKPSSVSVPQCSFFEMAAALDSFYLKEQTFYHVASDSIECSNFLTSYSPFSYYTACCRTISRGVSGFIDSEQGVFEAPTVAFSSLEKKCEVDAPSSVPHIEENRYLFPEVDMTSTNFTGLSCRTNKTLNIYLLDSNLFWLYAERLGAPSSTQVKEFAAIVDVKEESHYILDPKQALMKLTLESFIQNFSVLYSPLKRHLIGSGSAQFPSQHLITEVTTDTFWEVVLQKQDVLLLYYAPWCGFCPSLNHIFIQLARNLPMDTFTVARIDVSQNDLPWEFMVDRLPTVLFFPCNRKDLSVKYPEDVPITLPNLLRFILHHSDPASSPQNVANSPTKECLQSEAVLQRGHISHLEREIQKLRAEISSLQRAQVQVESQLSSARRDEHRLRQQQRALEEQHSLLHAHSEQLQALYEQKTRELQELARKLQELADASENLLTENTWLKILVATMERKLEGRDGAESLAAQREVHPKQPEPSATPQLPGSSPPPANVSATLVSERNKENRTD

SEQ ID NO: 5136 - protein, 360 aa, unidentified
MVPAAGRRPPRVMRLLGWWQVLLWVLGLPVRGVEVAEESGRLWSEEQPAHPLQVGAVYLGEEELLHDPMGQDRAAEEANAVLGLDTQGDHMVMLSVIPGEAEDKVSSEPSGVTCGAGGAEDSRCNVRESLFSLDGAGAHFPDREEEYYTEPEVAESDAAPTEDSNNTESLKSPKVNCEERNITGLENFTLKILNMSQDLMDFLNPNGSDCTLVLFYTPWCRFSASLAPHFNSLPRAFPALHFLALDASQHSSLSTRFGTVAVPNILLFQGAKPMARFNHTDRTLETLKIFIFNQTGIEAKKNVVVTQADQIGPLPSTLIKSVDWLLVFSLFFLISFIMYATIRTESIRWLIPGQEQEHVE

SEQ ID NO: 5137 - protein, 825 aa, unidentified
MFSGFNVFRVGISFVIMCIFYMPTVNSLPELSPQKYFSTLQPGKASLAYFCQADSPRTSVFLEELNEAVRPLQDYGISVAKVNCVKEEISRYCGKEKDLMKAYLFKGNILLREFPTDTLFDVNAIVAHVLFALLFSEVKYITNLEDLQNIENALKGKANIIFSYVRAIGIPEHRAVMEAAFVYGTTYQFVLTTEIALLESIGSEDVEYAHLYFFHCKLVLDLTQQCRRTLMEQPLTTLNIHLFIKTMKAPLLTEVAEDPQQVSTVHLQLGLPLVFIVSQQATYEADRRTAEWVAWRLLGKAGVLLLLRDSLEVNIPQDANVVFKRAEEGVPVEFLVLHDVDLIISHVENNMHIEEIQEDEDNDMEGPDIDVQDDEVAETVFRDRKRKLPLELTVELTEETFNATVMASDSIVLFYAGWQAVSMAFLQSYIDVAVKLKGTSTMLLTRINCADWSDVCTKQNVTEFPIIKMYKKGENPVSYAGMLGTEDLLKFIQLNRISYPVNITSIQEAEEYLSGELYKDLILYSSVSVLGLFSPTMKTAKEDFSEAGNYLKGYVITGIYSEEDVLLLSTKYAASLPALLLARHTEGKIESIPLASTHAQDIVQIITDALLEMFPEITVENLPSYFRLQKPLLILFSDGTVNPQYKKAILTLVKQKYLDSFTPCWLNLKNTPVGRGILRAYFDPLPPLPLLVLVNLHSGGQVFAFPSDQAIIEENLVLWLKKLEAGLENHITILPAQEWKPPLPAYDFLSMIDAATSQRGTRKVPKCMKETDVQENDKEQHEDKSAVRKEPIETLRIKHWNRSNWFKEAEKSFRRDKELGCSKVN

SEQ ID NO: 5138 - protein, 529 aa, unidentified [sequence omitted]

SEQ ID NO: 5139 - protein, 890 aa, unidentified
MALRRSMGRPGLPPLPLPPPPRLGLLLAALASLLLPESAAAGLKLMGAPVKLTVSQGQPVKLNCSVEGMEEPDIQWVKDGAVVQNLDQLYIPVSEQHWIGFLSLKSVERSDAGRYWCQVEDGGETEISQPVWLTVEGVPFFTVEPKDLAVPPNAPFQLSCEAVGPPEPVTIVWWRGTTKIGGPAPSPSVLNVTGVTQSTMFSCEAHNLKGLASSRTATVHLQALPAAPFNITVTKLSSSNASVAWMPGADGRALLQSCTVQVTQAPGGWEVLAVVVPVPPFTCLLRDLVPATNYSLRVRCANALGPSPYADWVPFQTKGLAPASAPQNLHAIRTDSGLILEWEEVIPEAPLEGPLGPYKLSWVQDNGTQDELTVEGTRANLTGWDPQKDLIVRVCVSNAVGCGPWSQPLVVSSHDRAGQQGPPHSRTSWVPVVLGVLTALVTAAALALILLRKRRKETRFGQAFDSVMARGEPAVHFRAARSFNRERPERIEATLDSLGISDELKEKLEDVLIPEQQFTLGRMLGKGEFGSVREAQLKQEDGSFVKVAVKMLKADIIASSDIEEFLREAACMKEFDHPHVAKLVGVSLRSRAKGRLPIPMVILPFMKHGDLHAFLLASRIGENPFNLPLQTLIRFMVDIACGMEYLSSRNFIHRDLAARNCMLAEDMTVCVADFGLSRKIYSGDYYRQGCASKLPVKWLALESLADNLYTVQSDVWAFGVTMWEIMTRGQTPYAGIENAEIYNYLIGGNRLKQPPECMEDVYDLMYQCWSADPKQRPSFTCLRMELENILGQLSVLSASQDPLYINIERAEEPTAGGSLELPGRDQPYSGAGDGSGMGAVGGTPSDCRYILTPGGLAEQPGQAEHQPESPLNETQRLLLLQQGLLPHSSC

SEQ ID NO: 5140 - protein, 113 aa, unidentified
MGGLEPCSRLLLLPLLLAVSGLRPVQAQAQSDCSCSTVSPGVLAGIVMGDLVLTVLIALAVYFLGRLVPRGRGAAEAATRKQRITETESPYQELQGQRSDVYSDLNTQRPYYK

SEQ ID NO: 5141 - protein, 537 aa, unidentified
MSAPKLLSLGCIFFPLLLFQQARAQFPRQCATVEALRSGMCCPDLSPVSGPGTDRCGSSSGRGRCEAVTADSRPHSPQYPHDGRDDREVWPLRFFNRTCHCNGNFSGHNCGTCRPGWRGAACDQRVLIVRRNLLDLSKEEKNHFVRALDMAKRTTHPLFVIATRRSEEILGPDGNTPQFENISIYNYFVWTHYYSVKKTFLGVGQESFGEVDFSHEGPAFLTWHRYHLLRLEKDMQEMLQEPSFSLPYWNFATGKNVCDICTDDLMGSRSNFDSTLISPNSVFSQWRVVCDSLEDYDTLGTLCNSTEDGPIRRNPAGNVARPMVQRLPEPQDVAQCLEVGLFDTPPFYSNSTNSFRNTVEGYSDPTGKYDPAVRSLHNLAHLFLNGTGGQTHLSPNDPIFVLLHTFTDAVFDEWLRRYNADISTFPLENAPIGHNRQYNMVPFWPPVTNTEMFVTAPDNLGYTYEIQWPSREFSVPEIIAIAVVGALLLVALIFGTASYLIRARRSMDEANQPLLTDQYQCYAEEYEKLQNPNQSVV

SEQ ID NO: 5142 - protein, 732 aa, unidentified
MDPSADTWDLFSPLISLWINRFYIYLGFAVSISLWICVQIVIKTQGKNLQEKSVPKAAQDLMTNGYVSLQEKDIFVSGVKIFYGSQTGTAKGFATVLAEAVTSLDLPVAIINLKEYDPDDHLIEEVTSKNVCVFLVATYTDGLPTESAEWFCKWLEEASIDFRFGKTYLKGMRYAVFGLGNSAYASHFNKVGKNVDKWLWMLGAHRVMSRGEGDCDVVKSKHGSIEADFRAWKTKFISQLQALQKGERKKSCGGHCKKGKCESHQHGSEEREEGSHEQDELHHRDTEEEEPFESSSEEEFGGEDHQSLNSIVDVEDLGKIMDHVKKEKREKEQQEEKSGLFRNMGRNEDGERRAMITPALREALTKQGYQLIGSHSGVKLCRWTKSMLRGRGGCYKHTFYGIESHRCMETTPSLACANKCVFCWRHHTNPVGTEWRWKMDQPEMILKEAIENHQNMIKQFKGVPGVKAERFEEGMTVKHCALSLVGEPIMYPEINRFLKLLHQCKISSFLVTNAQFPAEIRNLEPVTQLYVSVDASTKDSLKKIDRPLFKDFWQRFLDSLKALAVKQQRTVYRLTLVKAWNVDELQAYAQLVSLGNPDFIEVKGVTYCGESSASSLTMAHVPWHEEVVQFVHELVDLIPEYEIACEHEHSNCLLIAHRKFKIGGEWWTWIDYNRFQELIQEYEDSGGSKTFSAKDYMARTPHWALFGASERGFDPKDTRHQRKNKSKAISGC

SEQ ID NO: 5143 - protein, 1058 aa, unidentified
MSSSPLSKKRRVSGPDPKPGSNCSPAQSVLSEVPSVPTNGMAKNGSEADIDEGLYSRQLYVLGHEAMKRLQTSSVLVSGLRGLGVEIAKNIILGGVKAVTLHDQGTAQWADLSSQFYLREEDIGKNRAEVSQPRLAELNSYVPVTAYTGPLVEDFLSGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVLGPYTFSICDTSNFSDYIRGGIVSQVKVPKKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDARMYMDRRCVYYRKPLLESGTLGTKGNVQVVIPFLTESYSSSQDPPEKSIPICTLKNFPNAIEHTLQWARDEFEGLFKQPAENVNQYLTDPKFVERTLRLAGTQPLEVLEAVQRSLVLQRPQTWADCVTWACHHWHTQYSNNIRQLLHNFPPDQLTSSGAPFWSGPKRCPHPLTFDVNNPLHLDYVMAAANLFAQTYGLTGSQDRAAVATFLQSVQVPEFTPKSGVKIHVSDQELQSANASVDDSRLEELKATLPSPDKLPGFKMYPIDFEKDDDSNFHMDFIVAASNLRAENYDIPSADRHKSKLIAGKIIPAIATTTAAVVGLVCLELYKVVQGHRQLDSYKNGFLNLALPFFGFSEPLAAPRHQYYNQEWTLWDRFEVQGLQPNGEEMTLKQFLDYFKTEHKLEITMLSQGVSMLYSFFMPAAKLKERLDQPMTEIVSRVSKRKLGRHVRALVLELCCNDESGEDVEVPYVRYTIR

SEQ ID NO: 5144 - protein, 640 aa, unidentified
MALSRGLPRELAEAVAGGRVLVVGAGGIGCELLKNLVLTGFSHIDLIDLDTIDVSNLNRQFLFQKKHVGRSKAQVAKESVLQFYPKANIVAYHDSIMNPDYNVEFFRQFILVMNALDNRAARNHVNRMCLAADVPLIESGTAGYLGQVTTIKKGVTECYECHPKPTQRTFPGCTIRNTPSEPIHCIVWAKYLFNQLFGEEDADQEVSPDRADPEAAWEPTEAEARARASNEDGDIKRISTKEWAKSTGYDPVKLFTKLFKDDIRYLLTMDKLWRKRKPPVPLDWAEVQSQGEETNASDQQNEPQLGLKDQQVLDVKSYARLFSKSIETLRVHLAEKGDGAELIWDKDDPSAMDFVTSAANLRMHIFSMNMKSRFDIKSMAGNIIPAIATTNAVIAGLIVLEGLKILSGKIDQCRTIFLNKQPNPRKKLLVPCALDPPNPNCYVCASKPEVTVRLNVHKVTVLTLQDKIVKEKFAMVAPDVQIEDGKGTILISSEEGETEANNHKKLSEFGIRNGSRLQADDFLQDYTLLINILHSEDLGKDVEFEVVGDAPEKVGPKQAEDAAKSITNGSDDGAQPSTSTAQEQDDVLIVDSDEEDSSNNADVSEEERSRKRKLDEKENLSAKRSRIEQKEELDDVIALD

SEQ ID NO: 5145 - protein, 404 aa, unidentified
MAESVERLQQRVQELERELAQERSLQVPRSGDGGGGRVRIEKMSSEVVDSNPYSRLMALKRMGIVSDYEKIRTFAVAIVGVGGVGSVTAEMLTRCGIGKLLLFDYDKVELANMNRLFFQPHQAGLSKVQAAEHTLRNINPDVLFEVHNYNITTVENFQHFMDRISNGGLEEGKPVDLVLSCVDNFEARMTINTACNELGQTWMESGVSENAVSGHIQLIIPGESACFACAPPLVVAANIDEKTLKREGVCAASLPTTMGVVAGILVQNVLKFLLNFGTVSFYLGYNAMQDFFPTMSMKPNPQCDDRNCRKQQEEYKKKVAALPKQEVIQEEEEIIHEDNEWGIELVSEVSEEELKNFSGPVPDLPEGITVAYTIPKKQEDSVTELTVEDSGESLEDLMAKMKNM

SEQ ID NO: 5146 - protein, 1012 aa, unidentified
MDALDASKLLDEELYSRQLYVLGSPAMQRIQGARVLVSGLQGLGAEVAKNLVLMGVGSLTLHDPHPTCWSDLAAQFLLSEQDLERSRAEASQELLAQLNRAVQVVVHTGDITEDLLLDFQVVVLTAAKLEEQLKVGTLCHKHGVCFLAADTRGLVGQLFCDFGEDFTVQDPTEAEPLTAAIQHISQGSPGILTLRKGANTHYFRDGDLVTFSGIEGMVELNDCDPRSIHVREDGSLEIGDTTTFSRYLRGGAITEVKRPKTVRHKSLDTALLQPHVVAQSSQEVHHAHCLHQAFCALHKFQHLHGRPPQPWDPVDAETVVGLARDLEPLKRTEEEPLEEPLDEALVRTVALSSAGVLSPMVAMLGAVAAQEVLKAISRKFMPLDQWLYFDALDCLPEDGELLPSPEDCALRGSRYDGQIAVFGAGFQEKLRRQHYLLVGAGAIGCELLKVFALVGLGAGNSGGLTVVDMDHIERSNLSRQFLFRSQDVGRPKAEVAAAAARGLNPDLQVIPLTYPLDPTTEHIYGDNFFSRVDGVAAALDSFQARRYVAARCTHYLKPLLEAGTSGTWGSATVFMPHVTEAYRAPASAAASEDAPYPVCTVRYFPSTAEHTLQWARHEFEELFRLSAETINHHQQAHTSLADMDEPQTLTLLKPVLGVLRVRPQNWQDCVAWALGHWKLCFHYGIKQLLRHFPPNKVLEDGTPFWSGPKQCPQPLEFDTNQDTHLLYVLAAANLYAQMHGLPGSQDWTALRELLKLLPQPDPQQMAPIFASNLELASASAEFGPEQQKELNKALEVWSVGPPLKPLMFEKDDDSNFHVDFVVAAASLRCQNYGIPPVNRAQSKRIVGQIIPAIATTTAAVAGLLGLELYKVVSGPRPRSAFRHSYLHLAENYLIRYMPFAPAIQTFHHLKWTSWDRLKVPAGQPERTLESLLAHLQEQHGLRVRILLHGSALLYAAGWSPEKQAQHLPLRVTELVQQLTGQAPAPGQRVLVLELSCEGDDEDTAFPPLHYEL

SEQ ID NO: 5147 - protein, 344 aa, unidentified
MFTSTGSSGLYKAPLSKSLLLVPSALSLLLALLLPHCQKLFVYDLHAVKNDFQIWRLICGRIICLDLKDTFCSSLLIYNFRIFERRYGSRKFASFLLGSWVLSALFDFLLIEAMQYFFGITAASNLPSGFLAPVFALFVPFYCSIPRVQVAQILGPLSITNKTLIYILGLQLFTSGSYIWIVAISGLMSGLCYDSKMFQVHQVLCIPSWMAKFFSWTLEPIFSSSEPTSEARIGMGATLDIQRQQRMELLDRQLMFSQFAQGRRQRQQQGGMINWNRLFPPLRQRQNVNYQGGRQSEPAAPPLEVSEEQVARLMEMGFSRGDALEALRASNNDLNVATNFLLQH

SEQ ID NO: 5148 - protein, 318 aa, unidentified
METRYNLKSPAVKRLMKEAAELKDPTDHYHAQPLEDNLFEWHFTVRGPPDSDFDGGVYHGRIVLPPEYPMKPPSIILLTANGRFEVGKKICLSISGHHPETWQPSWSIRTALLAIIGFMPTKGEGAIGSLDYTPEERRALAKKSQDFCCEGCGSAMKDVLLPLKSGSDSSQADQEAKELARQISFKAEVNSSGKTISESDLNHSFSLTDLQDDIPTTFQGATASTSYGLQNSSAASFHQPTQPVAKNTSMSPRQRRAQQQSQRRLSTSPDVIQGHQPRDNHTDHGGSAVLIVILTLALAALIFRRIYLANEYIFDFEL

SEQ ID NO: 5149 - protein, 259 aa, unidentified
MSSTSSKRAPTTATQRLKQDYLRIKKDPVPYICAEPLPSNILEWHYVVRGPEMTPYEGGYYHGKLIFPREFPFKPPSIYMITPNGRFKCNTRLCLSITDFHPDTWNPAWSVSTILTGLLSFMVEKGPTLGSIETSDFTKRQLAVQSLAFNLKDKVFCELFPEVVEEIKQKQKAQDELSSRPQTLPLPDVVPDGETHLVQNGIQLLNGHAPGAVPNLAGLQQANRHHGLLGGALANLFVIVGFAAFAYTVKYVLRSIAQE

SEQ ID NO: 5150 - protein, 875 aa, unidentified
MEKLHQCYWKSGEPQSDDIEASRMKRAAAKHLIERYYHQLTEGCGNEACTNEFCASCPTFLRMDNNAAAIKALELYKINAKLCDPHPSKKGASSAYLENSKGAPNNSCSEIKMNKKGARIDFKDVTYLTEEKVYEILELCREREDYSPLIRVIGRVFSSAEALVQSFRKVKQHTKEELKSLQAKDEDKDEDEKEKAACSAAAMEEDSEASSSRIGDSSQGDNNLQKLGPDDVSVDIDAIRRVYTRLLSNEKIETAFLNALVYLSPNVECDLTYHNVYSRDPNYLNLFIIVMENRNLHSPEYLEMALPLFCKAMSKLPLAAQGKLIRLWSKYNADQIRRMMETFQQLITYKVISNEFNSRNLVNDDDAIVAASKCLKMVYYANVVGGEVDTNHNEEDDEEPIPESSELTLQELLGEERRNKKGPRVDPLETELGVKTLDCRKPLIPFEEFINEPLNEVLEMDKDYTFFKVETENKFSFMTCPFILNAVTKNLGLYYDNRIRMYSERRITVLYSLVQGQQLNPYLRLKVRRDHIIDDALVRLEMIAMENPADLKKQLYVEFEGEQGVDEGGVSKEFFQLVVEEIFNPDIGMFTYDESTKLFWFNPSSFETEGQFTLIGIVLGLAIYNNCILDVHFPMVVYRKLMGKKGTFRDLGDSHPVLYQSLKDLLEYEGNVEDDMMITFQISQTDLFGNPMMYDLKENGDKIPITNENRKEFVNLYSDYILNKSVEKQFKAFRRGFHMVTNESPLKYLFRPEEIELLICGSRNLDFQALEETTEYDGGYTRDSVLIREFWEIVHSFTDEQKRLFLQFTTGTDRAPVGGLGKLKMIIAKNGPDTERLPTSHTCFNVLLLPEYSSKEKLKERLLKAITYAKGFGML

SEQ ID NO: 5151 - protein, 338 aa, unidentified
MAASQVLGEKINILSGETVKAGDRDPLGNDCPEQDRLPQRSWRQKCASYVLALRPWSFSASLTPVALGSALAYRSHGVLDPRLLVGCAVAVLAVHGAGNLVNTYYDFSKGIDHKKSDDRTLVDRILEPQDVVRFGVFLYTLGCVCAACLYYLSPLKLEHLALIYFGGLSGSFLYTGGIGFKYVALGDLIILITFGPLAVMFAYAIQVGSLAIFPLVYAIPLALSTEAILHSNNTRDMESDREAGIVTLAILIGPTFSYILYNTLLFLPYLVFSILATHCTISLALPLLTIPMAFSLERQFRSQAFNKLPQRTAKLNLLLGLFYVFGIILAPAGSLPKI

SEQ ID NO: 5152 - protein, 1749 aa, unidentified
MADEEAGGTERMEISAELPQTPQRLASWWDQQVDFYTAFLHHLAQLVPEIYFAEMDPDLEKQEESVQMSIFTPLEWYLFGEDPDICLEKLKHSGAFQLCGRVFKSGETTYSCRDCAIDPTCVLCMDCFQDSVHKNHRYKMHTSTGGGFCDCGDTEAWKTGPFCVNHEPGRAGTIKENSRCPLNEEVIVQARKIFPSVIKYVVEMTIWEEEKELPPELQIREKNERYYCVLFNDEHHSYDHVIYSLQRALDCELAEAQLHTTAIDKEGRRAVKAGAYAACQEAKEDIKSHSENVSQHPLHVEVLHSEIMAHQKFALRLGSWMNKIMSYSSDFRQIFCQACLREEPDSENPCLISRLMLWDAKLYKGARKILHELIFSSFFMEMEYKKLFAMEFVKYYKQLQKEYISDDHDRSISITALSVQMFTVPTLARHLIEEQNVISVITETLLEVLPEYLDRNNKFNFQGYSQDKLGRVYAVICDLKYILISKPTIWTERLRMQFLEGFRSFLKILTCMQGMEEIRRQVGQHIEVDPDWEAAIAIQMQLKNILLMFQEWCACDEELLLVAYKECHKAVMRCSTSFISSSKTVVQSCGHSLETKSYRVSEDLVSIHLPLSRTLAGLHVRLSRLGAVSRLHEFVSFEDFQVEVLVEYPLRCLVLVAQVVAEMWRRNGLSLISQVFYYQDVKCREEMYDKDIIMLQIGASLMDPNKFLLLVLQRYELAEAFNKTISTKDQDLIKQYNTLIEEMLQVLIYIVGERYVPGVGNVTKEEVTMREIIHLLCIEPMPHSAIAKNLPENENNETGLENVINKVATFKKPGVSGHGVYELKDESLKDFNMYFYHYSKTQHSKAEHMQKKRRKQENKDEALPPPPPPEFCPAFSKVINLLNCDIMMYILRTVFERAIDTDSNLWTEGMLQMAFHILALGLLEEKQQLQKAPEEEVTFDFYHKASRLGSSAMNIQMLLEKLKGIPQLEGQKDMITWILQMFDTVKRLREKSCLIVATTSGSESIKNDEITHDKEKAERKRKAEAARLHRQKIMAQMSALQKNFIETHKLMYDNTSEMPGKEDSIMEEESTPAVSDYSRIALGPKRGPSVTEKEVLTCILCQEEQEVKIENNAMVLSACVQKSTALTQHRGKPIELSGEALDPLFMDPDLAYGTYTGSCGHVMHAVCWQKYFEAVQLSSQQRIHVDLFDLESGEYLCPLCKSLCNTVIPIIPLQPQKINSENADALAQLLTLARWIQTVLARISGYNIRHAKGENPIPIFFNQGMGDSTLEFHSILSFGVESSIKYSNSIKEMVILFATTIYRIGLKVPPDERDPRVPMLTWSTCAFTIQAIENLLGDEGKPLFGALQNRQHNGLKALMQFAVAQRITCPQVLIQKHLVRLLSVVLPNIKSEDTPCLLSIDLFHVLVGAVLAFPSLYWDDPVDLQPSSVSSSYNHLYLFHLITMAHMLQILLTVDTGLPLAQVQEDSEEAHSASSFFAEISQYTSGSIGCDIPGWYLWVSLKNGITPYLRCAALFFHYLLGVTPPEELHTNSAEGEYSALCSYLSLPTNLFLLFQEYWDTVRPLLQRWCADPALLNCLKQKNTVVRYPRKRNSLIELPDDYSCLLNQASHFRCPRSADDERKHPVLCLFCGAILCSQNICCQEIVNGEEVGACIFHALHCGAGVCIFLKIRECRVVLVEGKARGCAYPAPYLDEYGETDPGLKRGNPLHLSRERYRKLHLVWQQHCIIEEIARSQETNQMLFGFNWQLL

SEQ ID NO: 5153 - protein, 1755 aa, unidentified
MASELEPEVQAIDRSLLECSAEEIAGKWLQATDLTREVYQHLAHYVPKIYCRGPNPFPQKEDMLAQHVLLGPMEWYLCGEDPAFGFPKLEQANKPSHLCGRVFKVGEPTYSCRDCAVDPTCVLCMECFLGSIHRDHRYRMTTSGGGGFCDCGDTEAWKEGPYCQKHELNTSEIEEEEDPLVHLSEDVIARTYNIFAITFRYAVEILTWEKESELPADLEMVEKSDTYYCMLFNDEVHTYEQVIYTLQKAVNCTQKEAIGFATTVDRDGRRSVRYGDFQYCEQAKSVIVRNTSRQTKPLKVQVMHSSIVAHQNFGLKLLSWLGSIIGYSDGLRRILCQVGLQEGPDGENSSLVDRLMLSDSKLWKGARSVYHQLFMSSLLMDLKYKKLFAVRFAKNYQQLQRDFMEDDHERAVSVTALSVQFFTAPTLARMLITEENLMSIIIKTFMDHLRHRDAQGRFQFERYTALQAFKFRRVQSLILDLKYVLISKPTEWSDELRQKFLEGFDAFLELLKCMQGMDPITRQVGQHIEMEPEWEAAFTLQMKLTHVISMMQDWCASDEKVLIEAYKKCLAVLMQCHGGYTDGEQPITLSICGHSVETIRYCVSQEKVSIHLPVSRLLAGLHVLLSKSEVAYKFPELLPLSELSPPMLIEHPLRCLVLCAQVHAGMWRRNGFSLVNQIYYYHNVKCRREMFDKDVVMLQTGVSMMDPNHFLMIMLSRFELYQIFSTPDYGKRFSSEITHKDVVQQNNTLIEEMLYLIIMLVGERFSPGVGQVNATDEIKREIIHQLSIKPMAHSELVKSLPEDENKETGMESVIEAVAHFKKPGLTGRGMYELKPECAKEFNLYFYHFSRAEQSKAEEAQRKLKRQNREDTALPPPVLPPFCPLFASLVNILQSDVMLCIMGTILQWAVEHNGYAWSESMLQRVLHLIGMALQEEKQHLENVTEEHVVTFTFTQKISKPGEAPKNSPSILAMLETLQNAPYLEVHKDMIRWILKTFNAVKKMRESSPTSPVAETEGTIMEESSRDKDKAERKRKAEIARLRREKIMAQMSEMQRHFIDENKELFQQTLELDASTSAVLDHSPVASDMTLTALGPAQTQVPEQRQFVTCILCQEEQEVKVESRAMVLAAFVQRSTVLSKNRSKFIQDPEKYDPLFMHPDLSCGTHTSSCGHIMHAHCWQRYFDSVQAKEQRRQQRLRLHTSYDVENGEFLCPLCECLSNTVIPLLLPPRNIFNNRLNFSDQPNLTQWIRTISQQIKALQFLRKEESTPNNASTKNSENVDELQLPEGFRPDFRPKIPYSESIKEMLTTFGTATYKVGLKVHPNEEDPRVPIMCWGSCAYTIQSIERILSDEDKPLFGPLPCRLDDCLRSLTRFAAAHWTVASVSVVQGHFCKLFASLVPNDSHEELPCILDIDMFHLLVGLVLAFPALQCQDFSGISLGTGDLHIFHLVTMAHIIQILLTSCTEENGMDQENPPCEEESAVLALYKTLHQYTGSALKEIPSGWHLWRSVRAGIMPFLKCSALFFHYLNGVPSPPDIQVPGTSHFEHLCSYLSLPNNLICLFQENSEIMNSLIESWCRNSEVKRYLEGERDAIRYPRESNKLINLPEDYSSLINQASNFSCPKSGGDKSRAPTLCLVCGSLLCSQSYCCQTELEGEDVGACTAHTYSCGSGVGIFLRVRECQVLFLAGKTKGCFYSPPYLDDYGETDQGLRRGNPLHLCKERFKKIQKLWHQHSVTEEIGHAQEANQTLVGIDWQHL

SEQ ID NO: 5154 - protein, 1888 aa, unidentified
MAAAAAAAVGGQQPSQPELPAPGLALDKAATAAHLKAALSRPDNRAGAEELQALLERVLSAERPLAAAAGGEDAAAAGGGGGPGAAEEEALEWCKCLLAGGGGYDEFCAAVRAYDPAALCGLVWTANFVAYRCRTCGISPCMSLCAECFHQGDHTGHDFNMFRSQAGGACDCGDSNVMRESGFCKRHQIKSSSNIPCVPKDLLMMSEFVLPRFIFCLIQYLREGYNEPAADGPSEKDLNKVLQLLEPQISFLEDLTKMGGAMRSVLTQVLTNQQNYKDLTSGLGENACVKKSHEKYLIALKSSGLTYPEDKLVYGVQEPSAGTSSLAVQGFIGATGTLGQVDSSDEDDQDGSQGLGKRKRVKLSSGTKDQSIMDVLKHKSFLEELLFWTIKYEFPQKMVTFLLNMLPDQEYKVAFTKTFVQHYAFIMKTLKKSHESDTMSNRIVHISVQLFSNEELARQVTEECQLLDIMVTVLLYMMESCLIKSELQDEENSLHVVVNCGEALLKNNTYWPLVSDFINILSHQSVAKRFLEDHGLLVTWMNFVSFFQGMNLNKRELNEHVEFESQTYYAAFAAELEACAQPMWGLLSHCKVRETQEYTRNVVRYCLEALQDWFDAINFVDEPAPNQVTFHLPLHRYYAMFLSKAVKCQELDLDSVLPDQEMLMKLMIHPLQIQASLAEIHSNMWVRNGLQIKGQAMTYVQSHFCNSMIDPDIYLLQVCASRLDPDYFISSVFERFKVVDLLTMASQHQNTVLDAEHERSMLEGALTFLVILLSLRLHLGMSDDEILRAEMVAQLCMNDRTHSSLLDLIPENPNPKSGIIPGSYSFESVLSAVADFKAPVFEPGGSMQQGMYTPKAEVWDQEFDPVMVILRTVYRRDVQSAMDRYTAFLKQSGKFPGNPWPPYKKRTSLHPSYKGLMRLLHCKTLHIVLFTLLYKILMDHQNLSEHVLCMVLYLIELGLENSAEEESDEEASVGGPERCHDSWFPGSNLVSNMRHFINYVRVRVPETAPEVKRDSPASTSSDNLGSLQNSGTAQVFSLVAERRKKFQEIINRSSSEANQVVRPKTSSKWSAPGSAPQLTTAILEIKESILSLLIKLHHKLSGKQNSYYPPWLDDIEILIQPEIPKYSHGDGITAVERILLKAASQSRMNKRIIEEICRKVTPPVPPKKVTAAEKKTLDKEERRQKARERQQKLLAEFASRQKSFMETAMDVDSPENDIPMEITTAEPQVSEAVYDCVICGQSGPSSEDRPTGLVVLLQASSVLGQCRDNVEPKKLPISEEEQIYPWDTCAAVHDVRLSLLQRYFKDSSCLLAVSIGWEGGVYVQTCGHTLHIDCHKSYMESLRNDQVLQGFSVDKGEFTCPLCRQFANSVLPCYPGSNVENNPWQRPSNKSIQDLIKEVEELQGRPGAFPSETNLSKEMESVMKDIKNTTQKKYRDYSKTPGSPDNDFLFMYSVARTNLELELIHRGGNLCSGGASTAGKRSCLNQLFHVLALHMRLYSIDSEYNPWRKLTQLEEMNPQLGYEEQQPEVPILYHDVTSLLLIQILMMPQPLRKDHFTCIVKVLFTLLYTQALAALSVKCSEEDRSAWKHAGALKKSTCDAEKSYEVLLSFVISELFKGKLYHEEGTQECAMVNPIAWSPESMEKCLQDFCLPFLRITSLLQHHLFGEDLPSCQEEEEFSVLASCLGLLPTFYQTEHPFISASCLDWPVPAFDIITQWCFEIKSFTERHAEQGKALLIQESKWKLPHLLQLPENYNTIFQYYHRKTCSVCTKVPKDPAVCLVCGTFVCLKGLCCKQQSYCECVLHSQNCGAGTGIFLLINASVIIIIRGHRFCLWGSVYLDAHGEEDRDLRRGKPLYICKERYKVLEQQWISHTFDHINKRWGPHYNGL

SEQ ID NO: 5155 - protein, 5183 aa, unidentified
MATSGGEEAAAAAPAPGTPATGADTTPGWEVAVRPLLSASYSAFEMKELPQLVASVIESESEILHHEKQYEPFYSSFVALSTHYITTVCSLIPRNQLQSVAAACKVLIEFSLLRLENPDEACAVSQKHLILLIKGLCTGCSRLDRTEIITFTAMMKSAKLPQTVKTLSDVEDQKELASPVSPELRQKEVQMNFLNQLTSVFNPRTVASQPISTQTLVEGENDEQSSTDQASAIKTKNVFIAQNVASLQELGGSEKLLRVCLNLPYFLRYINRFQDAVLANSFFIMPATVADATAVRNGFHSLVIDVTMALDTLSLPVLEPLNPSRLQDVTVLSLSCLYAGVSVATCMAILHVGSAQQVRTGSTSSKEDDYESDAATIVQKCLEIYDMIGQAISSSRRAGGEHYQNFQLLGAWCLLNSLFLILNLSPTALADKGKEKDPLAALRVRDILSRTKEGVGSPKLGPGKGHQGFGVLSVILANHAIKLLTSLFQDLQVEALHKGWETDGPPAALSIMAQSTSIQRIQRLIDSVPLMNLLLTLLSTSYRKACVLQRQRKGSMSSDASASTDSNTYYEDDFSSTEEDSSQDDDSEPILGQWFEETISPSKEKAAPPPPPPPPPLESSPRVKSPSKQAPGEKGNILASRKDPELFLGLASNILNFITSSMLNSRNNFIRNYLSVSLSEHHMATLASIIKEVDKDGLKGSSDEEFAAALYHFNHSLVTSDLQSPNLQNTLLQQLGVAPFSEGPWPLYIHPQSLSVLSRLLLIWQHKASAQGDPDVPECLKVWDRFLSTMKQNALQGVVPSETEDLNVEHLQMLLLIFHNFTETGRRAILSLFVQIIQELSVNMDAQMRFVPLILARLLLIFDYLLHQYSKAPVYLFEQVQHNLLSPPFGWASGSQDSNSRRATTPLYHGFKEVEENWSKHFSSDAVPHPRFYCVLSPEASEDDLNRLDSVACDVLFSKLVKYDELYAALTALLAAGSQLDTVRRKENKNVTALEACALQYYFLILWRILGILPPSKTYINQLSMNSPEMSECDILHTLRWSSRLRISSYVNWIKDHLIKQGMKAEHASSLLELASTTKCSSVKYDVEIVEEYFARQISSFCSIDCTTILQLHEIPSLQSIYTLDAAISKVQVSLDEHFSKMAAETDPHKSSEITKNLLPATLQLIDTYASFTRAYLLQNFNEEGTTEKPSKEKLQGFAAVLAIGSSRCKANTLGPTLVQNLPSSVQTVCESWNNINTNEFPNIGSWRNAFANDTIPSESYISAVQAAHLGTLCSQSLPLAASLKHTLLSLVRLTGDLIVWSDEMNPPQVIRTLLPLLLESSTESVAEISSNSLERILGPAESDEFLARVYEKLITGCYNILANHADPNSGLDESILEECLQYLEKQLESSQARKAMEEFFSDSGELVQIMMATANENLSAKFCNRVLKFFTKLFQLTEKSPNPSLLHLCGSLAQLACVEPVRLQAWLTRMTTSPPKDSDQLDVIQENRQLLQLLTTYIVRENSQVGEGVCAVLLGTLTPMATEMLANGDGTGFPELMVVMATLASAGQGAGHLQLHNAAVDWLSRCKKYLSQKNVVEKLNANVMHGKHVMILECTCHIMSYLADVTNALSQSNGQGPSHLSVDGEERAIEVDSDWVEELAVEEEDSQAEDSDEDSLCNKLCTFTITQKEFMNQHWYHCHTCKMVDGVGVCTVCAKVCHKDHEISYAKYGSFFCDCGAKEDGSCLALVKRTPSSGMSSTMKESAFQSEPRISESLVRHASTSSPADKAKVTISDGKVADEEKPKKSSLCRTVEGCREELQNQANFSFAPLVLDMLNFLMDAIQTNFQQASAVGSSSRAQQALSELHTVEKAVEMTDQLMVPTLGSQEGAFENVRMNYSGDQGQTIRQLISAHVLRRVAMCVLSSPHGRRQHLAVSHEKGKITVLQLSALLKQADSSKRKLTLTRLASAPVPFTVLSLTGNPCKEDYLAVCGLKDCHVLTFSSSGSVSDHLVLHPQLATGNFIIKAVWLPGSQTELAIVTADFVKIYDLCVDALSPTFYFLLPSSKIRDVTFLFNEEGKNIIVIMSSAGYIYTQLMEEASSAQQGPFYVTNVLEINHEDLKDSNSQVAGGGVSVYYSHVLQMLFFSYCQGKSFAATISRTTLEVLQLFPINIKSSNGGSKTSPALCQWSEVMNHPGLVCCVQQTTGVPLVVMVKPDTFLIQEIKTLPAKAKIQDMVAIRHTACNEQQRTTMILLCEDGSLRIYMANVENTSYWLQPSLQPSSVISIMKPVRKRKTATITTRTSSQVTFPIDFFEHNQQLTDVEFGGNDLLQVYNAQQIKHRLNSTGMYVANTKPGGFTIEISNNNSTMVMTGMRIQIGTQAIERAPSYIEIFGRTMQLNLSRSRWFDFPFTREEALQADKKLNLFIGASVDPAGVTMIDAVKIYGKTKEQFGWPDEPPEEFPSASVSNICPSNLNQSNGTGDSDSAAPTTTSGTVLERLVVSSLEALESCFAVGPIIEKERNKNAAQELATLLLSLPAPASVQQQSKSLLASLHTSRSAYHSHKDQALLSKAVQCLNTSSKEGKDLDPEVFQRLVITARSIAIMRPNNLVHFTESKLPQMETEGMDEGKEPQKQLEGDCCSFITQLVNHFWKLHASKPKNAFLAPACLPGLTHIEATVNALVDIIHGYCTCELDCINTASKIYMQMLLCPDPAVSFSCKQALIRVLRPRNKRRHVTLPSSPRSNTPMGDKDDDDDDDADEKMQSSGIPNGGHIRQESQEQSEVDHGDFEMVSESMVLETAENVNNGNPSPLEALLAGAEGFPPMLDIPPDADDETMVELAIALSLQQDQQGSSSSALGLQSLGLSGQAPSSSSLDAGTLSDTTASAPASDDEGSTAATDGSTLRTSPADHGGSVGSESGGSAVDSVAGEHSVSGRSSAYGDATAEGHPAGPGSVSSSTGAISTTTGHQEGDGSEGEGEGETEGDVHTSNRLHMVRLMLLERLLQTLPQLRNVGGVRAIPYMQVILMLTTDLDGEDEKDKGALDNLLSQLIAELGMDKKDVSKKNERSALNEVHLVVMRLLSVFMSRTKSGSKSSICESSSLISSATAAALLSSGAVDYCLHVLKSLLEYWKSQQNDEEPVATSQLLKPHTTSSPPDMSPFFLRQYVKGHAADVFEAYTQLLTEMVLRLPYQIKKITDTNSRIPPPVFDHSWFYFLSEYLMIQQTPFVRRQVRKLLLFICGSKEKYRQLRDLHTLDSHVRGIKKLLEEQGIFLRASVVTASSGSALQYDTLISLMEHLKACAEIAAQRTINWQKFCIKDDSVLYFLLQVSFLVDEGVSPVLLQLLSCALCGSKVLAALAASSGSSSASSSSAPVAASSGQATTQSKSSTKKSKKEEKEKEKDGETSGSQEDQLCTALVNQLNKFADKETLIQFLRCFLLESNSSSVRWQAHCLTLHIYRNSSKSQQELLLDLMWSIWPELPAYGRKAAQFVDLLGYFSLKTPQTEKKLKEYSQKAVEILRTQNHILTNHPNSNIYNTLSGLVEFDGYYLESDPCLVCNNPEVPFCYIKLSSIKVDTRYTTTQQVVKLIGSHTISKVTVKIGDLKRTKMVRTINLYYNNRTVQAIVELKNKPARWHKAKKVQLTPGQTEVKIDLPLPIVASNLMIEFADFYENYQASTETLQCPRCSASVPANPGVCGNCGENVYQCHKCRSINYDEKDPFLCNACGFCKYARFDFMLYAKPCCAVDPIENEEDRKKAVSNINTLLDKADRVYHQLMGHRPQLENLLCKVNEAAPEKPQDDSGTAGGISSTSASVNRYILQLAQEYCGDCKNSFDELSKIIQKVFASRKELLEYDLQQREAATKSSRTSVQPTFTASQYRALSVLGCGHTSSTKCYGCASAVTEHCITLLRALATNPALRHILVSQGLIRELFDYNLRRGAAAMREEVRQLMCLLTRDNPEATQQMNDLIIGKVSTALKGHWANPDLASSLQYEMLLLTDSISKEDSCWELRLRCALSLFLMAVNIKTPVVVENITLMCLRILQKLIKPPAPTSKKNKDVPVEALTTVKPYCNEIHAQAQLWLKRDPKASYDAWKKCLPIRGIDGNGKAPSKSELRHLYLTEKYVWRWKQFLSRRGKRTSPLDLKLGHNNWLRQVLFTPATQAARQAACTIVEALATIPSRKQQVLDLLTSYLDELSIAGECAAEYLALYQKLITSAHWKVYLAARGVLPYVGNLITKEIARLLALEEATLSTDLQQGYALKSLTGLLSSFVEVESIKRHFKSRLVGTVLNGYLCLRKLVVQRTKLIDETQDMLLEMLEDMTTGTESETKAFMAVCIETAKRYNLDDYRTPVFIFERLCSIIYPEENEVTEFFVTLEKDPQQEDFLQGRMPGNPYSSNEPGIGPLMRDIKNKICQDCDLVALLEDDSGMELLVNNKIISLDLPVAEVYKKVWCTTNEGEPMRIVYRMRGLLGDATEEFIESLDSTTDEEEDEEEVYKMAGVMAQCGGLECMLNRLAGIRDFKQGRHLLTVLLKLFSYCVKVKVNRQQLVKLEMNTLNVMLGTLNLALVAEQESKDSGGAAVAEQVLSIMEIILDESNAEPLSEDKGNLLLTGDKDQLVMLLDQINSTFVRSNPSVLQGLLRIIPYLSFGEVEKMQILVERFKPYCNFDKYDEDHSGDDKVFLDCFCKIAAGIKNNSNGHQLKDLILQKGITQNALDYMKKHIPSAKNLDADIWKKFLSRPALPFILRLLRGLAIQHPGTQVLIGTDSIPNLHKLEQVSSDEGIGTLAENLLEALREHPDVNKKIDAARRETRAEKKRMAMAMRQKALGTLGMTTNEKGQVVTKTALLKQMEELIEEPGLTCCICREGYKFQPTKVLGIYTFTKRVALEEMENKPRKQQGYSTVSHFNIVHYDCHLAAVRLARGREEWESAALQNANTKCNGLLPVWGPHVPESAFATCLARHNTYLQECTGQREPTYQLNIHDIKLLFLRFAMEQSFSADTGGGGRESNIHLIPYIIHTVLYVLNTTRATSREEKNLQGFLEQPKEKWVESAFEVDGPYYFTVLALHILPPEQWRATRVEILRRLLVTSQARAVAPGGATRLTDKAVKDYSAYRSSLLFWALVDLIYNMFKKVPTSNTEGGWSCSLAEYIRHNDMPIYEAADKALKTFQEEFMPVETFSEFLDVAGLLSEITDPESFLKDLLNSVP

SEQ ID NO: 5156 - protein, 508 aa, unidentified
MLWFQGAIPAAIATAKRSGAVFVVFVAGDDEQSTQMAASWEDDKVTEASSNSFVAIKIDTKSEACLQFSQIYPVVCVPSSFFIGDSGIPLEVIAGSVSADELVTRIHKVRQMHLLKSETSVANGSQSESSVSTPSASFEPNNTCENSQSRNAELCEIPPTSDTKSDTATGGESAGHATSSQEPSGCSDQRPAEDLNIRVERLTKKLEERREEKRKEEEQREIKKEIERRKTGKEMLDYKRKQEEELTKRMLEERNREKAEDRAARERIKQQIALDRAERAARFAKTKEEVEAAKAAALLAKQAEMEVKRESYARERSTVARIQFRLPDGSSFTNQFPSDAPLEEARQFAAQTVGNTYGNFSLATMFPRREFTKEDYKKKLLDLELAPSASVVLLPAGRPTASIVHSSSGDIWTLLGTVLYPFLAIWRLISNFLFSNPPPTQTSVRVTSSEPPNPASSSKSEKREPVRKRVLEKRGDDFKKEGKIYRLRTQDDGEDENNTWNGNSTQQM

SEQ ID NO: 5157 - protein, 307 aa, unidentified
MGGLTASDVHPTLGVQLFSAGIAACLADVITFPLDTAKVRLQVQGECPTSSVIRYKGVLGTITAVVKTEGRMKLYSGLPAGLQRQISSASLRIGLYDTVQEFLTAGKETAPSLGSKILAGLTTGGVAVFIGQPTEVVKVRLQAQSHLHGIKPRYTGTYNAYRIIATTEGLTGLWKGTTPNLMRSVIINCTELVTYDLMKEAFVKNNILADDVPCHLVSALIAGFCATAMSSPVDVVKTRFINSPPGQYKSVPNCAMKVFTNEGPTAFFKGLVPSFLRLGSWNVIMFVCFEQLKRELSKSRQTMDCAT

SEQ ID NO: 5158 - protein, 394 aa, unidentified
MALLDLALEGMAVFGFVLFLVLWLMHFMAIIYTRLHLNKKATDKQPYSKLPGVSLLKPLKGVDPNLINNLETFFELDYPKYEVLLCVQDHDDPAIDVCKKLLGKYPNVDARLFIGGKKVGINPKINNLMPGYEVAKYDLIWICDSGIRVIPDTLTDMVNQMTEKVGLVHGLPYVADRQGFAATLEQVYFGTSHPRYYISANVTGFKCVTGMSCLMRKDVLDQAGGLIAFAQYIAEDYFMAKAIADRGWRFAMSTQVAMQNSGSYSISQFQSRMIRWTKLRINMLPATIICEPISECFVASLIIGWAAHHVFRWDIMVFFMCHCLAWFIFDYIQLRGVQGGTLCFSKLDYAVAWFIRESMTIYIFLSALWDPTISWRTGRYRLRCGGTAEEILDV

SEQ ID NO: 5159 - protein, 533 aa, unidentified
MAVESQGGRPLVLGLLLCVLGPVVSHAGKILLIPVDGSHWLSMLGAIQQLQQRGHEIVVLAPDASLYIRDGAFYTLKTYPVPFQREDVKESFVSLGHNVFENDSFLQRVIKTYKKIKKDSAMLLSGCSHLLHNKELMASLAESSFDVMLTDPFLPCSPIVAQYLSLPTVFFLHALPCSLEFEATQCPNPFSYVPRPLSSHSDHMTFLQRVKNMLIAFSQNFLCDVVYSPYATLASEFLQREVTVQDLLSSASVWLFRSDFVKDYPRPIMPNMVFVGGINCLHQNPLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 5160 - protein, 530 aa, unidentified
MARAGWTSPVPLCVCLLLTCGFAEAGKLLVVPMDGSHWFTMQSVVEKLILRGHEVVVVMPEVSWQLERSLNCTVKTYSTSYTLEDQNREFMVFAHAQWKAQAQSIFSLLMSSSSGFLDLFFSHCRSLFNDRKLVEYLKESSFDAVFLDPFDTCGLIVAKYFSLPSVVFTRGIFCHHLEEGAQCPAPLSYVPNDLLGFSDAMTFKERVWNHIVHLEDHLFCQYLFRNALEIASEILQTPVTAYDLYSHTSIWLLRTDFVLDYPKPVMPNMIFIGGINCHQGKPLPMEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 5161 - protein, 534 aa, unidentified
MATGLQVPLPWLATGLLLLLSVQPWAESGKVLVVPIDGSHWLSMREVLRELHARGHQAVVLTPEVNMHIKEENFFTLTTYAISWTQDEFDRHVLGHTQLYFETEHFLKKFFRSMAMLNNMSLVYHRSCVELLHNEALIRHLNATSFDVVLTDPVNLCAAVLAKYLSIPTVFFLRNIPCDLDFKGTQCPNPSSYIPRLLTTNSDHMTFMQRVKNMLYPLALSYICHAFSAPYASLASELFQREVSVVDILSHASVWLFRGDFVMDYPRPIMPNMVFIGGINCANRKPLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 5162 - protein, 534 aa, unidentified
MARGLQVPLPRLATGLLLLLSVQPWAESGKVLVVPTDGSPWLSMREALRELHARGHQAVVLTPEVNMHIKEEKFFTLTAYAVPWTQKEFDRVTLGYTQGFFETEHLLKRYSRSMAIMNNVSLALHRCCVELLHNEALIRHLNATSFDVVLTDPVNLCGAVLAKYLSIPAVFFWRYIPCDLDFKGTQCPNPSSYIPKLLTTNSDHMTFLQRVKNMLYPLALSYICHTFSAPYASLASELFQREVSVVDLVSYASVWLFRGDFVMDYPRPIMPNMVFIGGINCANGKPLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 5163 - protein, 534 aa, unidentified
MATGLQVPLPQLATGLLLLLSVQPWAESGKVLVVPTDGSHWLSMREALRDLHARGHQVVVLTLEVNMYIKEENFFTLTTYAISWTQDEFDRLLLGHTQSFFETEHLLMKFSRRMAIMNNMSLIIHRSCVELLHNEALIRHLHATSFDVVLTDPFHLCAAVLAKYLSIPAVFFLRNIPCDLDFKGTQCPNPSSYIPRLLTTNSDHMTFLQRVKNMLYPLALSYLCHAVSAPYASLASELFQREVSVVDLVSHASVWLFRGDFVMDYPRPIMPNMVFIGGINCANGKPLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 5164 - protein, 532 aa, unidentified
MACLLRSFQRISAGVFFLALWGMVVGDKLLVVPQDGSHWLSMKDIVEVLSDRGHEIVVVVPEVNLLLKESKYYTRKIYPVPYDQEELKNRYQSFGNNHFAERSFLTAPQTEYRNNMIVIGLYFINCQSLLQDRDTLNFFKESKFDALFTDPALPCGVILAEYLGLPSVYLFRGFPCSLEHTFSRSPDPVSYIPRCYTKFSDHMTFSQRVANFLVNLLEPYLFYCLFSKYEELASAVLKRDVDIITLYQKVSVWLLRYDFVLEYPRPVMPNMVFIGGINCKKRKDLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 5165 - protein, 530 aa, unidentified
MARAGWTGLLPLYVCLLLTCGFAKAGKLLVVPMDGSHWFTMQSVVEKLILRGHEVVVVMPEVSWQLGRSLNCTVKTYSTSYTLEDQDREFMVFADARWTAPLRSAFSLLTSSSNGIFDLFFSNCRSLFNDRKLVEYLKESCFDAVFLDPFDACGLIVAKYFSLPSVVFARGIFCHYLEEGAQCPAPLSYVPRLLLGFSDAMTFKERVWNHIMHLEEHLFCPYFFKNVLEIASEILQTPVTAYDLYSHTSIWLLRTDFVLEYPKPVMPNMIFIGGINCHQGKPVPMEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 5166 - protein, 530 aa, unidentified
MARTGWTSPIPLCVSLLLTCGFAEAGKLLVVPMDGSHWFTMQSVVEKLILRGHEVVVVMPEVSWQLGKSLNCTVKTYSTSYTLEDLDREFMDFADAQWKAQVRSLFSLFLSSSNGFFNLFFSHCRSLFNDRKLVEYLKESSFDAVFLDPFDACGLIVAKYFSLPSVVFARGIACHYLEEGAQCPAPLSYVPRILLGFSDAMTFKERVRNHIMHLEEHLFCQYFSKNALEIASEILQTPVTAYDLYSHTSIWLLRTDFVLDYPKPVMPNMIFIGGINCHQGKPLPMEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 5167 - protein, 530 aa, unidentified
MACTGWTSPLPLCVCLLLTCGFAEAGKLLVVPMDGSHWFTMRSVVEKLILRGHEVVVVMPEVSWQLGRSLNCTVKTYSTSYTLEDLDREFKAFAHAQWKAQVRSIYSLLMGSYNDIFDLFFSNCRSLFKDKKLVEYLKESSFDAVFLDPFDNCGLIVAKYFSLPSVVFARGILCHYLEEGAQCPAPLSYVPRILLGFSDAMTFKERVRNHIMHLEEHLLCHRFFKNALEIASEILQTPVTEYDLYSHTSIWLLRTDFVLDYPKPVMPNMIFIGGINCHQGKPLPMEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 5168 - protein, 527 aa, unidentified
MLNNLLLFSLQISLIGTTLGGNVLIWPMEGSHWLNVKIIIDELIKKEHNVTVLVASGALFITPTSNPSLTFEIYRVPFGKERIEGVIKDFVLTWLENRPSPSTIWRFYQEMAKVIKDFHMVSQEICDGVLKNQQLMAKLKKSKFEVLVSDPVFPCGDIVALKLGIPFMYSLRFSPASTVEKHCGKVPYPPSYVPAVLSELTDQMSFTDRIRNFISYHLQDYMFETLWKSWDSYYSKALGRPTTLCETMGKAEIWLIRTYWDFEFPRPYLPNFEFVGGLHCKPAKPLPKEMEEFIQSSGKNGVVVFSLGSMVKNLTEEKANLIASALAQIPQKVLWRYKGKKPATLGNNTQLFDWIPQNDLLGHPKTKAFITHGGTNGIYEAIYHGVPMVGVPMFADQPDNIAHMKAKGAAVEVNLNTMTSVDLLSALRTVINEPSYKENAMRLSRIHHDQPVKPLDRAVFWIEFVMRHKGAKHLRVAAHDLTWFQYHSLDVIGFLLVCVTTAIFLVIQCCLFSCQKFGKIGKKKKRE

SEQ ID NO: 5169 - protein, 527 aa, unidentified; identical to SEQ ID NO: 5168

SEQ ID NO: 5170 - protein, 527 aa, unidentified
MRSDKSALVFLLLQLFCVGCGFCGKVLVWPCDMSHWLNVKVILEELIVRGHEVTVLTHSKPSLIDYRKPSALKFEVVHMPQDRTEENEIFVDLALNVLPGLSTWQSVIKLNDFFVEIRGTLKMMCESFIYNQTLMKKLQETNYDVMLIDPVIPCGDLMAELLAVPFVLTLRISVGGNMERSCGKLPAPLSYVPVPMTGLTDRMTFLERVKNSMLSVLFHFWIQDYDYHFWEEFYSKALGRPTTLCETVGKAEIWLIRTYWDFEFPQPYQPNFEFVGGLHCKPAKALPKEMENFVQSSGEDGIVVFSLGSLFQNVTEEKANIIASALAQIPQKVLWRYKGKKPSTLGANTRLYDWIPQNDLLGHPKTKAFITHGGMNGIYEAIYHGVPMVGVPIFGDQLDNIAHMKAKGAAVEINFKTMTSEDLLRALRTVITDSSYKENAMRLSRIHHDQPVKPLDRAVFWIEFVMRHKGAKHLRSAAHDLTWFQHYSIDVIGFLLACVATAIFLFTKCFLFSCQKFNKTRKIEKRE

SEQ ID NO: 5171 - protein, 528 aa, unidentified
MALKWTTVLLIQLSFYFSSGSCGKVLVWAAEYSLWMNMKTILKELVQRGHEVTVLASSASILFDPNDSSTLKLEVYPTSLTKTEFENIIMQLVKRLSEIQKDTFWLPFSQEQEILWAINDIIRNFCKDVVSNKKLMKKLQESRFDIVFADAYLPCGELLAELFNIPFVYSHSFSPGYSFERHSGGFIFPPSYVPVVMSKLSDQMTFMERVKNMLYVLYFDFWFQIFNMKKWDQFYSEVLGRPTTLSETMRKADIWLMRNSWNFKFPHPFLPNVDFVGGLHCKPAKPLPKEMEEFVQSSGENGVVVFSLGSMVSNMTEERANVIATALAKIPQKVLWRFDGNKPDALGLNTRLYKWIPQNDLLGHPKTRAFITHGGANGIYEAIYHGIPMVGIPLFFDQPDNIAHMKAKGAAVRVDFNTMSSTDLLNALKTVINDPSYKENIMKLSRIQHDQPVKPLDRAVFWIEFVMRHKGAKHLRVAAHNLTWFQYHSLDVIGFLLACVATVLFIITKCCLFCFWKFARKGKKGKRD

SEQ ID NO: 5172 - protein, 529 aa, unidentified
MTLKWTSVLLLIHLSCYFSSGSCGKVLVWAAEYSHWMNMKTILKELVQRGHEVTVLASSASILFDPNDASTLKFEVYPTSLTKTEFENIIMQQVKRWSDIRKDSFWLYFSQEQEILWELYDIFRNFCKDVVSNKKVMKKLQESRFDIVFADAVFPCGELLAALLNIRFVYSLRFTPGYTIERHSGGLIFPPSYIPIVMSKLSDQMTFMERVKNMIYVLYFDFWFQMSDMKKWDQFYSEVLGRPTTLFETMGKADIWLMRNSWSFQFPHPFLPNVDFVGGFHCKPAKPLPKEMEEFVQSSGENGVVVFSLGSVISNMTAERANVIATALAKIPQKVLWRFDGNKPDALGLNTRLYKWIPQNDLLGHPKTRAFITHGGANGIYEAIYHGIPMVGIPLFFDQPDNIAHMKAKGAAVRLDFNTMSSTDLLNALKTVINDPLYKENIMKLSRIQHDQPVKPLDRAVFWIEFVMPHKGAKHLRVAAHDLTWFQYHSLDVIGFLLACVATVIFIITKFCLFCFWKFARKGKKGKRD

SEQ ID NO: 5173 - protein, 530 aa, unidentified
MSLKWTSVFLLIQLSCYFSSGSCGKVLVWPTEYSHWINMKTILEELVQRGHEVTVLTSSASTLVNASKSSAIKLEVYPTSLTKNYLEDSLLKILDRWIYGVSKNTFWSYFSQLQELCWEYYDYSNKLCKDAVLNKKLMMKLQESKFDVILADALNPCGELLAELFNIPFLYSLRFSVGYTFEKNGGGFLFPPSYVPVVMSELSDQMIFMERIKNMIHMLYFDFWFQIYDLKKWDQFYSEVLGRPTTLFETMGKAEMWLIRTYWDFEFPRPFLPNVDFVGGLHCKPAKPLPKEMEEFVQSSGENGIVVFSLGSMISNMSEESANMIASALAQIPQKVLWRFDGKKPNTLGSNTRLYKWLPQNDLLGHPKTKAFITHGGTNGIYEAIYHGIPMVGIPLFADQHDNIAHMKAKGAALSVDIRTMSSRDLLNALKSVINDPVYKENVMKLSRIHHDQPMKPLDRAVFWIEFVMRHKGAKHLRVAAHNLTWIQYHSLDVIAFLLACVATVIFIITKFCLFCFRKLAKKGKKKKRD

SEQ ID NO: 5174 - protein, 530 aa, unidentified
MSLKWMSVFLLMQLSCYFSSGSCGKVLVWPTEYSHWINMKTILEELVQRGHEVIVLTSSASILVNASKSSAIKLEVYPTSLTKNDLEDFFMKMFDRWTYSISKNTFWSYFSQLQELCWEYSDYNIKLCEDAVLNKKLMRKLQESKFDVLLADAVNPCGELLAELLNIPFLYSLRFSVGYTVEKNGGGFLFPPSYVPVVMSELSDQMIFMERIKNMIYMLYFDFWFQAYDLKKWDQFYSEVLGRPTTLFETMGKAEMWLIRTYWDFEFPRPFLPNVDFVGGLHCKPAKPLPKEMEEFVQSSGENGIVVFSLGSMISNMSEESANMIASALAQIPQKVLWRFDGKKPNTLGSNTRLYKWLPQNDLLGHPKTKAFITHGGTNGIYEAIYHGIPMVGIPLFADQHDNIAHMKAKGAALSVDIRTMSSRDLLNALKSVINDPIYKENIMKLSRIHHDQPVKPLDRAVFWIEFVMRHKGAKHLRVAAHNLTWIQYHSLDVIAFLLACVATMIFMITKCCLFCFRKLAKTGKKKKRD

SEQ ID NO: 5175 - protein, 529 aa, unidentified
MALKWTSVLLLIHLGCYFSSGSCGKVLVWTGEYSHWMNMKTILKELVQRGHEVTVLASSASILFDPNDAFTLKLEVYPTSLTKTEFENIIMQQVKRWSDIQKDSFWLYFSQEQEILWEFHDIFRNFCKDVVSNKKVMKKLQESRFDIIFADAFFPCGELLAALLNIPFVYSLCFTPGYTIERHSGGLIFPPSYIPVVMSKLSDQMTFMERVKNMIYVLYFDFWFQMCDMKKWDQFYSEVLGRPTTLFETMGKADIWLMRNSWSFQFPHPFLPNIDFVGGLHCKPAKPLPKEMEEFVQSSGENGVVVFSLGSVISNMTAERANVIATALAKIPQKVLWRFDGNKPDALGLNTRLYKWIPQNDLLGLPKTRAFITHGGANGIYEAIYHGIPMVGIPLFWDQPDNIAHMKAKGAAVRLDFHTMSSTDLLNALKTVINDPSYKENVMKLSIIQHDQPVKPLHRAVFWIEFVMCHKGAKHLRVAARDLTWFQYHSLDVIGFLLACVATVIFVVTKFCLFCFWKFARKGKKGKRD

SEQ ID NO: 5176 - protein, 528 aa, unidentified
MSMKWTSALLLIQLSCYFSSGSCGKVLVWPTEFSHWMNIKTILDELVQRGHEVTVLASSASISFDPNSPSTLKFEVYPVSLTKTEFEDIIKQLVKRWAELPKDTFWSYFSQVQEIMWTFNDILRKFCKDIVSNKKLMKKLQESRFDVVLADAVFPFGELLAELLKIPFVYSLRFSPGYAIEKHSGGLLFPPSYVPVVMSELSDQMTFIERVKNMIYVLYFEFWFQIFDMKKWDQFYSEVLGRPTTLSETMAKADIWLIRNYWDFQFPHPLLPNVEFVGGLHCKPAKPLPKEMEEFVQSSGENGVVVFSLGSMVSNTSEERANVIASALAKIPQKVLWRFDGNKPDTLGLNTRLYKWIPQNDLLGHPKTRAFITHGGANGIYEAIYHGIPMVGVPLFADQPDNIAHMKAKGAAVSLDFHTMSSTDLLNALKTVINDPLYKENAMKLSRIHHDQPVKPLDRAVFWIEFVMRHKGAKHLRVAAHDLTWFQYHSLDVTGFLLACVATVIFIITKCLFCVWKFVRTGKKGKRD

SEQ ID NO: 5177 - protein, 529 aa, unidentified
MSVKWTSVILLIQLSFCFSSGNCGKVLVWAAEYSHWMNIKTILDELIQRGHEVTVLASSASILFDPNNSSALKIEIYPTSLTKTELENFIMQQIKRWSDLPKDTFWLYFSQVQEIMSIFGDITRKFCKDVVSNKKFMKKVQESRFDVIFADAIFPCSELLAELFNIPFVYSLSFSPGYTFEKHSGGFIFPPSYVPVVMSELTDQMTFMERVKNMIYVLYFDFWFEIFDMKKWDQFYSEVLGRPTTLSETMGKADVWLIRNSWNFQFPYPLLPNVDFVGGLHCKPAKPLPKEMEDFVQSSGENGVVVFSLGSMVSNMTEERANVIASALAQIPQKVLWRFDGNKPDTLGLNTRLYKWIPQNDLLGHPKTRAFITHGGANGIYEAIYHGIPMVGIPLFADQPDNIAHMKARGAAVRVDFNTMSSTDLLNALKRVINDPSYKENVMKLSRIQHDQPVKPLDRAVFWIEFVMRHKGAKHLRVAAHDLTWFQYHSLDVIGFLLVCVATVIFIVTKCCLFCFWKFARKAKKGKND

SEQ ID NO: 5178 - protein, 523 aa, unidentified
MVGQRVLLLVAFLLSGVLLSEAAKILTISTLGGSHYLLLDRVSQILQEHGHNVTMLHQSGKFLIPDIKEEEKSYQVIRWFSPEDHQKRIKKHFDSYIETALDGRKESEALVKLMEIFGTQCSYLLSRKDIMDSLKNENYDLVFVEAFDFCSFLIAEKLVKPFVAILPTTFGSLDFGLPSPLSYVPVFPSLLTDHMDFWGRVKNFLMFFSFSRSQWDMQSTFDNTIKEHFPEGSRPVLSHLLLKAELWFVNSDFAFDFARPLLPNTVYIGGLMEKPIKPVPQDLDNFIANFGDAGFVLVAFGSMLNTHQSQEVLKKMHNAFAHLPQGVIWTCQSSHWPRDVHLATNVKIVDWLPQSDLLAHPSIRLFVTHGGQNSVMEAIRHGVPMVGLPVNGDQHGNMVRVVAKNYGVSIRLNQVTADTLTLTMKQVIEDKRYKSAVVAASVILHSQPLSPAQRLVGWIDHILQTGGATHLKPYAFQQPWHEQYLIDVFVFLLGLTLGTMWLCGKLLGVVARWLRGARKVKKT

SEQ ID NO: 5179 - protein, 523 aa, unidentified
MAGQRVLLLVGFLLPGVLLSEAAKILTISTVGGSHYLLMDRVSQILQDHGHNVTMLNHKRGPFMPDFKKEEKSYQVISWLAPEDHQREFKKSFDFFLEETLGGRGKFENLLNVLEYLALQCSHFLNRKDIMDSLKNENFDMVIVETFDYCPFLIAEKLGKPFVAILSTSFGSLEFGLPIPLSYVPVFRSLLTDHMDFWGRVKNFLMFFSFCRRQQHMQSTFDNTIKEHFTEGSRPVLSHLLLKAELWFINSDFAFDFARPLLPNTVYVGGLMEKPIKPVPQDLENFIAKFGDSGFVLVTLGSMVNTCQNPEIFKEMNNAFAHLPQGVIWKCQCSHWPKDVHLAANVKIVDWLPQSDLLAHPSIRLFVTHGGQNSIMEAIQHGVPMVGIPLFGDQPENMVRVEAKKFGVSIQLKKLKAETLALKMKQIMEDKRYKSAAVAASVILRSHPLSPTQRLVGWIDHVLQTGGATHLKPYVFQQPWHEQYLLDVFVFLLGLTLGTLWLCGKLLGMAVWWLRGARKVKET

SEQ ID NO: 5180 - protein, 541 aa, unidentified
MKSYTPYFILLWSAVGIAKAAKIIIVPPIMFESHMYIFKTLASALHERGHHTVFLLSEGRDIAPSNHYSLQRYPGIFNSTTSDAFLQSKMRNIFSGRLTAIELFDILDHYTKNCDLMVGNHALIQGLKKEKFDLLLVDPNDMCGFVIAHLLGVKYAVFSTGLWYPAEVGAPAPLAYVPEFNSLLTDRMNLLQRMKNTGVYLISRLGVSFLVLPKYERIMQKYNLLPEKSMYDLVHGSSLWMLCTDVALEFPRPTLPNVVYVGGILTKPASPLPEDLQRWVNGANEHGFVLVSFGAGVKYLSEDIANKLAGALGRLPQKVIWRFSGPKPKNLGNNTKLIEWLPQNDLLGHSKIKAFLSHGGLNSIFETIYHGVPVVGIPLFGDHYDTMTRVQAKGMGILLEWKTVTEKELYEALVKVINNPSYRQRAQKLSEIHKDQPGHPVNRTIYWIDYIIRHNGAHHLRAAVHQISFCQYFLLDIAFVLLLGAALLYFLLSWVTKFIYRKIKSLWSRNKHSTVNGHYHNGILNGKYKRNGHIKHEKKVK

SEQ ID NO: 5181 - protein, 244 aa, unidentified
MAAAASPAFLLCLPLLHLLSGWSRAGWVDTHCLCYDFIITPKSRPEPQWCEVQGLVDERPFLHYDCVNHKAKAFASLGKKVNVTKTWEEQTETLRDVVDFLKGQLLDIQVENLIPIEPLTLQARMSCEHEAHGHGRGSWQFLFNGQKFLLFDSNNRKWTALHPGAKKMTEKWEKNRDVTMFFQKISLGDCKMWLEEFLMYWEQMLDPTKPPSLAPGTTQPKAMATTLSPWSLLIIFLCFILAGR

SEQ ID NO: 5182 - protein, 246 aa, unidentified
MAAAAATKILLCLPLLLLLSGWSRAGRADPHSLCYDITVIPKFRPGPRWCAVQGQVDEKTFLHYDCGNKTVTPVSPLGKKLNVTTAWKAQNPVLREVVDILTEQLRDIQLENYTPKEPLTLQARMSCEQKAEGHSSGSWQFSFDGQIFLLFDSEKRMWTTVHPGARKMKEKWENDKVVAMSFHYFSMGDCIGWLEDFLMGMDSTLEPSAGAPLAMSSGTTQLRATATTLILCCLLIILPCFILPGI

SEQ ID NO: 5183 - protein, 1275 aa, unidentified
MENFILYEEIGRGSKTVVYKGRRKGTINFVAILCTDKCKRPEITNWVRLTREIKHKNIVTFHEWYETSNHLWLVVELCTGGSLKTVIAQDENLPEDVVREFGIDLISGLHHLHKLGILFCDISPRKILLEGPGTLKFSNFCLAKVEGENLEEFFALVAAEEGGGDNGENVLKKSMKSRVKGSPVYTAPEVVRGADFSISSDLWSLGCLLYEMFSGKPPFFSESISELTEKILCEDPLPPIPKDSSRPKASSDFINLLDGLLQRDPQKRLTWTRLLQHSFWKKAFAGADQESSVEDLSLSRNTMECSGPQDSKELLQNSQSRQAKGHKSGQPLGHSFRLENPTEFRPKSTLEGQLNESMFLLSSRPTPRTSTAVEVSPGEDMTHCSPQKTSPLTKITSGHLSQQDLESQMRELIYTDSDLVVTPIIDNPKIMKQPPVKFDAKILHLPTYSVDKLLFLKDQDWNDFLQQVCSQIDSTEKSMGASRAKLNLLCYLCVVAGHQEVATRLLHSPLFQLLIQHLRIAPNWDIRAKVAHVIGLLASHTAELQENTPVVEAIVLLTELIRENFRNSKLKQCLLPTLGELIYLVATQEEKKKNPRECWAVPLAAYTVLMRCLREGEERVVNHMAAKIIENVCTTFSAQSQGFITGEIGPILWYLFRHSTADSLRITAVSALCRITRHSPTAFQNVIEKVGLNSVINSLASAICKVQQYMLTLFAAMLSCGIHLQRLIQEKGFVSTIIRLLDSPSTCIRAKAFLVLLYILIYNREMLLLSCQARLVMYIERDSRKTTPGKEQQSGNEYLSKCLDLLICHIVQELPRILGDILNSLANVSGRKHPSTVQVKQLKLCLPLMPVVLHLVTSQVFRPQVVTEEFLFSYGTILSHIKSVDSGETNIDGAIGLTASEEFIKITLSAFEAIIQYPILLKDYRSTVVDYILPPLVSLVQSQNVEWRLFSLRLLSETTSLLVNQEFGDGKEKASVDSDSNLLALIRDVLLPQYEHILLEPDPVPAYALKLLVAMTEHNPTFTRLVEESKLIPLIFEVTLEHQESILGNTMQSVIALLSNLVACKDSNMELLYEQGLVSHICNLLTETATLCLDVDNKNNNEMAAPLLFSLLDILHSMLTYTSGIVRLALQAQKSGSGEDPQAAEDLLLLNRPLTDLISLLIPLLPNEDPEIFDVSSKCLSILVQLYGGENPDSLSPENVEIFAHLLTSKEDPKEQKLLLRILRRMITSNEKHLESLKNAGSLLRALERLAPGSGSFADSAVAPLALEILQAVGH

SEQ ID NO: 5184 - protein, 640 aa, unidentified
MGQPSLTWMLMVVVASWFITTAATDTSEARWCSECHSNATCTEDEAVTTCTCQEGFTGDGLTCVDLDECAIPGAHNCSANSSCVNTPGSFSCVCPEGFRLSPGLGCTDVDECAEPGLSHCHALATCVNVVGSYLCVCPAGYRGDGWHCECSPGSCGPGLDCVPEGDALVCADPCQAHRTLDEYWRSTEYGEGYACDTDLRGWYRFVGQGGARMAETCVPVLRCNTAAPMWLNGTHPSSDEGIVSRKACAHWSGHCCLWDASVQVKACAGGYYVYNLTAPPECHLAYCTDPSSVEGTCEECSIDEDCKSNNGRWHCQCKQDFNITDISLLEHRLECGANDMKVSLGKCQLKSLGFDKVFMYLSDSRCSGFNDRDNRDWVSVVTPARDGPCGTVLTRNETHATYSNTLYLADEIIIRDLNIKINFACSYPLDMKVSLKTALQPMVSALNIRVGGTGMFTVRMALFQTPSYTQPYQGSSVTLSTEAFLYVGTMLDGGDLSRFALLMTNCYATPSSNATDPLKYFIIQDRCPHTRDSTIQVVENGESSQGRFSVQMFRFAGNYDLVYLHCEVYLCDTMNEKCKPTCSGTRFRSGSVIDQSRVLNLGPITRKGVQATVSRAFSSLGLLKVWLPLLLSATLTLTFQ

SEQ ID NO: 5185 - protein, 1318 aa, unidentified
MLRTSGLALLALVSAVGPSQASGFTEKGLSLLGYQLCSHRVTHTVQKVEAVQTSYTSYVSCGGWIPWRRCPKMVYRTQYLVVEVPESRNVTDCCEGYEQLGLYCVLPLNQSGQFTSRPGACPAEGPEPSTSPCSLDIDCPGLEKCCPWSGGRYCMAPAPQAPERDPVGSWYNVTILVKMDFKELQQVDPRLLNHMRLLHSLVTSALQPMASTVHHLHSAPGNASTTVSRLLLGLPRPLPVADVSTLLGDIAKRVYEVISVQVQDVNECFYEELNACSGRELCANLEGSYWCVCHQEAPATSPRKLNLEWEDCPPVSDYVVLNVTSDSFQVSWRLNSTQNHTFHVRVYRGMELLRSARTQSQALAVAGLEAGVLYRVKTSYQGCGADVSTTLTIKTNAQVFEVTIKIVNHNLTEKLLNRSSVEYQDFSRQLLHEVESSFPPVVSDLYRSGKLRMQIVSLQAGSVVVRLKLTVQDPGFPMGISTLAPILQPLLASTVFQIDRQGTRVQDWDECVDSAEHDCSPAAWCINLEGSYTCQCRTTRDATPSRAGRACEGDLVSPMGGGLSAATGVTVPGLGTGTAALGLENFTLSPSPGYPQGTPAAGQAWTPEPSPRRGGSNVVGYDRNNTGKGVEQELQGNSIMEPPSWPSPTEDPTGHFLWHATRSTRETLLNPTWLRNEDSGPSGSVDLPLTSTLTALKTPACVPVSIGRIMVSNVTSTGFHLAWEADLAMDSTFQLTLTSMWSPAVVLETWNTSVTLSGLEPGVLHLVEIMAKACGKEGARAHLKVRTAARKLIGKVRIKNVRYSESFRNASSQEYRDFLELFFRMVRGSLPATMCQHMDAGGVRMEVVSVTNGSIVVEFHLLIIADVDVQEVSAAFLTAFQTVPLLEVIRGDTFIQDYDECERKEDDCVPGTSCRNTLGSFTCSCEGGAPDFPVEYSERPCEGDSPGNETWATSPERPLTTAGTKAAFVQGTSPTPQGLPQRLNLTGAVRVLCEIEKVVVAIQKRFLQQESIPESSLYLSHPSCNVSHSNGTHVLLEAGWSECGTLMQSNMTNTVVRTTLRNDLSQEGIIHHLKILSPIYCAFQNDLLTSSGFTLEWGVYTIIEDLHGAGNFVTEMQLFIGDSPIPQNYSVSASDDVRIEVGLYRQKSNLKVVLTECWATPSSNARDPITFSFINNSCPVPNTYTNVIENGNSNKAQFKLRIFSFINDSIVYLHCKLRVCMESPGATCKINCNNFRLLQNSETSATHQMSWGPLIRSEGEPPHAEAGLGAGYVVLIVVAIFVLVAGTATLLIVRYQRMNGRYNFKIQSNNFSYQVFYE

SEQ ID NO: 5186 - protein, 944 aa, unidentified
MTVSGPGTPEPRPATPGASSVEQLRKEGNELFKCGDYGGALAAYTQALGLDATPQDQAVLHRNRAACHLKLEDYDKAETEASKAIEKDGGDVKALYRRSQALEKLGRLDQAVLDLQRCVSLEPKNKVFQEALRNIGGQIQEKVRYMSSTDAKVEQMFQILLDPEEKGTEKKQKASQNLVVLAREDAGAEKIFRSNGVQLLQRLLDMGETDLMLAALRTLVGICSEHQSRTVATLSILGTRRVVSILGVESQAVSLAACHLLQVMFDALKEGVKKGFRGKEGAIIVDPARELKVLISNLLDLLTEVGVSGQGRDNALTLLIKAVPRKSLKDPNNSLTLWVIDQGLKKILEVGGSLQDPPGELAVTANSRMSASILLSKLFDDLKCDAERENFHRLCENYIKSWFEGQGLAGKLRAIQTVSCLLQGPCDAGNRALELSGVMESVIALCASEQEEEQLVAVEALIHAAGKAKRASFITANGVSLLKDLYKCSEKDSIRIRALVGLCKLGSAGGTDFSMKQFAEGSTLKLAKQCRKWLCNDQIDAGTRRWAVEGLAYLTFDADVKEEFVEDAAALKALFQLSRLEERSVLFAVASALVNCTNSYDYEEPDPKMVELAKYAKQHVPEQHPKDKPSFVRARVKKLLAAGVVSAMVCMVKTESPVLTSSCRELLSRVFLALVEEVEDRGTVVAQGGGRALIPLALEGTDVGQTKAAQALAKLTITSNPEMTFPGERIYEVVRPLVSLLHLNCSGLQNFEALMALTNLAGISERLRQKILKEKAVPMIEGYMFEEHEMIRRAATECMCNLAMSKEVQDLFEAQGNDRLKLLVLYSGEDDELLQRAAAGGLAMLTSMRPTLCSRIPQVTTHWLEILQALLLSSNQELQHRGAVVVLNMVEASREIASTLMESEMMEILSVLAKGDHSPVTRAAAACLDKAVEYGLIQPNQDGE

SEQ ID NO: 5187 - protein, 259 aa, unidentified
MLPSTSVNSLVQGNGVLNSRDAARHTAGAKRYKYLRRLFRFRQMDFEFAAWQMLYLFTSPQRVYRNFHYRKQTKDQWARDDPAFLVLLSIWLCVSTIGFGFVLDMGFFETIKLLLWVVLIDCVGVGLLIATLMWFISNKYLVKRQSRDYDVEWGYAFDVHLNAFYPLLVILHFIQLFFINHVILTDTFIGYLVGNTLWLVAVGYYIYVTFLGYSALPFLKNTVILLYPFAPLILLYGLSLALGWNFTHTLCSFYKYRVK

SEQ ID NO: 5188 - protein, 842 aa, unidentified
MAVRPGLWPALLGIVLAAWLRGSGAQQSATVANPVPGANPDLLPHFLVEPEDVYIVKNKPVLLVCKAVPATQIFFKCNGEWVRQVDHVIERSTDGSSGLPTMEVRINVSRQQVEKVFGLEEYWCQCVAWSSSGTTKSQKAYIRIAYLRKNFEQEPLAKEVSLEQGIVLPCRPPEGIPPAEVEWLRNEDLVDPSLDPNVYITREHSLVVRQARLADTANYTCVAKNIVARRRSASAAVIVYVDGSWSPWSKWSACGLDCTHWRSRECSDPAPRNGGEECQGTDLDTRNCTSDLCVHTASGPEDVALYVGLIAVAVCLVLLLLVLILVYCRKKEGLDSDVADSSILTSGFQPVSIKPSKADNPHLLTIQPDLSTTTTTYQGSLCPRQDGPSPKFQLTNGHLLSPLGGGRHTLHHSSPTSEAEEFVSRLSTQNYFRSLPRGTSNMTYGTFNFLGGRLMIPNTGISLLIPPDAIPRGKIYEIYLTLHKPEDVRLPLAGCQTLLSPIVSCGPPGVLLTRPVILAMDHCGEPSPDSWSLRLKKQSCEGSWEDVLHLGEEAPSHLYYCQLEASACYVFTEQLGRFALVGEALSVAAAKRLKLLLFAPVACTSLEYNIRVYCLHDTHDALKEVVQLEKQLGGQLIQEPRVLHFKDSYHNLRLSIHDVPSSLWKSKLLVSYQEIPFYHIWNGTQRYLHCTFTLERVSPSTSDLACKLWVWQVEGDGQSFSINFNITKDTRFAELLALESEAGVPALVGPSAFKIPFLIRQKIISSLDPPCRRGADWRTLAQKLHLDSHLSFFASKPSPTAMILNLWEARHFPNGNLSQLAAAVAGLGQPDAGLFTVSEAEC

SEQ ID NO: 5189 - protein, 945 aa, unidentified
MGARSGARGALLLALLLCWDPRLSQAGTDSGSEVLPDSFPSAPAEPLPYFLQEPQDAYIVKNKPVELRCRAFPATQIYFKCNGEWVSQNDHVTQEGLDEATGLRVREVQIEVSRQQVEELFGLEDYWCQCVAWSSAGTTKSRRAYVRIAYLRKNFDQEPLGKEVPLDHEVLLQCRPPEGVPVAEVEWLKNEDVIDPTQDTNFLLTIDHNLIIRQARLSDTANYTCVAKNIVAKRRSTTATVIVYVNGGWSSWAEWSPCSNRCGRGWQKRTRTCTNPAPLNGGAFCEGQAFQKTACTTICPVDGAWTEWSKWSACSTECAHWRSRECMAPPPQNGGRDCSGTLLDSKNCTDGLCMQNKKTLSDPNSHLLEASGDAALYAGLVVAIFVVVAILMAVGVVVYRRNCRDFDTDITDSSAALTGGFHPVNFKTARPSNPQLLHPSVPPDLTASAGIYRGPVYALQDSTDKIPMTNSPLLDPLPSLKVKVYSSSTTGSGPGLADGADLLGVLPPGTYPSDFARDTHFLHLRSASLGSQQLLGLPRDPGSSVSGTFGCLGGRLSIPGTGVSLLVPNGAIPQGKFYEMYLLINKAESTLPLSEGTQTVLSPSVTCGPTGLLLCRPVILTMPHCAEVSARDWIFQLKTQAHQGHWEEVVTLDEETLNTPCYCQLEPRACHILLDQLGTYVFTGESYSRSAVKRLQLAVFAPALCTSLEYSLRVYCLEDTPVALKEVLELERTLGGYLVEEPKPLMFKDSYHNLRLSLHDLPHAHWRSKLLAKYQEIPFYHIWSGSQKALHCTFTLERHSLASTELTCKICVRQVEGEGQIFQLHTTLAETPAGSLDTLCSAPGSTVTTQLGPYAFKIPLSIRQKICNSLDAPNSRGNDWRMLAQKLSMDRYLNYFATKASPTGVILDLWEALQQDDGDLNSLASALEEMGKSEMLVAVATDGDC

SEQ ID NO: 5190 - protein, 931 aa, unidentified
MRKGLRATAARCGLGLGYLLQMLVLPALALLSASGTGSAAQDDDFFHELPETFPSDPPEPLPHFLIEPEEAYIVKNKPVNLYCKASPATQIYFKCNSEWVHQKDHIVDERVDETSGLIVREVSIEISRQQVEELFGPEDYWCQCVAWSSAGTTKSRKAYVRIAYLRKTFEQEPLGKEVSLEQEVLLQCRPPEGIPVAEVEWLKNEDIIDPVEDRNFYITIDHNLIIKQARLSDTANYTCVAKNIVAKRKSTTATVIVYVNGGWSTWTEWSVCNSRCGRGYQKRTRTCTNPAPLNGGAFCEGQSVQKIACTTLCPVDGRWTPWSKWSTCGTECTHWRRRECTAPAPKNGGKDCDGLVLQSKNCTDGLCMQTAPDSDDVALYVGIVIAVIVCLAISVVVALFVYRKNHRDFESDIIDSSALNGGFQPVNIKAARQDLLAVPPDLTSAAAMYRGPVYALHDVSDKIPMTNSPILDPLPNLKIKVYNTSGAVTPQDDLSEFTSKLSPQMTQSLLENEALSLKNQSLARQTDPSCTAFGSFNSLGGHLIVPNSGVSLLIPAGAIPQGRVYEMYVTVHRKETMRPPMDDSQTLLTPVVSCGPPGALLTRPVVLTMHHCADPNTEDWKILLKNQAAQGQWEDVVVVGEENFTTPCYIQLDAEACHILTENLSTYALVGHSTTKAAAKRLKLAIFGPLCCSSLEYSIRVYCLDDTQDALKEILHLERQMGGQLLEEPKALHFKGSTHNLRLSIHDIAHSLWKSKLLAKYQEIPFYHVWSGSQRNLHCTFTLERFSLNTVELVCKLCVRQVEGEGQIFQLNCTVSEEPTGIDLPLLDPANTITTVTGPSAFSIPLPIRQKLCSSLDAPQTRGHDWRMLAHKLNLDRYLNYFATKSSPTGVILDLWEAQNFPDGNLSMLAAVLEEMGRHETVVSLAAEGQY

SEQ ID NO: 5191 - protein, 953 aa, unidentified
MGRAAATAGGGGGARRWLPWLGLCFWAAGTAAARGTDNGEALPESIPSAPGTLPHFIEEPDDAYIIKSNPIALRCKARPAMQIFFKCNGEWVHQNEHVSEETLDESSGLKVREVFINVTRQQVEDFHGPEDYWCQCVAWSHLGTSKSRKASVRIAYLRKNFEQDPQGREVPIEGMIVLHCRPPEGVPAAEVEWLKNEEPIDSEQDENIDTRADHNLIIRQARLSDSGNYTCMAANIVAKRRSLSATVVVYVNGGWSSWTEWSACNVRCGRGWQKRSRTCTNPAPLNGGAFCEGMSVQKITCTSLCPVDGSWEVWSEWSVCSPECEHLRIRECTAPPPRNGGKFCEGLSQESENCTDGLCILDKKPLHEIKPQSIENASDIALYSGLGAAVVAVAVLVIGVTLYRRSQSDYGVDVIDSSALTGGFQTFNFKTVRQGNSLLLNSAMQPDLTVSRTYSGPICLQDPLDKELMTESSLFNPLSDIKVKVQSSFMVSLGVSERAEYHGKNHSRTFPHGNNHSFSTMHPRNKMPYIQNLSSLPTRTELRTTGVFGHLGGRLVMPNTGVSLLIPHGAIPEENSWEIYMSINQGEPSLQSDGSEVLLSPEVTCGPPDMIVTTPFALTIPHCADVSSEHWNIHLKKRTQQGKWEEVMSVEDESTSCYCLLDPFACHVLLDSFGTYALTGEPITDCAVKQLKVAVFGCMSCNSLDYNLRVYCVDNTPCAFQEVVSDERHQGGQLLEEPKLLHFKGNTFSLQISVLDIPPFLWRIKPFTACQEVPFSRVWCSNRQPLHCAFSLERYTPTTTQLSCKICIRQLKGHEQILQVQTSILESERETITFFAQEDSTFPAQTGPKAFKIPYSIRQRICATFDTPNAKGKDWQMLAQKNSINRNLSYFATQSSPSAVILNLWEARHQHDGDLDSLACALEEIGRTHTKLSNISESQLDEADFNYSRQNGL

SEQ ID NO: 5192 - protein, 2635 aa, unidentified
MSTKAEQFASKIRYLQEYHNRVLHNIYPVPSGTDIANTLKYFSQTLLSILSRTGKKENQDASNLTVPMTMCLFPVPFPLTPSLRPQVSSINPTVTRSLLYSVLRDAPSERGPQSRDAQLSDYPSLDYQGLYVTLVTLLDLVPLLQHGQHDLGQSIFYTTTCLLPFLNDDILSTLPYTMISTLATFPPFLHKDIIEYLSTSFLPMAILGSSRREGVPAHVNLSASSMLMIAMQYTSNPVYHCQLLECLMKYKQEVWKDLLYVIAYGPSQVKPPAVQMLFHYWPNLKPPGAISEYRGLQYTAWNPIHCQHIECHNAINKPAVKMCIDPSLSVALGDKPPPLYLCEECSERIAGDHSEWLIDVLLPQAEISAICQKKNCSSHVRRAVVTCFSAGCCGRHGNRPVRYCKRCHSNHHSNEVGAAAETHLYQTSPPPINTRECGAEELVCAVEAVISLLKEAEFHAEQREHELNRRRQLGLSSSHHSLDNADFDNKDDDKHDQRLLSQFGIWFLVSLCTPSENTPTESLARLVAMVFQWFHSTAYMMDDEVGSLVEKLKPQFVTKWLKTVCDVRFDVMVMCLLPKPMEFARVGGYWDKSCSTVTQLKEGLNRILCLIPYNVINQSVWECIMPEWLEAIRTEVPDNQLKEFREVLSKMFDIELCPLPFSMEEMFGFISCRFTGYPSSVQEQALLWLHVLSELDIMVPLQLLISMFSDGVNSVKELANQRKSRVSELAGNLASRRVSVASDPGRRVQHNMLSPFHSPFQSPFRSPLRSPFRSPFKNFGHPGGRTIDFDCEDDEMNLNCFILMFDLLLKQMELQDDGITMGLEHSLSKDIISIINNVFQAPWGGSHTCQKDEKAIECNLCQSSILCYQLACELLERLAPKEESRLVEPTDSLEDSLLSSRPEFIIGPEGEEEENPASKHGENPGNCTEPVEHAAVKNDTERKFCYQQLPVTLRLIYTIFQEMAKFEEPDILFNMLNCLKILCLHGECLYIARKDHPQFLAYIQDHMLIASLWRVVKSEFSQLSSLAVPLLLHALSLPHGADIFWTIINGNFNSKDWKMRFEAVEKVAVICRFLDIHSVTKNHLLKYSLAHAFCCFLTAVEDVNPAVATRAGLLLDTIKRPALQGLCLCLDFQFDTVVKDRPTILSKLLLLHFLKQDIPALSWEFFVNRFETLSLEAQLHLDCNKEFPFPTTITAVRTNVANLSDAALWKIKRARFARNRQKSVRSLRDSVKGPVESKRALSLPETLTSKIRQQSPENDNTIKDLLPEDAGIDHQTVHQLITVLMKFMAKDESSAESDISSAKAFNTVKRHLYVLLGYDQQEGCFMIAPQKMRLSTCFNAFIAGIAQVMDYNINLGKHLLPLVVQVLKYCSCPQLRHYFQQPPRCSLWSLKPHIRQMWLKALLVILYKYPYRDCDISKILLHLIHITVNTLNAQYHSCKPHATAGPLYSDNSNISRYSEKEKGEIELAEYRETGALQDSLLHCVREESIPKKKLRSFKQKSLDIGNADSLLFTLDEHRRKSCIDRCDIEKPPTQAAYIAQRPNDPGRSRQNSATRPDNSEIPENPAMEGFPDARRPVIPEVRLNCMETFEVKVDSPVKPAPKEDLDLIDLSSDSTSGPEKHSILSTSDSDSLVFEPLPPLRIVESDEEEETMNQGDDGPSGKNAASSPSVPSHPSVLSLSTAPLVQVSVEDCSKDFSSKDSGNNQSAGNTDSALITLEDPMDAEGSSKPEELPEFSCGSPLTLKQKRDLLQKSFALPEMSLDDHPDPGTEGEKPGELMPSSGAKTVLLKVPEDAENPTESEKPDTSAESDTEQNPERKVEEDGAEESEFKIQIVPRQRKQRKIAVSAIQREYLDISFNILDKLGEQKDPDPSTKGLSTLEMPRESSSAPTLDAGVPETSSHSSISTQYRQMKRGSLGVLTMSQLMKRQLEHQSSAPHNISNWDTEQIQPGKRQCNVPTCLNPDLEGQPLRMRGATKSSLLSAPSIVSMFVPAPEEFTDEQPTVMTDKCHDCGAILEEYDEETLGLAIVVLSTFIHLSPDLAAPLLLDIMQSVGRLASSTTFSNQAESMMVPGNAAGVAKQFLRCIFHQLAPNGIFPQLFQSTIKDGTFLRTLASSLMDFNELSSIAALSQLLEGLNNKKNLPAGGAMIRCLENIATFMEALPMDSPSSLWTTISNQFQTFFAKLPCVLPLKCSLDSSLRIMICLLKIPSTNATRSLLEPFSKLLSFVIQNAVFTLAYLVELCGLCYRAFTKERDKFYLSRSVVLELLQALKLKSPLPDTNLLLLVQFICADAGTKLAESTILSKQMIASVPGCGTAAMECVRQYINEVLDFMADMHTLTKLKSHMKTCSQPLHEDTFGGHLKVGLAQIAAMDISRGNHRDNKAVIRYLPWLYHPPSAMQQGPKEFIECVSHIRLLSWLLLGSLTHNAVCPNASSPCLPIPLDAGSHVADHLIVILIGFPEQSKTSVLHMCSLFHAFIFAQLWTVYCEQSAVATNLQNQNEFSFTAILTALEFWSRVTPSILQLMAHNKVMVEMVCLHVISLMEALQECNSTIFVKLIPMWLPMIQSNIKHLSAGLQLRLQAIQNHVNHHSLRTLPGSGQSSAGLAALRKWLQCTQFKMAQVEIQSSEAASQFYPL

SEQ ID NO: 5193 - protein, 457 aa, unidentified
MDRSLRNVLVVSFGFLLLFTAYGGLQSLQSSLYSEEGLGVTALSTLYGGMLLSSMFLPPLLIERLGCKGTIILSMCGYVAFSVGNFFASWYTLIPTSILLGLGAAPLWSAQCTYLTITGNTHAEKAGKRGKDMVNQYFGIFFLIFQSSGVWGNLISSLVFGQTPSQETLPEEQLTSCGASDCLMATTTTNSTQRPSQQLVYTLLGIYTGSGVLAVLMIAAFLQPIRDVQRESEGEKKSVPFWSTLLSTFKLYRDKRLCLLILLPLYSGLQQGFLSSEYTRSYVTCTLGIQFVGYVMICFSATDALCSVLYGKVSQYTGRAVLYVLGAVTHVSCMIALLLWRPRADHLAVFFVFSGLWGVADAVWQTQNNALYGVLFEKSKEAAFANYRLWEALGFVIAFGYSMFLCVHVKLYILLGVLSLTMVAYGLVECVESKNPIRPHAPGQVNQAEDEEIQTKM

SEQ ID NO: 5194 - protein, 597 aa, unidentified
MEAEPPLYPMAGAAGPQGDEDLLGVPDGPEAPLDELVGAYPNYNEEEEERRYYRRKRLGVLKNVLAASAGGMLTYGVYLGLLQMQLILHYDETYREVKYGNMGLPDIDSKMLMGINVTPIAALLYTPVLIRFFGTKWMMFLAVGIYALFVSTNYWERYYTLVPSAVALGMAIVPLWASMGNYITRMAQKYHEYSHYKEQDGQGMKQRPPRGSHAPYLLVFQAIFYSFFHLSFACAQLPMIYFLNHYLYDLNHTLYNVQSCGTNSHGILSGFNKTVLRTLPRSGNLIVVESVLMAVAFLAMLLVLGLCGAAYRPTEEIDLRSVGWGNIFQLPFKHVRDYRLRHLVPFFIYSGFEVLFACTGIALGYGVCSVGLERLAYLLVAYSLGASAASLLGLLGLWLPRPVPLVAGAGVHLLLTFILFFWAPVPRVLQHSWILYVAAALWGVGSALNKTGLSTLLGILYEDKERQDFIFTIYHWWQAVAIFTVYLGSSLHMKAKLAVLLVTLVAAAVSYLRMEQKLRRGVAPRQPRIPRPQHKVRGYRYLEEDNSDESDAEGEHGDGAEEEAPPAGPRPGPEPAGLGRRPCPYEQAQGGDGPEEQ

SEQ ID NO: 5195 - protein, 258 aa, unidentified
MASAAAAEAEKGSPVVVGLLVVGNIIILLSGLSLFAETIWVTADQYRVYPLMGVSGKDDVFAGAWIAIFCGFSFFMVASFGVGAALCRRRSMVLTYLVLMLIVYIFECASCITSYTHRDYMVSNPSLITKQMLTFYSADTDQGQELTRLWDRVMIEQECCGTSGPMDWVNFTSAFRAATPEVVFPWPPLCCRRTGNFIPLNEEGCRLGHMDYLFTKGCFEHIGHAIDSYTWGISWFGFAILMWTLPVMLIAMYFYTML

SEQ ID NO: 5196 - protein, 260 aa, unidentified
MAKDNSTVRCFQGLLIFGNVIIGCCGIALTAECIFFVSDQHSLYPLLEATDNDDIYGAAWIGIFVGICLFCLSVLGIVGIMKSSRKILLAYFILMFIVYAFEVASCITAATQQDFFTPNLFLKQMLERYQNNSPPNNDDQWKNNGVTKTWDRLMLQDNCCGVNGPSDWQKYTSAFRTENNDADYPWPRQCCVMNNLKEPLNLEACKLGVPGFYHNQGCYELISGPMNRHAWGVAWFGFAILCWTFWVLLGTMFYWSRIEY

SEQ ID NO: 5197 - protein, 184 aa, unidentified
MAPLLPIRTLPLILILLALLSPGAADFNISSLSGLLSPALTESLLVALPPCHLTGGNATLMVRRANDSKVVTSSFVVPPCRGRRELVSVVDSGAGFTVTRLSAYQVTNLVPGTKFYISYLVKKGTATESSREIPMSTLPRRNMESIGLGMARTGGMVVITVLLSVAMFLLVLGFIIALALGSRK

SEQ ID NO: 5198 - protein, 287 aa, unidentified
MPPLWALLALGCLRFGSAVNLQPQLASVTFATNNPTLTTVALEKPLCMFDSKEALTGTHEVYLYVLVDSAISRNASVQDSTNTPLGSTFLQTEGGRTGPYKAVAFDLIPCSDLPSLDAIGDVSKASQILNAYLVRVGANGTCLWDPNFQGLCNAPLSAATEYRFKYVLVNMSTGLVEDQTLWSDPIRTNQLTPYSTIDTWPGRRSGGMIVITSILGSLPFFLLVGFAGAIALSLVDMGSSDGETTHDSQITQEAVPKSLGASESSYTSVNRGPPLDRAEVYSSKLQD

SEQ ID NO: 5199 - protein, 320 aa, unidentified
MGLPWGQPHLGLQMLLLALNCLRPSLSLGEWGSWMDASSQTQGAGGPAGVIGPWAPAPLRLGEAAPGTPTPVSVAHLLSPVATELVPYTPQITAWDLEGKVTATTFSLEQPRCVFDGLASASDTVWLVVAFSNASRGFQNPETLADIPASPQLLTDGHYMTLPLSPDQLPCGDPMAGSGGAPVLRVGHDHGCHQQPFCNAPLPGPGPYREDPRIHRHLARAAKWQHDRHYLHPLFSGRPPTLGLLGSLYHALLQPVVAGGGPGAAADRLLHGQALHDPPHPTQRGRHTAGGLQAWPGPPPQPQPLAWPLCMGLGEMGRWE

SEQ ID NO: 5200 - protein, 263 aa, unidentified
MDNSWRLGPAIGLSAGQSQLLVSLLLLLTRVQPGTDVAAPEHISYVPQLSNDTLAGRLTLSTFTLEQPLGQFSSHNISDLDTIWLVVALSNATQSFTAPRTNQDIPAPANFSQRGYYLTLRANRVLYQTRGQLHVLRVGNDTHCQPTKIGCNHPLPGPGPYRVKFLVMNDEGPVAETKWSSDTRLQQAQALRAVPGPQSPGTVVIIAILSILLAVLLTVLLAVLIYTCFNSCRSTSLSGPEEAGSVRRYTTHLAFSTPAEGAS

SEQ ID NO: 5201 - protein, 299 aa, unidentified
MALLVRVLRNQTSISQWVPVCSRLIPVSPTQGQGDRALSRTSQWPQMSQSRACGGSEQIPGIDIQLNRKYHTTRKLSTTKDSPQPVEEKVGAFTKIIEAMGFTGPLKYSKWKIKIAALRMYTSCVEKTDFEEFFLRCQMPDTFNSWFLITLLHVWMCLVRMKQEGRSGKYMCRIIVHFMWEDVQQRGRVMGVNPYILKKNMILMTNHFYAAILGYDEGILSDDHGLAAALWRTFFNRKCEDPRHLELLVEYVRKQIQYLDSMNGEDLLLTGEVSWRPLVEKNPQSILKPHSPTYNDEGL

SEQ ID NO: 5202 - protein, 93 aa, unidentified
MDSLRKMLISVAMLGAGAGVGYALLVIVTPGERRKQEMLKEMPLQDPRSREEAARTQQLLLATLQEAATTQENVAWRKNWMVGGEGGAGGRSP

SEQ ID NO: 5203 - protein, 63 aa, unidentified
MAAATLTSKLYSLLFRRTSTFALTIIVGVMFFERAFDQGADAIYDHINEGKLWKHIKHKYENK

SEQ ID NO: 5204 - protein, 56 aa, unidentified
MVTRFLGPRYRELVKNWVPTAYTWGAVGAVGLVWATDWRLILDWVPYINGKFKKDN

SEQ ID NO: 5205 - protein, 931 aa, unidentified
MASPGIEVELLGKGHSDLGEVAPEIKASERRTAVAIADLEWREMEGDDCEFRYGDGTNEAQDNDFPTVERSRLQEMLSLLGLETYQVQKLSLQDSLQISFDSMKNWAPQVPKDLPWNFLRKLQALNADARNTTMVLDVLPDARPVEKESQMEEEIIYWDPADDLAADIYSFSELPTPDTPVNPLDLLCALLLSSDSFLQQEIALKMALCQFALPLVLPDSENHYHTFLLWAMRGIVRTWWSQPPRGMGSFREDSVVLSRAPAFAFVRMDVSSNSKSQLLNAVLSPGHRQWDCFWHRDLNLGTNAREISDGLVEISWFFPSGREDLDIFPEPVAFLNLRGDIGSHWLQFKLLTEISSAVFILTDNISKKEYKLLYSMKESTTKYYFILSPYRGKRNTNLRFLNKLIPVLKIDHSHVLVKVSSTDSDSFVKRIRAIVGNVLRAPCRRVSVEDMAHAARKLGLKVDEDCEECQKAKDRMERITRKIKDSDAYRRDELRLQGDPWRKAAQVEKEFCQLQWAVDPPEKHRAELRRRLLELRMQQNGHDPSSGVQEFISGISSPSLSEKQYFLRWMEWGLARVAQPRLRQPPETLLTLRPKHGGTTDVGEPLWPEPLGVEHFLREMGQFYEAESCLVEAGRLPAGQRRFAHFPGLASELLLTGLPLELIDGSTLSMPVRWVTGLLKELHVRLERRSRLVVLSTVGVPGTGKSTLLNTMFGLRFATGKSCGPRGAFMQLITVAEGFSQDLGCDHILVIDSGGLIGGALTSAGDRFELEASLATLLMGLSNVTVISLAETKDIPAAILHAFLRLEKTGHMPNYQFVYQNLHDVSVPGPRPRDKRQLLDPPGDLSRAAAQMEKQGDGFRALAGLAFCDPEKQHIWHIPGLWHGAPPMAAVSLAYSEAIFELKRCLLENIRNGLSNQNKNIQQLIELVRRL

SEQ ID NO: 5206 - protein, 259 aa, unidentified
MAASRLELNLVRLLSRCEAMAAEKRDPDEWRLEKYVGALEDMLQALKVHASKPASEVINEYSWKVDFLKGMLQAEKLTSSSEKALANQFLAPGRVPTTARERVPATKTVHLQSRARYTSEMRSELLGTDSAEPEMDVRKRTGVAGSQPVSEKQLAAELDLVLQRHQNLQEKLAEEMLGLARSLKTNTLAAQSVIKKDNQTLSHSLKMADQNLEKLKTESERLEQHTQKSVNWLLWAMLIIVCFIFISMILFIRIMPKLK

SEQ ID NO: 5207 - protein, 5202 aa, unidentified
MNCPVLSLGSGFLFQVIEMLIFAYFASISLTESRGLFPRLENVGAFKKVSIVPTQAVCGLPDRSTFCHSSAAAESIQFCTQRFCIQDCPYRSSHPTYTALFSAGLSSCITPDKNDLHPNAHSNSASFIFGNHKSCFSSPPSPKLMASFTLAVWLKPEQQGVMCVIEKTVDGQIVFKLTISEKETMFYYRTVNGLQPPIKVMTLGRILVKKWIHLSVQVHQTKISFFINGVEKDHTPFNARTLSGSITDFASGTVQIGQSLNGLEQFVGRMQDFRLYQVALTNREILEVFSGDLLRLHAQSHCRCPGSHPRVHPLAQRYCIPNDAGDTADNRVSRLNPEAHPLSFVNDNDVGTSWVSNVFTNITQLNQGVTISVDLENGQYQVFYIIIQFFSPQPTEIRIQRKKENSLDWEDWQYFARNCGAFGMKNNGDLEKPDSVNCLQLSNFTPYSRGNVTFSILTPGPNYRPGYNNFYNTPSLQEFVKATQIRFHFHGQYYTTETAVNLRHRYYAVDEITISGRCQCHGHADNCDTTSQPYRCLCSQESFTEGLHCDRCLPLYNDKPFRQGDQVYAFNCKPCQCNSHSKSCHYNISVDPFPFEHFRGGGGVCDDCEHNTTGRNCELCKDYFFRQVGADPSAIDVCKPCDCDTVGTRNGSILCDQIGGQCNCKRHVSGRQCNQCQNGFYNLQELDPDGCSPCNCNTSGTVDGDITCHQNSGQCKCKANVIGLRCDHCNFGFKFLRSFNDVGCEPCQCNLHGSVNKFCNPHSGQCECKKEAKGLQCDTCRENFYGLDVTNCKACDCDTAGSLPGTVCNAKTGQCICKPNVEGRQCNKCLEGNFYLRQNNSFLCLPCNCDKTGTINGSLLCNKSTGQCPCKLGVTGLRCNQCEPHRYNLTIDNFQHCQMCECDSLGTLPGTICDPISGQCLCVPNRQGRRCNQCQPGFYISPGNATGCLPCSCHTTGAVNHICNSLTGQCVCQDASIAGQRCDQCKDHYFGFDPQTGRCQPCNCHLSGALNETCHLVTGQCFCKQFVTGSKCDACVPSASHLDVNNLLGCSKTPFQQPPPRGQVQSSSAINLSWSPPDSPNAHWLTYSLLRDGFEIYTTEDQYPYSIQYFLDTDLLPYTKYSYYIETTNVHGSTRSVAVTYKTKPGVPEGNLTLSYIIPIGSDSVTLTWTTLSNQSGPIEKYILSCAPLAGGQPCVSYEGHETSATIWNLVPFAKYDFSVQACTSGGCLHSLPITVTTAQAPPQRLSPPKMQKISSTELHVEWSPPAELNGIIIRYELYMRRLRSTKETTSEESRVFQSSGWLSPHSFVESANENALKPPQTMTTITGLEPYTKYEFRVLAVNMAGSVSSAWVSERTGESAPVFMIPPSVFPLSSYSLNISWEKPADNVTRGKVVGYDINMLSEQSPQQSIPMAFSQLLHTAKSQELSYTVEGLKPYRIYEFTITLCNSVGCVTSASGAGQTLAAAPAQLRPPLVKGINSTTIHLRWFPPEELNGPSPIYQLERRESSLPALMTTMMKGIRFIGNGYCKFPSSTHPVNTDFTGIKASFRTKVPEGLIVFAASPGNQEEYFALQLKKGRLYFLFDPQGSPVEVTTTNDHGKQYSDGKWHEIIAIRHQAFGQITLDGIYTGSSAILNGSTVIGDNTGVFLGGLPRSYTILRKDPEIIQKGFVGCLKDVHFMKNYNPSAIWEPLDWQSSEEQINVYNSWEGCPASLNEGAQFLGAGFLELHPYMFHGGMNFEISFKFRTDQLNGLLLFVYNKDGPDFLAMELKSGILTFRLNTSLAFTQVDLLLGLSYCNGKWNKVIIKKEGSFISASVNGLMKHASESGDQPLVVNSPVYVGGIPQELLNSYQHLCLEQGFGGCMKDVKFTRGAVVNLASVSSGAVRVNLDGCLSTDSAVNCRGNDSILVYQGKEQSVYEGGLQPFTEYLYRVIASHEGGSVYSDWSRGRTTGAAPQSVPTPSRVRSLNGYSIEVTWDEPVVRGVIEKYILKAYSEDSTRPPRMPSASAEFVNTSNLTGILTGLLPFKNYAVTLTACTLAGCTESSHALNISTPQEAPQEVQPPVAKSLPSSLLLSWNPPKKANGIITQYCLYMDGRLIYSGSEENYIVTDLAVFTPHQFLLSACTHVGCTNSSWVLLYTAQLPPEHVDSPVLTVLDSRTIHIQWKQPRKISGILERYVLYMSNHTHDFTIWSVIYNSTELFQDHMLQYVLPGNKYLIKLGACTGGGCTVSEASEALTDEDIPEGVPAPKAHSYSPDSFNVSWTEPEYPNGVITSYGLYLDGILIHNSSELSYRAYGFAPWSLHSFRVQACTAKGCALGPLVENRTLEAPPEGTVNVFVKTQGSRKAHVRWEAPFRPNGLLTHSVLFTGIFYVDPVGNNYTLLNVTKVMYSGEETNLWVLIDGLVPFTNYTVQVNISNSQGSLITDPITIAMPPGAPDGVLPPRLSSATPTSLQVVWSTPARNNAPGSPRYQLQMRSGDSTHGFLELFSNPSASLSYEVSDLQPYTEYMFRLVASNGFGSAHSSWIPFMTAEDKPGPVVPPILLDVKSRMMLVTWQHPRKSNGVITHYNIYLHGRLYLRTPGNVTNCTVMHLHPYTAYKFQVEACTSKGCSLSPESQTVWTLPGAPEGIPSPELFSDTPTSVIISWQPPTHPNGLVENFTIERRVKGKEEVTTLVTLPRSHSMRFIDKTSALSPWTKYEYRVLMSTLHGGTNSSAWVEVTTRPSRPAGVQPPVVTVLEPDAVQVTWKPPLIQNGDILSYEIHMPDPHITLTNVTSAVLSQKVTHLIPFTNYSVTIVACSGGNGYLGGCTESLPTYVTTHPTVPQNVGPLSVIPLSESYVVISWQPPSKPNGPNLRYELLRRKIQQPLASNPPEDLNRWHNIYSGTQWLYEDKGLSRFTTYEYMLFVHNSVGFTPSREVTVTTLAGLPERGANLTASVLNHTAIDVRWAKPTVQDLQGEVEYYTLFWSSATSNDSLKILPDVNSHVIGHLKPNTEYWIFISVFNGVHSINSAGLHATTCDGEPQGMLPPEVVIINSTAVRVIWTSPSNPNGVVTEYSIYVNNKLYKTGMNVPGSFILRDLSPFTIYDIQVEVCTIYACVKSNGTQITTVEDTPSDIPTPTIRGITSRSLQIDWVSPRKPNGIILGYDLLWKTWYPCAKTQKLVQDQSDELCKAVRCQKPESICGHICYSSEAKVCCNGVLYNPKPGHRCCEEKYIPFVLNSTGVCCGGRIQEAQPNHQCCSGYYARILPGEVCCPDEQHNRVSVGIGDSCCGRMPYSTSGNQICCAGRLHDGHGQKCCGRQIVSNDLECCGGEEGVVYNRLPGMFCCGQDYVNMSDTICCSASSGESKAHIKKNDPVPVKCCETELIPKSQKCCNGVGYNPLKYVCSDKISTGMMMKETKECRILCPASMEATEHCGRCDFNFTSHICTVIRGSHNSTGKASIEEMCSSAEETIHTGSVNTYSYTDVNLKPYMTYEYRISAWNSYGRGLSKAVRARTKEDVPQGVSPPTWTKIDNLEDTIVLNWRKPIQSNGPIIYYILLRNGIERFRGTSLSFSDKEGIQPFQEYSYQLKACTVAGCATSSKVVAATTQGVPESILPPSITALSAVALHLSWSVPEKSNGVIKEYQIRQVGKGLIHTDTTDRRQHTVTGLQPYTNYSFTLTACTSAGCTSSEPFLGQTLQAAPEGVWVTPRHIIINSTTVELYWSLPEKPNGLVSQYQLSRNGNLLFLGGSEEQNFTDKNLEPNSRYTYKLEVKTGGGSSASDDYIVQTPMSTPEEIYPPYNITVIGPYSIFVAWIPPGILIPEIPVEYNVLLNDGSVTPLAFSVGHHQSTLLENLTPFTQYEIRIQACQNGSCGVSSRMFVKTPEAAPMDLNSPVLKALGSACIEIKWMPPEKPNGIIINYFIYRRPAGIEEESVLFVWSEGALEFMDEGDTLRPFTLYEYRVRACNSKGSVESLWSLTQTLEAPPQDFPAPWAQATSAHSVLLNWTKPESPNGIISHYRVVYQERPDDPTFNSPTVHAFTVKGTSHQAHLYGLEPFTTYRIGVVAANHAGEILSPWTLIQTLESSPSGLRNFIVEQKENGRALLLQWSEPMRTNGVIKTYNIFSDGFLEYSGLNRQFLFRRLDPFTLYTLTLEACTRAGCAHSAPQPLWTDEAPPDSQLAPTVHSVKSTSVELSWSEPVNPNGKIIRYEVIRRCFEGKAWGNQTIQADEKIVFTEYNTERNTFMYNDTGLQPWTQCEYKIYTWNSAGHTCSSWNVVRTLQAPPEGLSPPVISYVSMNPQKLLISWIPPEQSNGIIQSYRLQRNEMLYPFSFDPVTFNYTDEELLPFSTYSYALQACTSGGCSTSKPTSITTLEAAPSEVSPPDLWAVSATQMNVCWSPPTVQNGKITKYLVRYDNKESLAGQGLCLLVSHLQPYSQYNFSLVACTNGGCTASVSKSAWTMEALPENMDSPTLQVTGSESIEITWKPPRNPNGQIRSYELRRDGTIVYTGLETRYRDFTLTPGVEYSYTVTASNSQGGILSPLVKDRTSPSAPSGMEPPKLQARGPQEILVNWDPPVRTNGDIINYTLFIRELFERETKIIHINTTHNSFGMQSYIVNQLKPFHRYEIRIQACTTLGCASSDWTFIQTPEIAPLMQPPPHLEVQMAPGGFQPTVSLLWTGPLQPNGKVLYYELYRRQIATQPRKSNPVLIYNGSSTSFIDSELLPFTEYEYQVWAVNSAGKAPSSWTWCRTGPAPPEGLRAPTFHVISSTQAVVNISAPGKPNGIVSLYRLFSSSAHGAETVLSEGMATQQTLHGLQAFTNYSIGVEACTCFNCCSKGPTAELRTHPAPPSGLSSPQIGTLASRTASFRWSPPMFPNGVIHSYELQFHVACPPDSALPCTPSQIETKYTGLGQKASLGGLQPYTTYKLRVVAHNEVGSTASEWISFTTQKELPQYRAPFSVDSNLSVVCVNWSDTFLLNGQLKEYVLTDGGRRVYSGLDTTLYIPRTADKTFFFQVICTTDEGSVKTPLIQYDTSTGLGLVLTTPGKKKGSRSKSTEFYSELWFIVLMAMLGLILLAIFLSLILQRKIHKEPYIRERPPLVPLQKRMSPLNVYPPGENHMGLADTKIPRSGTPVSIRSNRSACVLRIPSQNQTSLTYSQGSLHRSVSQLMDIQDKKVLMDNSLWEAIMGHNSGLYVDEEDLMNAIKDFSSVTKERTTFTDTHL

SEQ ID NO: 5208 - protein, 58 aa, unidentified
MAGPESDAQYQFTGIKKYFNSYTLTGRMNCVLATYGSIALIVLYFKLRSKKTPAVKAT

SEQ ID NO: 5209 - protein, 1318 aa, unidentified
MSGGASATGPRRGPPGLEDTTSKKKQKDRANQESKDGDPRKETGSRYVAQAGLEPLASGDPSASASHAAGITGSRHRTRLFFPSSSGSASTPQEEQTKEGACEDPHDLLATPTPELLLDWRQSAEEVIVKLRVGVGPLQLEDVDAAFTDTDCVVRFAGGQQWGGVFYAEIKSSCAKVQTRKGSLLHLTLPKKVPMLTWPSLLVEADEQLCIPPLNSQTCLLGSEENLAPLAGEKAVPPGNDPVSPAMVRSRNPGKDDCAKEEMAVAADAATLVDEPESMVNLAFVKNDSYEKGPDSVVVHVYVKEICRDTSRVLFREQDFTLIFQTRDGNFLRLHPGCGPHTTFRWQVKLRNLIEPEQCTFCFTASRIDICLRKRQSQRWGGLEAPAARVGGAKVAVPTGPTPLDSTPPGGAPHPLTGQEEARAVEKDKSKARSEDTGLDSVATRTPMEHVTPKPETHLASPKPTCMVPPMPHSPVSGDSVEEEEEEEKKVCLPGFTGLVNLGNTCFMNSVIQSLSNTRELRDFFHDRSFEAEINYNNPLGTGGRLAIGFAVLLRALWKGTHHAFQPSKLKAIVASKASQFTGYAQHDAQEFMAFLLDGLHEDLNRIQNKPYTETVDSDGRPDEVVAEEAWQRHKMRNDSFIVDLFQGQYKSKLVCPVCAKVSITFDPFLYLPVPLPQKQKVLPVFYFAREPHSKPIKFLVSVSKENSTASEVLDSLSQSVHVKPENLRLAEVIKNRFHRVFLPSHSLDTVSPSDTLLCFELLSSELAKERVVVLEVQQRPQVPSVPISKCAACQRKQQSEDEKLKRCTRCYRVGYCNQLCQKTHWPDHKGLCRPENIGYPFLVSVPASRLTYARLAQLLEGYARYSVSVFQPPFQPGRMALESQSPGCTTLLSTGSLEAGDSERDPIQPPELQLVTPMAEGDTGLPRVWAAPDRGPVPSTSGISSEMLASGPIEVGSLPAGERVSRPEAAVPGYQHPSEAMNAHTPQFFIYKIDSSNREQRLEDKGDTPLELGDDCSLALVWRNNERLQEFVLVASKELECAEDPGSAGEAARAGHFTLDQCLNLFTRPEVLAPEEAWYCPQCKQHREASKQLLLWRLPNVLIVQLKRFSFRSFIWRDKINDLVEFPVRNLDLSKFCIGQKEEQLPSYDLYAVINHYGGMIGGHYTACARLPNDRSSQRSDVGWRLFDDSTVTTVDESQVVTRYAYVLFYRRRNSPVERPPRAGHSEHHPDLGPAAEAAASQASRIWQELEAEEEPVPEGSGPLGPWGPQDWVGPLPRGPTTPDEGCLRYFVLGTVAALVALVLNVFYPLVSQSRWR

SEQ ID NO: 5210 - protein, 517 aa, unidentified
MLSSRAEAAMTAADRAIQRFLRTGAAVRYKVMKNWGVIGGIAAALAAGIYVIWGPITERKKRRKGLVPGLVNLGNTCFMNSLLQGLSACPAFIRWLEEFTSQYSRDQKEPPSHQYLSLTLLHLLKALSCQEVTDDEVLDASCLLDVLRMYRWQISSFEEQDAHELFHVITSSLEDERDRQPRVTHLFDVHSLEQQSEITPKQITCRTRGSPHPTSNHWKSQHPFHGRLTSNMVCKHCEHQSPVRFDTFDSLSLSIPAATWGHPLTLDHCLHHFISSESVRDVVCDNCTKIEAKGTLNGEKVEHQRTTFVKQLKLGKLPQCLCIHLQRLSWSSHGTPLKRHEHVQFNEFLMMDIYKYHLLGHKPSQHNPKLNKNPGPTLELQDGPGAPTPVLNQPGAPKTQIFMNGACSPSLLPTLSAPMPFPLPVVPDYSSSTYLFRLMAVVVHHGDMHSGHFVTYRRSPPSARNPLSTSNQWLWVSDDTVRKASLQEVLSSSAYLLFYERVLSRMQHQSQECKSEE

SEQ ID NO: 5211 - protein, 406 aa, unidentified
MKKKQQHPGGGADPWPHGAPMGGAPPGLGSWKRRVPLLPFLRFSLRDYGFCMATLLVFCLGSLLYQLSGGPPRFLLDLRQYLGNSTYLDDHGPPPSKVLPFPSQVVYNRVGKCGSRTVVLLLRILSEKHGFNLVTSDIHNKTRLTKNEQMELIKNISTAEQPYLFTRHVHFLNFSRFGGDQPVYINIIRDPVNRFLSNYFFRRFGDWRGEQNHMIRTPSMRQEERYLDINECILENYPECSNPRLFYIIPYFCGQHPRCREPGEWALERAKLNVNENFLLVGILEELEDVLLLLERFLPHYFKGVLSIYKDPEHRKLGNMTVTVKKTVPSPEAVQILYQRMRYEYEFYHYVKEQFHLLKRKFGLKSHVSKPPLRPHFFIPTPLETEEPIDDEEQDDEKWLEDIYKR

SEQ ID NO: 5212 - protein, 389 aa, unidentified
MALTPESPSSFPGLAATGSSVPEPPGGPNATLNSSWASPTEPSSLEDLVATGTIGTLLSAMGVVGVVGNAYTLVVTCRSLRAVASMYVYVVNLALADLLYLLSIPFIVATYVTKEWHFGDVGCRVLFGLDFLTMHASIFTLTVMSSERYAAVLRPLDTVQRPKGYRKLLALGTWLLALLLTLPVMLAMRLVRRGPKSLCLPAWGPRAHRAYLTLLFATSIAGPGLLIGLLYARLARAYRRSQRASFKRARRPGARALRLVLGIVLLFWACFLPFWLWQLLAQYHQAPLAPRTARIVNYLTTCLTYGNSCANPFLYTLLTRNYRDHLRGRVRGPGSGGGRGPVPSLQPRARFQRCSGRSLSSCSPQPTDSLVLAPAAPARPAPEGPRAPA

SEQ ID NO: 5213 - protein, 118 aa, unidentified
MSAPAQPPAEGTEGTAPGGGPPGPPPNMTSNRRLQQTQAQVEEVVDIIRVNVDKVLERDQKLSELDDRADALQAGASQFESSAAKLKRKYWWKNCKMMIMLGAICAIIVVVIVIYFFT

SEQ ID NO: 5214 - protein, 116 aa, unidentified
MSATAATAPPAAPAGEGGPPAPPPNLTSNRRLQQTQAQVDEVVDIMRVNVDKVLERDQKLSELDDRADALQAGASQFETSAAKLKRKYWWKNLKMMIILGVICAIILIIIIVYFST

SEQ ID NO: 5215 - protein, 100 aa, unidentified
MSTGPTAATGSNRRLQQTQNQVDEVVDIMRVNVDKVLERDQKLSELDDRADALQAGASQFETSAAKLKRKYWWKNCKMWAIGITVLVIFIIIIIVWVVSS

SEQ ID NO: 5216 - protein, 141 aa, unidentified
MPPKFKRHLNDDDVTGSVKSERRNLLEDDSDEEEDFFLRGPSGPRFGPRNDKIKHVQNQVDEVIDVMQENITKVIERGERLDELQDKSESLSDNATAFSNRSKQLRRQMWWRGCKIKAIMALVAAILLLVIIILIVMKYRT

SEQ ID NO: 5217 - protein, 116 aa, unidentified
MAGIELERCQQQANEVTEIMRNNFGKVLERGVKLAELQQRSDQLLDMSSTFNKTTQNLAQKKCWENIRYRICVGLVVVGVLLIILIVLLVVFLPQSSDSSSAPRTQDAGIASGPGN

SEQ ID NO: 5218 - protein, 220 aa, unidentified
MAILFAVVARGTTILAKHAWCGGNFLEVTEQILAKIPSENNKLTYSHGNYLFHYICQDRIVYLCITDDDFERSRAFNFLNEIKKRFQTTYGSRAQTALPYAMNSEFSSVLAAQLKHHSENKGLDKVMETQAQVDELKGIMVRNIDLVAQRGERLELLIDKTENLVDSSVTFKTTSRNLARAMCMKNLKLTIIIIIVSIVFIYIIVSPLCGGFTWPSCVKK

SEQ ID NO: 5219 - protein, 100 aa, unidentified
MEEASEGGGNDRVRNLQSEVEGVKNIMTQNVERILARGENLEHLRNKTEDLEATSEHFKTTSQKVARKFWWKNVKMIVLICVIVFIIILFIVLFATGAFS

SEQ ID NO: 5220 - protein, 524 aa, unidentified
MDTESTYSGYSYYSSHSKKSHRQGERTRERHKSPRNKDGRGSEKSVTIQPPTGEPLLGNDSTRTEEVQDDNWGETTTAITGTSEHSISQEDIARISKDMEDSVGLDCKRYLGLTVASFLGLLVFLTPIAFILLPPILWRDELEPCGTICEGLFISMAFKLLILLIGTWALFFRKRRADMPRVFVFRALLLVLIFLFVVSYWLFYGVRILDSRDRNYQGIVQYAVSLVDALLFIHYLAIVLLELRQLQPMFTLQVVRSTDGESRFYSLGHLSIQRAALVVLENYYKDFTIYNPNLLTASKFRAAKHMAGLKVYNVDGPSNNATGQSRAMIAAAARRRDSSHNELYYEEAEHERRVKKRKARLVVAVEEAFIHIQRLQAEEQQKAPGEVMDPREAAQAIFPSMARALQKYLRITRQQNYHSMESILQHLAFCITNGMTPKAFLERYLSAGPTLQYDKDRWLSTQWRLVSDEAVTNGLRDGIVFVLKCLDFSLVVNVKKIPFIILSEEFIDPKSHKFVLRLQSETSV

SEQ ID NO: 5221 - protein, 521 aa, unidentified
MDTESQYSGYSYKSGHSRSSRKHRDRRDRHRSKSRDGGRGDKSVTIQAPGEPLLDNESTRGDERDDNWGETTTVVTGTSEHSISHDDLTRIAKDMEDSVPLDCSRHLGVAAGATLALLSFLTPLAFLLLPPLLWREELEPCGTACEGLFISVAFKLLILLLGSWALFFRRPKASLPRVFVLRALLMVLVFLLVVSYWLFYGVRILDARERSYQGVVQFAVSLVDALLFVHYLAVVLLELRQLQPQFTLKVVRSTDGASRFYNVGHLSIQRVAVWILEKYYHDFPVYNPALLNLPKSVLAKKVSGFKVYSLGEENSTNNSTGQSRAVIAAAARRRDNSHNEYYYEEAEHERRVRKRRARLVVAVEEAFTHIKRLQEEEQKNPREVMDPREAAQAIFASMARAMQKYLRTTKQQPYHTMESILQHLEFCITHDMTPKAFLERYLAAGPTIQYHKERWLAKQWTLVSEEPVTNGLKDGIVFLLKRQDFSLVVSTKKVPFFKLSEEFVDPKSHKFVMRLQSETSV

SEQ ID NO: 5222 - protein, 249 aa, unidentified
MASASGAMAKHEQILVLDPPTDLKFKGPFTDVVTTNLKLRNPSDRKVCFKVKTTAPRRYCVRPNSGIIDPGSTVTVSVMLQPFDYDPNEKSKHKFMVQTIFAPPNTSDMEAVWKEAKPDELMDSKLRCVFEMPNENDKLNDMEPSKAVPLNASKQDGPMPKPHSVSLNDTETRKLMEECKRLQGEMMKLSEENRHLRDEGLRLRKVAHSDKPGSTSTASFRDNVTSPLPSLLVVIAAIFIGFFLGKFIL

SEQ ID NO: 5223 - protein, 243 aa, unidentified
MAKVEQVLSLEPQHELKFRGPFTDVVTTNLKLGNPTDRNVCFKVKTTAPRRYCVRPNSGIIDAGASINVSVMLQPFDYDPNEKSKHKFMVQSMFAPTDTSDMEAVWKEAKPEDLMDSKLRCVFELPAENDKPHDVEINKIISTTASKTETPIVSKSLSSSLDDTEVKKVMEECKRLQGEVQRLREENKQFKEEDGLRMRKTVQSNSPISALAPTGKEEGLSTRLLALVVLFFIVGVIIGKIAL

SEQ ID NO: 5224 - protein, 673 aa, unidentified
MCSRVPLLLPLLLLLALGPGVQGCPSGCQCSQPQTVFCTARQGTTVPRDVPPDTVGLYVFENGITMLDAGSFAGLPGLQLLDLSQNQIASLPSGVFQPLANLSNLDLTANRLHEITNETFRGLRRLERLYLGKNRIRHIQPGAFDTLDRLLELKLQDNELRALPPLRLPRLLLLDLSHNSLLALEPGILDTANVEALRLAGLGLQQLDEGLFSRLRNLHDLDVSDNQLERVPPVIRGLRGLTRLRLAGNTRIAQLRPEDLAGLAALQELDVSNLSLQALPGDLSGLFPRLRLLAAARNPFNCVCPLSWFGPWVRESHVTLASPEETRCHFPPKNAGRLLLELDYADFGCPATTTTATVPTTRPVVREPTALSSSLAPTWLSPTEPATEAPSPPSTAPPTVGPVPQPQDCPPSTCLNGGTCHLGTRHHLACLCPEGFTGLYCESQMGQGTRPSPTPVTPRPPRSLTLGIEPVSPTSLRVGLQRYLQGSSVQLRSLRLTYRNLSGPDKRLVTLRLPASLAEYTVTQLRPNATYSVCVMPLGPGRVPEGEEACGEAHTPPAVHSNHAPVTQAREGNLPLLIAPALAAVLLAALAAVGAAYCVRRGRAMAAAAQDKGQVGPGAGPLELEGVKVPLEPGPKATEGGGEALPSGSECEVPLMGFPGPGLQSPLHAKPYI

SEQ ID NO: 5225 - protein, 739 aa, unidentified
MPGKMVVILGASNILWIMFAASQAFKIETTPESRYLAQIGDSVSLTCSTTGCESPFFSWRTQIDSPLNGKVTNEGTTSTLTMNPVSFGNEHSYLCTATCESRKLEKGIQVEIYSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQEKPFTVEISPGPRIAAQIGDSVMLTCSVMGCESPSFSWRTQIDSPLSGKVRSEGTNSTLTLSPVSFENEHSYLCTVTCGHKKLEKGIQVELYSFPRDPEIEMSGGLVNGSSVTVSCKVPSVYPLDRLEIELLKGETILENIEFLEDTDMKSLENKSLEMTFIPTIEDTGKALVCQAKLHIDDMEFEPKQRQSTQTLYVNVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 5226 - protein, 779 aa, unidentified
MTPEFDEEVVFENSPLYQYLQDLGHTDFEICSSLSPKTEKCTTEGQQKPPTRVLPKQGILLKVAETIKSWIFFSQCNKKDDLLHKLDIGFRLDSLHTILQQEVLLQEDVELIELLDPSILSAGQSQQQENGHLPTLCSLATPNIWDLSMLFAFISLLVMLPTWWIVSSWLVWGVILFVYLVIRALRLWRTAKLQVTLKKYSVHLEDMATNSRAFTNLVRKALRLIQETEVISRGFTLVSAACPFNKAGQHPSQHLIGLRKAVYRTLRANFQAARLATLYMLKNYPLNSESDNVTNYICVVPFKELGLGLSEEQISEEEAHNFTDGFSLPALKVLFQLWVAQSSEFFRRLALLLSTANSPPGPLLTPALLPHRILSDVTQGLPHAHSACLEELKRSYEFYRYFETQHQSVPQCLSKTQQKSRELNNVHTAVRSLQLHLKALLNEVIILEDELEKLVCTKETQELVSEAYPILEQKLKLIQPHVQASNNCWEEAISQVDKLLRRNTDKKGKPEIACENPHCTVVPLKQPTLHIADKDPIPEEQELEAYVDDIDIDSDFRKDDFYYLSQEDKERQKREHEESKRVLQELKSVLGFKASEAERQKWKQLLFSDHAVLKSLSPVDPVEPISNSEPSMNSDMGKVSKNDTEEESNKSATTDNEISRTEYLCENSLEGKNKDNSSNEVFPQGAEERMCYQCESEDEPQADGSGLTTAPPTPRDSLQPSIKQRLARLQLSPDFTFTAGLAAEVAARSLSFTTMQEQTFGGEEEEQIIEENKNEIEEK

SEQ ID NO: 5227 - protein, 457 aa, unidentified
MRPPSPLPARWLCVLAGALAWALGPAGGQAARLQEECDYVQMIEVQHKQCLEEAQLENETIGCSKMWDNLTCWPATPRGQVVVLACPLIFKLFSSIQGRNVSRSCTDEGWTHLEPGPYPIACGLDDKAASLDEQQTMFYGSVKTGYTIGYGLSLATLLVATAILSLFRKLHCTRNYIHMHLFISFILRAAAVFIKDLALFDSGESDQCSEGSVGCKAAMVFFQYCVMANFFWLLVEGLYLYTLLAVSFFSERKYFWGYILIGWGVPSTFTMVWTIARIHFEDYGCWDTINSSLWWIIKGPILTSILVNFILFICIIRILLQKLRPPDIRKSDSSPYSRLARSTLLLIPLFGVHYIMFAFFPDNFKPEVKMVFELVVGSFQGFVVAILYCFLNGEVQAELRRKWRRWHLQGVLGWNPKYRHPSGGSNGATCSTQVSMLTRVSPGARRSSSFQAEVSLV

SEQ ID NO: 5228 - protein, 438 aa, unidentified
MRTLLPPALLTCWLLAPVNSIHPECRFHLEIQEEETKCAELLRSQTEKHKACSGVWDNITCWRPANVGETVTVPCPKVFSNFYSKAGNISKNCTSDGWSETFPDFVDACGYSDPEDESKITFYILVKAIYTLGYSVSLMSLATGSIILCLFRKLHCTRNYIHLNLFLSFILRAISVLVKDDVLYSSSGTLHCPDQPSSWVGCKLSLVFLQYCIMANFFWLLVEGLYLHTLLVAMLPPRRCFLAYLLIGWGLPTVCIGAWTAARLYLEDTGCWDTNDHSVPWWVIRIPILISIIVNFVLFISIIRILLQKLTSPDVGGNDQSQYKRLAKSTLLLIPLFGVHYMVFAVFPISISSKYQILFELCLGSFQGLVVAVLYCFLNSEVQCELKRKWRSRCPTPSASRDYRVCGSSFSRNGSEGALQFHRGSRAQSFLQTETSVI

SEQ ID NO: 5229 - protein, 163 aa, unidentified
MGSTWGSPGWVRLALCLTGLVLSLYALHVKAARARDRDYRALCDVGTAISCSRVFSSRWGRGFGLVEHVLGQDSILNQSNSIFGCIFYTLQLLLGCLRTRWASVLMLLSSLVSLAGSVYLAWILFFVLYDFCIVCITTYAINVSLMWLSFRKVQEPQGKAKRH

SEQ ID NO: 5230 - protein, 176 aa, unidentified
MAAPVLLRVSVPRWERVARYAVCAAGILLSIYAYHVEREKERDPEHRALCDLGPWVKCSAALASRWGRGFGLLGSIFGKDGVLNQPNSVFGLIFYILQLLLGMTASAVAALILMTSSIMSVVGSLYLAYILYFVLKEFCIICIVTYVLNFLLLIINYKRLVYLNEAWKRQLQPKQD

SEQ ID NO: 5231 - protein, 873 aa, unidentified
MGTSALWALWLLLALCWAPRESGATGTGRKAKCEPSQFQCTNGRCITLLWKCDGDEDCVDGSDEKNCVKKTCAESDFVCNNGQCVPSRWKCDGDPDCEDGSDESPEQCHMRTCRIHEISCGAHSTQCIPVSWRCDGENDCDSGEDEENCGNITCSPDEFTCSSGRCISRNFVCNGQDDCSDGSDELDCAPPTCGAHEFQCSTSSCIPISWVCDDDADCSDQSDESLEQCGRQPVIHTKCPASEIQCGSGECIHKKWRCDGDPDCKDGSDEVNCPSRTCRPDQFECEDGSCIHGSRQCNGIRDCVDGSDEVNCKNVNQCLGPGKFKCRSGECIDISKVCNQEQDCRDWSDEPLKECHINECLVNNGGCSHICKDLVIGYECDCAAGFELIDRKTCGDIDECQNPGICSQICINLKGGYKCECSRGYQMDLATGVCKAVGKEPSLIFTNRRDIRKIGLERKEYIQLVEQLRNTVALDADIAAQKLFWADLSQKAIFSASIDDKVGRHVKMIDNVYNPAAIAVDWVYKTIYWTDAASKTISVATLDGTKRKFLFNSDLREPASIAVDPLSGFVYWSDWGEPAKIEKAGMNGFDRRPLVTADIQWPNGITLDLIKSRLYWLDSKLHMLSSVDLNGQDRRIVLKSLEFLAHPLALTIFEDRVYWIDGENEAVYGANKFTGSELATLVNNLNDAQDIIVYHELVQPSGKNWCEEDMENGGCEYLCLPAPQINDHSPKYTCSCPSGYNVEENGRDCQSTATTVTYSETKDTNTTEISATSGLVPGGINVTTAVSEVSVPPKGTSAAWAILPLLLLVMAAVGGYLMWRNWQHKNMKSMNFDNPVYLKTTEEDLSIDIGRHSASVGHTYPAISVVSTDDDLA

SEQ ID NO: 5232 - protein, 101 aa, unidentified
MERPDKAALNALQPPEFRNESSLASTLKTLLFFTALMITVPIGLYFTTKSYIFEGALGMSNRDSYFYAAIVAVVAVHVVLALFVYVAWNEGSRQWREGKQD

SEQ ID NO: 5233 - protein, 406 aa, unidentified
MAENGKNCDQRRVAMNKEHHNGNFTDPSSVNEKKRREREERQNIVLWRQPLITLQYFSLEILVILKEWTSKLWHRQSIVVSFLLLLAVLIATYYVEGVHQQYVQRIEKQFLLYAYWIGLGILSSVGLGTGLHTFLLYLGPHIASVTLAAYECNSVNFPEPPYPDQIICPDEEGTEGTISLWSIISKVRIEACMWGIGTAIGELPPYFMARAARLSGAEPDDEEYQEFEEMLEHAESAQDFASRAKLAVQKLVQKVGFFGILACASIPNPLFDLAGITCGHFLVPFWTFFGATLIGKAIIKMHIQKIFVIITFSKHIVEQMVAFIGAVPGIGPSLQKPFQEYLEAQRQKLHHKSEMGTPQGENWLSWMFEKLVVVMVCYFILSIINSMAQSYAKRIQQRLNSEEKTK

SEQ ID NO: 5234 - protein, 353 aa, unidentified
MVGDTLKLLSPLMTRYFFLLFYSTDSSDLNENQHPLDFDEMAFGKVKSGISFLIQTGVGILGNSFLLCFYNLILFTGHKLRPTDLILSQLALANSMVLFFKGIPQTMAAFGLKYLLNDTGCKFVFYYHRVGTRVSLSTICLLNGFQAIKLNPSICRWMEIKIRSPRFIDFCCLLCWAPHVLMNASVLLLVNGPLNSKNSSAKNNYGYCSYKASKRFSSLHAVLYFSPDFMSLGFMVWASGSMVFFLYRHKQQVQHNHSNRLSCRPSQEARATHTIMVLVSSFFVFYSVHSFLTIWTTVVANPGQWIVTNSVLVASCFPARSPFVLIMSDTHISQFCFACRTRKTLFPNLVVMP

SEQ ID NO: 5235 - protein, 395 aa, unidentified
MTHTLYPTPFALYPINISAAWHLGPLPVSCFVSNKYQCSLAFGATTGLRVLVVVVPQTQLSFLSSLCLVSLFLHSLVSAHGEKPTKPVGLDPTLFQVVVGILGNFSLLYYYMFLYFRGYKPRSTDLILRHLTVADSLVILSKRIPETMATFGLKHFDNYFGCKFLLYAHRVGRGVSIGSTCLLSVFQVITINPRNSRWAEMKVKAPTYIGLSNILCWAFHMLVNAIFPIYTTGKWSNNNITKKGDLGYCSAPLSDEVTKSVYAALTSFHDVLCLGLMLWASSSIVLVLYRHKQQVQHICRNNLYPNSSPGNRAIQSILALVSTFALCYALSFITYVYLALFDNSSWWLVNTAALIIACFPTISPFVLMCRDPSRSRLCSICCRRNRRFFHDFRKM

SEQ ID NO: 5236 - protein, 301 aa, unidentified
MASRYVAVGMILSQTVVGVLGSFSVLLHYLSFYCTGCRLRSTDLIVKHLIVANFLALRCKGVPQTMAAFGVRYFLNALGCKLVFYLHRVGRGVSIGTTCLLSVFQVITVSSRKSRWAKLKEKAPKHVGFSVLLCWIVCMLVNIIFPMYVTGKWNYTNITVNEDLGYCSGGGNNKIAQTLRAMLLSFPDVLCLGLMLWVSSSMVCILHRHKQRVQHIDRSDLSPRASPENRATQSILILVSTFVSSYTLSCLFQVCMALLDNPNSLLVNTSALMSVCFPTLSPFVLMSCDPSVYRFCFAWKR

SEQ ID NO: 5237 - protein, 520 aa, unidentified
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKYHLYSEPQFNVPEKPELVTFNTAFGRFGIFTCFDIFFYDPGVTLVKDFHVDTILFPTAWMNVLPLLTAIEFHSAWAMGMGVNLLVANTHHVSLNMTGSGIYAPNGPKVYHYDMKTELGKLLLSEVDSHPLSSLAYPTAVNWNAYATTIKPFPVQKNTFRGFISRDGFNFTELFENAGNLTVCQKELCCHLSYRMLQKEENEVYVLGAFTGLHGRRRREYWQVCTLLKCKTTNLTTCGRPVETASTRFEMFSLSGTFGTEYVFPEVLLTEIHLSPGKFEVLKDGRLVNKNGSSGPILTVSLFGRWYTKDSLYSSCGTSNSAITYLLIFILLMIIALQNIVML

SEQ ID NO: 5238 - protein, 172 aa, unidentified
MRRQPAKVAALLLGLLLECTEAKKHCWYFEGLYPTYYICRSYEDCCGSRCCVRALSIQRLWYFWFLLMMGVLFCCGAGFFIRRRMYPPPLIEEPAFNVSYTRQPPNPGPGAQQPGPPYYTDPGGPGMNPVGNSMAMAFQVPPNSPQGSVACPPPPAYCNTPPPPYEQVVKAK

SEQ ID NO: 5239 - protein, 396 aa, unidentified
MPRVKAAQAGRQSSAKRHLAEQFAVGEIITDMAKKEWKVGLPIGQGGFGCIYLADMNSSESVGSDAPCVVKVEPSDNGPLFTELKFYQRAAKPEQIQKWIRTRKLKYLGVPKYWGSGLHDKNGKSYRFMIMDRFGSDLQKIYEANAKRFSRKTVLQLSLRILDILEYIHEHEYVHGDIKASNLLLNYKNPDQVYLVDYGLAYRYCPEGVHKEYKEDPKRCHDGTIEFTSIDAHNGVAPSRRGDLEILGYCMIQWLTGHLPWEDNLKDPKYVRDSKIRYRENIASLMDKCFPEKNKPGEIAKYMETVKLLDYTEKPLYENLRDILLQGLKAIGSKDDGKLDLSVVENGGLKAKTITKKRKKEIEESKEPGVEDTEWSNTQTEEAIQTRSRTRKRVQK

SEQ ID NO: 5240 - protein, 508 aa, unidentified
MPPKRNEKYKLPIPFPEGKVLDDMEGNQWVLGKKIGSGGFGLIYLAFPTNKPEKDARHVVKVEYQENGPLFSELKFYQRVAKKDCIKKWIERKQLDYLGIPLFYGSGLTEFKGRSYRFMVMERLGIDLQKISGQNGTFKKSTVLQLGIRMLDVLEYIHENEYVHGDIKAANLLLGYKNPDQVYLADYGLSYRYCPNGNHKQYQENPRKGHNGTIEFTSLDAHKGVALSRRSDVEILGYCMLRWLCGKLPWEQNLKDPVAVQTAKTNLLDELPQSVLKWAPSGSSCCEIAQFLVCAHSLAYDEKPNYQALKKILNPHGIPLGPLDFSTKGQSINVHTPNSQKVDSQKAATKQVNKAHNRLIEKKVHSERSAESCATWKVQKEEKLIGLMNNEAAQESTRRRQKYQESQEPLNEVNSFPQKISYTQFPNSFYEPHQDFTSPDIFKKSRSPSWYKYTSTVSTGITDLESSTGLWPTISQFTLSEETNADVYYYRIIIPVLLMLVFLALFFL

SEQ ID NO: 5241 - protein, 387 aa, unidentified
MVFAFWKVFLILSCLAGQVSVVQVTIPDGFVNVTVGSNVTLICIYTTTVASREQLSIQWSFFHKKEMEPISIYFSQGGQAVAIGQFKDRITGSNDPGNASITISHMQPADSGIYICDVNNPPDFLGQNQGILNVSVLVKPSKPLCSVQGRPETGHTISLSCLSALGTPSPVYYWHKLEGRDIVPVKENFNPTTGILVIGNLTNFEQGYYQCTAINRLGNSSCEIDLTSSHPEVGIIVGALIGSLVGAAIIISVVCFARNKAKAKAKERNSKTIAELEPMTKINPRGESEAMPREDATQLEVTLPSSIHETGPDTIQEPDYEPKPTQEPAPEPAPGSEPMAVPDLDIELELEPETQSELEPEPEPEPESEPGVVVEPLSEDEKGVVKA

SEQ ID NO: 5242 - protein, 540 aa, unidentified
MAAGGSAPEPRVLVCLGALLAGWVAVGLEAVVIGEVHENVTLHCGNISGLRGQVTWYRNNSEPVFLLSSNSSLRPAEPRFSLVDATSLHIESLSLGDEGIYTCQEILNVTQWFQVWLQVASGPYQIEVHIVATGTLPNGTLYAARGSQVDFSCNSSSRPPPVVEWWFQALNSSSESFGHNLTVNFFSLLLISPNLQGNYTCLALNQLSKRHRKVTTELLVYYPPPSAPQCWAQMASGSFMLQLTCRWDGGYPDPDFLWIEEPGGVIVGKSKLGVEMLSESQLSDGKKFKCVTSHIVGPESGASCMVQIRGPSLLSEPMKTCFTGGNVTLTCQVSGAYPPAKILWLRNLTQPEVIIQPSSRHLITQDGQNSTLTIHNCSQDLDEGYYICRADSPVGVREMEIWLSVKEPLNIGGIVGTIVSLLLLGLAIISGLLLHYSPVFCWKVGNTSRGQNMDDVMVLVDSEEEEEEEEEEEEDAAVGEQEGAREREELPKEIPKQDHIHRVTALVNGNIEQMGNGFQDLQDDSSEEQSDIVQEEDRPV

SEQ ID NO: 5243 - protein, 867 aa, unidentified
MDNPQALPLFLLLASLVGILTLRASSGLQQTNFSSAFSSDSKSSSQGLGVEVPSIKPPSWKVPDQFLDSKASAGISDSSWFPEALSSNMSGSFWSNVSAEGQDLSPVSPFSETPGSEVFPDISDPQVPAKDPKPSFTVKTPASNISTQVSHTKLSVEAPDSKFSPDDMDLKLSAQSPESKFSAETHSAASFPQQVGGPLAVLVGTTIRLPLVPIPNPGPPTSLVVWRRGSKVLAAGGLGPGAPLISLDPAHRDHLRFDQARGVLELASAQLDDAGVYTAEVIRAGVSQQTHEFTVGVYEPLPQLSVQPKAPETEEGAAELRLRCLGWGPGRGELSWSRDGRALEAAESEGAETPRMRSEGDQLLIVRPVRSDHARYTCRVRSPFGHREAAADVSVFYGPDPPTITVSSDRDAAPARFVTAGSNVTLRCAAASRPPADITWSLADPAEAAVPAGSRLLLPAVGPGHAGTYACLAANPRTGRRRRSLLNLTVADLPPGAPQCSVEGGPGDRSLRFRCSWPGGAPAASLQFQGLPEGIRAGPVSSVLLAAVPAHPRLSGVPITCLARHLVATRTCTVTPEAPREVLLHPLVAETRLGEAEVALEASGCPPPSRASWAREGRPLAPGGGSRLRLSQDGRKLHIGNFSLDWDLGNYSVLCSGALGAGGDQITLIGPSISSWRLQRARDAAVLTWDVERGALISSFEIQAWPDGPALGRTSTYRDWVSLLILGPQERSAVVPLPPRNPGTWTFRILPILGGQPGTPSQSRVYRAGPTLSHGAIAGIVLGSLLGLALLAVLLLLCICCLCRFRGKTPEKKKHPSTLVPVVTPSEKKMHSVTPVEISWPLDLKVPLEDHSSTRAYQAQTPVQLSL

SEQ ID NO: 5244 - protein, 327 aa, unidentified
MAELPGPFLCGALLGFLCLSGLAVEVKVPTEPLSTPLGKTAELTCTYSTSVGDSFALEWSFVQPGKPISESHPILYFTNGHLYPTGSKSKRVSLLQNPPTVGVATLKLTDVHPSDTGTYLCQVNNPPDFYTNGLGLINLTVLVPPSNPLCSQSGQTSVGGSTALRCSSSEGAPKPVYNWVRLGTFPTPSPGSMVQDEVSGQLILTNLSLTSSGTYRCVATNQMGSASCELTLSVTEPSQGRVAGALIGVLLGVLLLSVAAFCLVRFQKERGKKPKETYGGSDLREDAIAPGISEHTCMRADSSKGFLERPSSASTVTTTKSKLPMVV

SEQ ID NO: 5245 - protein, 399 aa, unidentified
MGILLGLLLLGHLTVDTYGRPILEVPESVTGPWKGDVNLPCTYDPLQGYTQVLVKWLVQRGSDPVTIFLRDSSGDHIQQAKYQGRLHVSHKVPGDVSLQLSTLEMDDRSHYTCEVTWQTPDGNQVVRDKITELRVQKLSVSKPTVTTGSGYGFTVPQGMRISLQCQARGSPPISYIWYKQQTNNQEPIKVATLSTLLFKPAVIADSGSYFCTAKGQVGSEQHSDIVKFVVKDSSKLLKTKTEAPTTMTYPLKATSTVKQSWDWTTDMDGYLGETSAGPGKSLPVFAIILIISLCCMVVFTMAYIMLCRKTSQQEHVYEAARAHAREANDSGETMRVAIFASGCSSDEPTSQNLGNNYSDEPCIGQEYQIIAQINGNYARLLDTVPLDYEFLATEGKSVC

SEQ ID NO: 5246 - protein, 311 aa, unidentified
MGVPTALEAGSWRWGSLLFALFLAASLGPVAAFKVATPYSLYVCPEGQNVTLTCRLLGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSNCVVYPSSSQDSENITAAALATGACIVGILCLPLILLLVYKQRQAASNRRAQELVRMDSNIQGIENPGFEASPPAQGIPEAKVRHPLSYVAQRQPSESGRHLLSEPSTPLSPPGPGDVFFPSLDPVPDSPNFEVI

SEQ ID NO: 5247 - protein, 236 aa, unidentified
MTAEFLSLLCLGLCLGYEDEKKNEKPPKPSLHAWPSSVVEAESNVTLKCQAHSQNVTFVLRKVNDSGYKQEQSSAENEAEFPFTDLKPKDAGRYFCAYKTTASHEWSESSEHLQLVVTDKHDELEAPSMKTDTRTIFVAIFSCISILLLFLSVFIIYRCSQHSSSSEESTKRTSHSKLPEQEAAEADLSNMERVSLSTADPQGVTYAELSTSALSEAASDTTQEPPGSHEYAALKV

SEQ ID NO: 5248 - protein, 320 aa, unidentified
MRLLALAAAALLARAPAPEVCAALNVTVSPGPVVDYLEGENATLLCHVSQKRRKDSLLAVRWFFAHSFDSQEALMVKMTKLRVVQYYGNFSRSAKRRRLRLLEEQRGALYRLSVLTLQPSDQGHYVCRVQEISRHRNKWTAWSNGSSATEMRVISLKASEESSFEKTKETWAFFEDLYVYAVLVCCVGILSILLFMLVIVWQSVFNKRKSRVRHYLVKCPQNSSGETVTSVTSLAPLQPKKGKRQKEKPDIPPAVPAKAPIAPTFHKPKLLKPQRKVTLPKIAEENLTYAELELIKPHRAAKGAPTSTVYAQILFEENKL

SEQ ID NO: 5249 - protein, 200 aa, unidentified
MRPLPSGRRKTRGISLGLFALCLAAARCLQSQGVSLYIPQATINATVKEDILLSVEYSCHGVPTIEWTYSSNWGTQKIVEWKPGTQANISQSHKDRVCTFDNGSIQLFSVGVRDSGYYVITVTERLGSSQFGTIVLHVSEILYEDLHFVAVILAFLAAVAAVLISLMWVCNKCAYKFQRKRRHKLKESTTEEIELEDVEC

SEQ ID NO: 5250 - protein, 282 aa, unidentified
MASLGQILFWSIISIIIILAGAIALIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 5251 - protein, 217 aa, unidentified
MSSDFEGYEQDFAVLTAEITSKIARVPRLPPDEKKQMVANVEKQLEEAKELLEQMDLEVREIPPQSRGMYSNRMRSYKQEMGKLETDFKRSRIAYSDEVRNELLGDDGNSSENQRAHLLDNTERLERSSRRLEAGYQIAVETEQIGQEMLENLSHDREKIQRARERLRETDANLGKSSRILTGMLRRIIQNRILLVILGIIVVITILMAITFSVRRH

SEQ ID NO: 5252 - protein, 232 aa, unidentified
MASSAASSEHFEKLHEIFRGLHEDLQGVPERLLGTAGTEEKKKLIRDFDEKQQEANETLAEMEEELRYAPLSFRNPMMSKLRNYRKDLAKLHREVRSTPLTATPGGRGDMKYGIYAVENEHMNRLQSQRAMLLQGTESLNRATQSIERSHRIATETDQIGSEIIEELGEQRDQLERTKSRLVNTSENLSKSRKILRSMSRKVTTNKLLLSIIILLELAILGGLVYYKFFRSH

SEQ ID NO: 5253 - protein, 647 aa, unidentified
MVMYARKQQRLSDGCHDRRGDSQPYQALKYSSKSHPSSGDHRHEKMRDAGDPSPPNKMLRRSDSPENKYSDSTGHSKAKNVHTHRVRERDGGTSYSPQENSHNHSALHSSNSHSSNPSNNPSKTSDAPYDSADDWSEHISSSGKKYYYNCRTEVSQWEKPKEWLEREQRQKEANKMAVNSFPKDRDYRREVMQATATSGFASGMEDKHSSDASSLLPQNILSQTSRHNDRDYRLPRAETHSSSTPVQHPIKPVVHPTATPSTVPSSPFTLQSDHQPKKSFDANGASTLSKLPTPTSSVPAQKTERKESTSGDKPVSHSCTTPSTSSASGLNPTSAPPTSASAVPVSPVPQSPIPPLLQDPNLLRQLLPALQATLQLNNSNVDISKINEVLTAAVTQASLQSIIHKFLTAGPSAFNITSLISQAAQLSTQAQPSNQSPMSLTSDASSPRSYVSPRISTPQTNTVPIKPLISTPPVSSQPKVSTPVVKQGPVSQSATQQPVTADKQQGHEPVSPRSLQRSSSQRSPSPGPNHTSNSSNASNATVVPQNSSARSTCSLTPALAAHFSENLIKHVQGWPADHAEKQASRLREEAHNMGTIHMSEICTELKNLRSLVRVCEIQATLREQRILFLRQQIKELEKLKNQNSFMV

SEQ ID NO: 5254 - protein, 303 aa, unidentified
MARASSGNGSEEAWGALRAPQQQSPAASSLEGAIWRRAGTQTRALDAILYHPQQSHLLRELCPGVNNQPYLCESGHCCGETGCCTYYYELWWFWLLWTVLILFSCCCAFRHRRAKLRLQQQQRQREINLLAYHGACHGAGPFPTGSLLDLRFLSTFKPPAYEDVVHRPGTPPPPYTVAPGRPLTASSEQTCCSSSSSCPAHFEGTNVEGVSSHQSAPPHQEGEPGAGVTPASTPPSCRYRRLTGDSGIELCPCPASGEGEPVKEVRVSATLPDLEDYSPCALPPESVPQIFPMGLSSSEGDIP

SEQ ID NO: 5255 - protein, 342 aa, unidentified
MPFLLGLRQDKEACVGTNNQSYICDTGHCCGQSQCCNYYYELWWFWLVWTIIIILSCCCVCHHRRAKHRLQAQQRQHEINLIAYREAHNYSALPFYFRFLPNYLLPPYEEVVNRPPTPPPPYSAFQLQQQQLLPPQCGPAGGSPPGIDPTRGSQGAQSSPLSEPSRSSTRPPSIADPDPSDLPVDRAATKAPGMEPSGSVAGLGELDPGAFLDKDAECREELLKDDSSEHGAPDSKEKTPGRHRRFTGDSGIEVCVCNRGHHDDDLKEFNTLIDDALDGPLDFCDSCHVRPPGDEEEGLCQSSEEQAREPGHPHLPRPPACLLLNTINEQDSPNSQSSSSPS

SEQ ID NO: 5256 - protein, 265 aa, unidentified
MEALPPVRSSLLGILLQVTRLSVLLVQNRDHLYNFLLLKINLFNHWVSGLAQEARGSCNWQAHLPLGAAACPLGQALWAGLALIQVPVWLVLQGPRLMWAGMWGSTKGLGLALLSAWEQLGLSVAIWTDLFLSCLHGLMLVALLLVVVTWRVCQKSHCFRLGRQLSKALQVNCVVRKLLVQLRRLYWWVETMTALTSWHLAYLITWTTCLASHLLQAAFEHTTQLAEAQEVEPQEVSGSSLLPSLSASSDSESGTVLPEQETPRE

SEQ ID NO: 5257 - protein, 3184 aa, unidentified
MEAEDLSKAEDRNEDPGSKNEGQLAAVQPDVPHGGQSSSPTALWDMLERKFLEYQQLTHKSPIERQKSLLSLLPLFLKAWEHSVGIICFPSLQRLAEDVSDQLAQQLQKALVGKPAEQARLAAGQLLWWKGDVDQDGYLLLKSVYVLTGTDSETLGRVAESGLPALLLQCLYLFFVFPLDKDELLESDLQVQKMFVQMLLNICSDSQGLEGLLSGSELQSLLIATTCLREHSCCFWKEPTFCVLRAISKAQNLSIIQYLQATDCVRLSLQNLSRLTDTLPAPEVSEAVSLILGFVKDSYPVSSALFLEFENSEGYPLLLKVLLRYDGLTQSEVDPHLEELLGLVVWLTTCGRSELKVFDSITYPQLEGFKFHHEASGVTVKNLQAFQVLQNVFHKASDSVLCIQVLSVIRTMWAWNARNFFLLEWTLQPISQFVEIMPLKPAPVQEHFFQLLEALVFELHYVPHEILRKVQHLIKESPGPSCTLMALQSILSIAGGDPLFTDIFRDSGLLGLLLAQLRKQAKIMRKSGNKVSTPGVQDPERELTCVMLRIVVTLLKGSVRNAVVLKDHGMVPFIKIFLDDECYREASLSILEQLSAINAEEYMSIIVGALCSSTQGELQLKLDLLKSLLRILVTPKGRAAFRVSSGFNGLLSLLSDLEGSLQEPPLQAWGAVSPRQTLELVLYTLCAVSAALHWDPVNGYFFRRNGLFEKLAEDLCLLGCFGALEEEGNLLRSWVDTKARPFADLLGTAFSSSGSLPPRIQSCLQILGFLDSMASGTLHLRGDLKESLRTKQGPVVDVQKGETGSDPQRNFKQWPDLEERMDEGDAAIMHPGVVCIMVRLLPRLYHEDHPQLSEEIQCSLASHIQSLVKSEKNRQVMCEAGLLGTLMASCHRALVTSGSPLHSRLIRIFEKLASQAIEPDVLRQFLGLGIPSSLSATTKILDSSHTHRGNPGCSGSQTAQGLAEGPWPAAPDAGLHPGVTQAPQPLGESQDSTTALQTALSLISMTSPRNLQPQRAALAPSFVEFDMSVEGYGCLFIPTLSTVMGTSTEYSVSGGIGTGATRPFPPPGGLTFSCWFLISRHGAATEGHPLRFLTLVRHLARTEQPFVCFSVSLCPDDLSLVVSTEEKEFQPLDVMEPEDDSEPSAGCQLQVRCGQLLACGQWHHLAVVVTKEMKRHCTVSTCLDGQVIGSAKMLYIQALPGPFLSMDPSAFVDVYGYIATPRVWKQKSSLIWRLGPTYLFEEAISMETLEVINKLGPRYCGNFQAVHVQGEDLDSEATPFVAEERVSFGLHIASSSITSVADIRNAYNEVDSRLIAKEMNISSRDNAMPVFLLRNCAGHLSGSLRTIGAVAVGQLGVRVFHSSPAASSLDFIGGPAILLGLISLATDDHTMYAAVKVLHSVLTSNAMCDFLMQHICGYQIMAFLLRKKASLLNHRIFQLILSVAGTVELGFRSSAITNTGVFQHILCNFELWMNTADNLELSLFSHLLEILQSPREGPRNAEAAHQAQLIPKLIFLFNEPSLIPSKISTIIGILACQLRGHFSTQDLLRIGLFVVYTLKPSSVNERQICMDGALDPSLPAGSQTSGKTIWLRNQLLEMLLSVISSPQLHLSSESKEEMFLKLGPDWFLLLLQGHLHASTTVLALKLLLYFLASPSLRTRFRDGLCAGSWVERSTEGVDIVMDNLKSQSPLPEQSPCLLPGFRVLNDFLAHHVHIPEVYLIVSTFFLQTPLTELMDGPKDSLDAMLQWLLQRHHQEEVLQAGLCTEGALLLLEMLKATMSQPLAGSEDGAWAQTFPASVLQFLSLVHRTYPQDPAWRAPEFLQTLAIAAFPLGAQKGVGAESTRNTSSPEAAAEGDSTVEGLQAPTKAHPARRKLREFTQLLLRELLLGASSPKQWLPLEVLLEASPDHATSQQKRDFQSEVLLSAMELFHMTSGGDAAMFRDGKEPQPSAEAAAAPSLANISCFTQKLVEKLYSGMFSADPRHILLFILEHIMVVIETASSQRDTVLSTLYSSLNKVILYCLSKPQQSLSECLGLLSILGFLQEHWDVVFATYNSNISFLLCLMHCLLLLNERSYPEGFGLEPKPRMSTYHQVFLSPNEDVKEKREDLPSLSDVQHNIQKTVQTLWQQLVAQRQQTLEDAFKIDLSVKPGEREVKIEEVTPLWEETMLKAWQHYLASEKKSLASRSNVAHHSKVTLWSGSLSSAMKLMPGRQAKDPECKTEDFVSCIENYRRRGQELYASLYKDHVQRRKCGNIKAANAWARIQEQLFGELGLWSQGEETKPCSPWELDWREGPARMRKRIKRLSPLEALSSGRHKESQDKNDHISQTNAENQDELTLREAEGEPDEVGVDCTQLTFFPALHESLHSEDFLELCRERQVILQELLDKEKVTQKFSLVIVQGHLVSEGVLLFGHQHFYICENFTLSPTGDVYCTRHCLSNISDPFIFNLCSKDRSTDHYSCQCHSYADMRELRQARFLLQDIALEIFFHNGYSKFLVFYNNDRSKAFKSFCSFQPSLKGKATSEDTLSLRRYPGSDRIMLQKWQKRDISNFEYLMYLNTAAGRTCNDYMQYPVFPWVLADYTSETLNLANPKIFRDLSKPMGAQTKERKLKFIQRFKEVEKTEGDMTVQCHYYTHYSSAIIVASYLVRMPPFTQAFCALQGGSFDVADRMFHSVKSTWESASRENMSDVRELTPEFFYLPEFLTNCNGVEFGCMQDGTVLGDVQLPPWADGDPRKFISLHRKALESDFVSANLHHWIDLIFGYKQQGPAAVDAVNIFHPYFYGDRMDLSSITDPLIKSTILGFVSNFGQVPKQLFTKPHPARTAAGKPLPGKDVSTPVSLPGHPQPFFYSLQSLRPSQVTVKDMYLFSLGSESPKGAIGHIVSTEKTILAVERNKVLLPPLWNRTFSWGFDDFSCCLGSYGSDKVLMTFENLAAWGRCLCAVCPSPTTIVTSGTSTVVCVWELSMTKGRPRGLRLRQALYGHTQAVTCLAASVTFSLLVSGSQDCTCILWDLDHLTHVTRLPAHREGISAITISDVSGTIVSCAGAHLSLWNVNGQPLASITTAWGPEGAITCCCLMEGPAWDTSQIIITGSQDGMVRVWKTEDVKMSVPGRPAGEEPPAQPPSPRGHKWEKNLALSRELDVSIALTGKPSKTSPAVTALAVSRNHTKLLVGDERGRIFCWSADG

SEQ ID NO: 5258 - protein, 1129 aa, unidentified
MPATRKPMRYGHTEGHTEVCFDDSGSFIVTCGSDGDVRIWEDLDDDDPKFINVGEKAYSCALKSGKLVTAVSNNTIQVHTFPEGVPDGILTRFTTNANHVVFNGDGTKIAAGSSDFLVKIVDVMDSSQQKTFRGHDAPVLSLSFDPKDIFLASASCDGSVRVWQISDQTCAISWPLLQKCNDVINAKSICRLAWQPKSGKLLAIPVEKSVKLYRRESWSHQFDLSDNFISQTLNIVTWSPCGQYLAAGSINGLIIVWNVETKDCMERVKHEKGYAICGLAWHPTCGRISYTDAEGNLGLLENVCDPSGKTSSSKVSSRVEKDYNDLFDGDDMSNAGDFLNDNAVEIPSFSKGIINDDEDDEDLMMASGRPRQRSHILEDDENSVDISMLKTGSSLLKEEEEDGQEGSIHNLPLVTSQRPFYDGPMPTPRQKPFQSGSTPLHLTHRFMVWNSIGIIRCYNDEQDNAIDVEFHDTSIHHATHLSNTLNYTIADLSHEAILLACESTDELASKLHCLHFSSWDSSKEWIIDLPQNEDIEAICLGQGWAAAATSALLLRLFTIGGVQKEVFSLAGPVVSMAGHGEQLFIVYHRGTGFDGDQCLGVQLLELGKKKKQILHGDPLPLTRKSYLAWIGFSAEGTPCYVDSEGIVRMLNRGLGNTWTPICNTREHCKGKSDHYWVVGIHENPQQLRCIPCKGSRFPPTLPRPAVAILSFKLPYCQIATEKGQMEEQFWRSVIFHNHLDYLAKNGYEYEESTKNQATKEQQELLMKMLALSCKLEREFRCVELADLMTQNAVNLAIKYASRSRKLILAQKLSELAVEKAAELTATQVEEEEEEEDFRKKLNAGYSNTATEWSQPRFRNQVEEDAEDSGEADDEEKPEIHKPGQNSFSKSTNSSDVSAKSGAVTFSSQGRVNPFKVSASSKEPAMSMNSARSTNILDNMGKSSKKSTALSRTTNNEKSPIIKPLIPKPKPKQASAASYFQKRNSQTNKTEEVKEENLKNVLSETPAICPPQNTENQRPKTGFQMWLEENRSNILSDNPDFSDEADIIKEGMIRFRVLSTEERKVWANKAKGETASEGTEAKKRKRVVDESDETENQEEKAKENLNLSKKQKPLDFSTNQKLSAFAFKQE

SEQ ID NO: 5259 - protein, 1224 aa, unidentified
MLPYTVNFKVSARTLTGALNAHNKAAVDWGWQGLIAYGCHSLVVVIDSITAQTLQVLEKHKADVVKVKWARENYHHNIGSPYCLRLASADVNGKIIVWDVAAGVAQCEIQEHAKPIQDVQWLWNQDASRDLLLAIHPPNYIVLWNADTGTKLWKKSYADNILSFSFDPFDPSHLTLLTSEGIVFISDFSPSKPPSGPGKKVYISSPHSSPAHNKLATATGAKKALNKVKILITQEKPSAEFITLNDCLQLAYLPSKRNHMLLLYPREILILDLEVNQTVGVIAIERTGVPFLQVIPCFQRDGLFCLHENGCITLRVRRSYNNIFTTSNEEPDPDPVQELTYDLRSQCDAIRVTKTVRPFSMVCCPVNENAAALVVSDGRVMIWELKSAVCNRNSRNSSSGVSPLYSPVSFCGIPVGVLQNKLPDLSLDNMIGQSAIAGEEHPRGSILREVHLKFLLTGLLSGLPAPQFAIRMCPPLTTKNIKMYQPLLAVGTSNGSVLVYHLTSGLLHKELSIHSCEVKGIEWTSLTSFLSFATSTPNNMGLVRNELQLVDLPTGRSIAFRGERGNDESAIEMIKVSHLKQYLAVVFRDKPLELWDVRTCTLLREMSKNFPTITALEWSPSHNLKSLRKKQLATREAMARQTVVSDTELSIVESSVISLLQEAESKSELSQNISAREHFVFTDIDGQVYHLTVEGNSVKDSARIPPDGSMGSITCIAWKGDTLVLGDMDGNLNFWDLKGRVSRGIPTHRSWVRKIRFAPGKGNQKLIAMYNDGAEVWDTKEVQMVSSLRSGRNVTFRILDVDWCTSDKVILASDDGCIRVLEMSMKSACFRMDEQELTEPVWCPYLLVPRASLALKAFLLHQPWNGQYSLDISHVDYPENEEIKNLLQEQLNSLSNDIKKLLLDPEFTLLQRCLLVSRLYGDESELHFWTVAAHYLHSLSQEKSASTTAPKEAAPRDKLSNPLDICYDVLCENAYFQKFQLERVNLQEVKRSTYDHTRKCTDQLLLLGQTDRAVQLLLETSADNQHYYCDSLKACLVTTVTSSGPSQSTIKLVATNMIANGKLAEGVQLLCLIDKAADACRYLQTYGEWNRAAWLAKVRLNPEECADVLRRWVDHLCSPQVNQKSKALLVLLSLGCFFSVAETLHSMRYFDRAALFVEACLKYGAFEVTEDTEKLITAIYADYARSLKNLGFKQGAVLFASKAGAAGKDLLNELESPKEEPIEE

SEQ ID NO: 5260 - protein, 1322 aa, unidentified
MAWMTYISNWFEQDDWYEGLQRANMSQVRQVGLLAAGCQPWNKDVCAASGDRFAYCATLAIYIYQLDHRYNEFKLHAIMSEHKKTITAISWCPHNPDLFASGSTDNLVIIWNVAEQKVIAKLDSTKGIPASLSWCWNAEDVVAFVSHRGPLFIWTISGPDSGVIVHKDAHSFLSDICMFRWHTHQKGKVVFGHIDGSLSIFHPGNKNQKHVLRPESLEGTDEEDPVTALEWDPLSTDYLLVVNLHYGIRLVDSESLSCITTFNLPSAAASVQCLAWVPSAPGMFITGDSQVGVLRIWNVSRTTPIDNLKLKKTGFHCLHVLNSPPRKKFSVQSPTKNHYTSSTSEAVPPPTLTQNQAFSLPPGHAVCCFLDGGVGLYDMGAKKWDFLRDLGHVETIFDCKFKPDDPNLLATASFDGTIKVWDINTLTAVYTSPGNEGVIYSLSWAPGGLNCIAGGTSRNGAFIWNVQKGKIIQRFNEHGTNGIFCIAWSHKDSKRIATCSSDGFCIIRTIDGKVLHKYKHPAAVFGCDWSQNNKDMIATGCEDTNVRVYYVATSSDQPLKVFSGHTAKVFHVKWSPLREGILCSGSDDGTVRIWDYTQDACINILNGHTAPVRGLMWNTEIPYLLISGSWDYTIKVWDTREGTCVDTVYDHGADVYGLTCHPSRPFTMASCSRDSTVRLWSLTALVTPVQINILADRSWEEIIGNTDYAIEPGTPPLLCGKVSRDIRQEIEKLTANSQVKKLRWFSECLSPPGGSDNLWNLVAVIKGQDDSLLPQNYCKGIMHLKHLIKFRTSEAQELTTVKMSKFGGGIGVPAKEERLKEAAEIHLRLGQIQRYCELMVELGEWDKALSIAPGVSVKYWKKLMQRRADQLIQEDKDDVIPYCIAIGDVKKLVHFFMSRGQLKEALLVAQAACEGNMQPLHVSVPKGASYSDDIYKEDFNELLHKVSKELAEWYFQDGRAVLAACCHLAIDNIELAMAYLIRGNELELAVCVGTVLGESAAPATHYALELLARKCMMISVCFPCVGYSVPFCYVNRNLAADLLLMIPDNELHLIKLCAFYPGCTEEINDLHDKCKLPTVEECMQLAETARADDNIFETVKYYLLSQEPEKALPIGISFVKEYISSSDWTLDTIYPVLDLLSYIRTEKLLLHTCTEARNELLILCGYIGALLAIRRQYQSIVPALYEYTSQLLKRREVSVPLKIEYLSEELDAWRACTQSTNRSLEDSPYTPPSDSQRMIYATLLKRLKEESLKGIIGPDYVTGSNLPSHSDIHISCLTGLKIQGPVFFLEDGKSAISLNDALMWAKVNPFSPLGTGIRLNPF

SEQ ID NO: 5261 - protein, 1336 aa, unidentified
MATEIGSPPRFFHMPRFQHQAPRQLFYKRPDFAQQQAMQQLTFDGKRMRKAVNRKTIDYNPSVIKYLENRIWQRDQRDMRAIQPDAGYYNDLVPPIGMLNNPMNAVTTKFVRTSTNKVKCPVFVVRWTPEGRRLVTGASSGEFTLWNGLTFNFETILQAHDSPVRAMTWSHNDMWMLTADHGGYVKYWQSNMNNVKMFQAHKEAIREASFSPTDNKFATCSDDGTVRIWDFLRCHEERILRGHGADVKCVDWHPTKGLVVSGSKDSQQPIKFWDPKTGQSLATLHAHKNTVMEVKLNLNGNWLLTASRDHLCKLFDIRNLKEELQVFRGHKKEATAVAWHPVHEGLFASGGSDGSLLFWHVGVEKEVGGMEMAHEGMIWSLAWHPLGHILCSGSNDHTSKFWTRNRPGDKMRDRYNLNLLPGMSEDGVEYDDLEPNSLAVIPGMGIPEQLKLAMEQEQMGKDESNEIEMTIPGLDWGMEEVMQKDQKKVPQKKVPYAKPIPAQFQQAWMQNKVPIPAPNEVLNDRKEDIKLEEKKKTQAEIEQEMATLQYTNPQLLEQLKIERLAQKQVEQIQPPPSSGTPLLGPQPFPGQGPMSQIPQGFQQPHPSQQMPMNMAQMGPPGPQGQFRPPGPQGQMGPQGPPLHQGGGGPQGFMGPQGPQGPPQGLPRPQDMHGPQGMQRHPGPHGPLGPQGPPGPQGSSGPQGHMGPQGPPGPQGHIGPQGPPGPQGHLGPQGPPGTQGMQGPPGPRGMQGPPHPHGIQGGPGSQGIQGPVSQGPLMGLNPRGMQGPPGPRENQGPAPQGMIMGHPPQEMRGPHPPGGLLGHGPQEMRGPQEIRGMQGPPPQGSMLGPPQELRGPPGSQSQQGPPQGSLGPPPQGGMQGPPGPQGQQNPARGPHPSQGPIPFQQQKTPLLGDGPRAPFNQEGQSTGPPPLIPGLGQQGAQGRIPPLNPGQGPGPNKGDSRGPPNHHMGPMSERRHEQSGGPEHGPERGPFRGGQDCRGPPDRRGPHPDFPDDFSRPDDFHPDKRFGHRLREFEGRGGPLPQEEKWRRGGPGPPFPPDHREFSEGDGRGAARGPPGAWEGRRPGDERFPRDPEDPRFRGRREESFRRGAPPRHEGRAPPRGRDGFPGPEDFGPEENFDASEEAARGRDLRGRGRGTPRGGRKGLLPTPDEFPRFEGGRKPDSWDGNREPGPGHEHFRDTPRPDHPPHDGHSPASRERSSSLQGMDMASLPPRKRPWHDGPGTSEHREMEAPGGPSEDRGGKGRGGPGPAQRVPKSGRSSSLDGEHHDGYHRDEPFGGPPGSGTPSRGGRSGSNWGRGSNMNSGPPRRGASRGGGRGR

SEQ ID NO: 5262 - protein, 360 aa, unidentified
MTQQPLRGVTSLRFNQDQSCFCCAMETGVRIYNVEPLMEKGHLDHEQVGSMGLVEMLHRSNLLALVGGGSSPKFSEISVLIWDDAREGKDSKEKLVLEFTFTKPVLSVRMRHDKIVIVLKNRIYVYSFPDNPRKLFEFDTRDNPKGLCDLCPSLEKQLLVFPGHKCGSLQLVDLASTKPGTSSAPFTINAHQSDIACVSLNQPGTVVASASQKGTLIRLFDTQSKEKLVELRRGTDPATLYCINFSHDSSFLCASSDKGTVHIFALKDTRLNRRSALARVGKVGPMIGQYVDSQWSLASFTVPAESACICAFGRNTSKNVNSVIAICVDGTFHKYVFTPDGNCNREAFDVYLDICDDDDF

SEQ ID NO: 5263 - protein, 106 aa, unidentified
MSTNNMSDPRRPNKVLRYKPPPSECNPALDDPTPDYMNLLGMIFSMCGLMLKLKWCAWVAVYCSFISFANSRSSEDTKQMMSSFMLSISAVVMSYLQNPQPMTPPW

SEQ ID NO: 5264 - protein, 890 aa, unidentified
MDSNTAPLGPSCPQPPPAPQPQARSRLNATASLEQERSERPRAPGPQAGPGPGVRDAAAPAEPQAQHTRSRERADGTGPTKGDMEIPFEEVLERAKAGDPKAQTEVGKHYLQLAGDTDEELNSCTAVDWLVLAAKQGRREAVKLLRRCLADRRGITSENEREVRQLSSETDLERAVRKAALVMYWKLNPKKKKQVAVAELLENVGQVNEHDGGAQPGPVPKSLQKQRRMLERLVSSESKNYIALDDFVEITKKYAKGVIPSSLFLQDDEDDDELAGKSPEDLPLRLKVVKYPLHAIMEIKEYLIDMASRAGMHWLSTIIPTHHINALIFFFIVSNLTIDFFAFFIPLVIFYLSFISMVICTLKVFQDSKAWENFRTLTDLLLRFEPNLDVEQAEVNFGWNHLEPYAHFLLSVFFVIFSFPIASKDCIPCSELAVITGFFTVTSYLSLSTHAEPYTRRALATEVTAGLLSLLPSMPLNWPYLKVLGQTFITVPVGHLVVLNVSVPCLLYVYLLYLFFRMAQLRNFKGTYCYLVPYLVCFMWCELSVVILLESTGLGLLRASIGYFLFLFALPILVAGLALVGVLQFARWFTSLELTKIAVTVAVCSVPLLLRWWTKASFSVVGMVKSLTRSSMVKLILVWLTAIVLFCWFYVYRSEGMKVYNSTLTWQQYGALCGPRAWKETNMARTQILCSHLEGHRVTWTGRFKYVRVTDIDNSAESAINMLPFFIGDWMRCLYGEAYPACSPGNTSTAEEELCRLKLLAKHPCHIKKFDRYKFEITVGMPFSSGADGSRSREEDDVTKDIVLRASSEFKSVLLSLRQGSLIEFSTILEGRLGSKWPVFELKAISCLNCMAQLSPTRRHVKIEHDWRSTVHGAVKFAFDFFFFPFLSAA

SEQ ID NO: 5265 - protein, 907 aa, unidentified
MNAPLDGLSVSSSSTGSLGSAAGAGGGGGAGLRLLSANVRQLHQALTALLSEAEREQFTHCLNAYHARRNVFDLVRTLRVLLDSPVKRRLLPMLRLVIPRSDQLLFDQYTAEGLYLPATTPYRQPAWGGPDSAGPGEVRLVSLRRAKAHEGLGFSIRGGSEHGVGIYVSLVEPGSLAEKEGLRVGDQILRVNDKSLARVTHAEAVKALKGSKKLVLSVYSAGRIPGGYVTNHIYTWVDPQGRSISPPSGLPQPHGGALRQQEGDRRSTLHLLQGGDEKKVNLVLGDGRSLGLTIRGGAEYGLGIYITGVDPGSEAEGSGLKVGDQILEVNGRSFLNILHDEAVRLLKSSRHLILTVKDVGRLPHARTTVDETKWIASSRIRETMANSAGFLGDLTTEGINKPGFYKGPAGSQVTLSSLGNQTRVLLEEQARHLLNEQEHATMAYYLDEYRGGSVSVEALVMALFKLLNTHAKFSLLSEVRGTISPQDLERFDHLVLRREIESMKARQPPGPGAGDTYSMVSYSDTGSSTGSHGTSTTVSSARNTLDLEETGEAVQGNINALPDVSVDDVRSTSQGLSSFKPLPRPPPLAQGNDLPLGQPRKLGREDLQPPSSMPSCSGTVFSAPQNRSPPAGTAPTPGTSSAQDLPSSPIYASVSPANPSSKRPLDAHLALVNQHPIGPFPRVQSPPHLKSPSAEATVAGGCLLPPSPSGHPDQTGTNQHFVMVEVHRPDSEPDVNEVRALPQTRTASTLSQLSDSGQTLSEDSGVDAGEAEASAPGRGRQSVSTKSRSSKELPRNERPTDGANKPPGLLEPTSTLVRVKKSAATLGIAIEGGANTRQPLPRIVTIQRGGSAHNCGQLKVGHVILEVNGLTLRGKEHREAARIIAEAFKTKDRDYIDFLVTEFNVML

SEQ ID NO: 5266 - protein, 541 aa, unidentified
MAGAIIENMSTKKLCIVGGILLVFQIIAFLVGGLIAPGPTTAVSYMSVKCVDARKNHHKTKWFVPWGPNHCDKIRDIEEAIPREIEANDIVFSVHIPLPHMEMSPWFQFMLFILQLDIAFKLNNQIRENAEVSMDVSLAYRDDAFAEWTEMAHERVPRKLKCTFTSPKTPEHEGRYYECDVLPFMEIGSVAHKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWMLLFGDIRQGIFYAMLLSFWIIFCGEHMMDQHERNHIAGYWKQVGPIAVGSFCLFIFDMCERGVQLTNPFYSIWTTDIGTELAMAFIIVAGICLCLYFLFLCFMVFQVFRNISGKQSSLPAMSKVRRLHYEGLIFRFKFLMLITLACAAMTVIFFIVSQVTEGHWKWGGVTVQVNSAFFTGIYGMWNLYVFALMFLYAPSHKNYGEDQSNGDLGVHSGEELQLTTTITHVDGPTEIYKLTRKEAQE

SEQ ID NO: 5267 - protein, 417 aa, unidentified
MGSAHPRPWLRLRPQPQPRPALWVLLFFLLLLAAAMPRSAPNDILDLRLPPEPVLNANTVCLTLPGLSRRQMEVCVRHPDVAASAIQGIQIAIHECQHQFRDQRWNCSSLETRNKIPYESPIFSRGFRESAFAYAIAAAGVVHAVSNACALGKLKACGCDASRRGDEEAFRRKLHRLQLDALQRGKGLSHGVPEHPALPTASPGLQDSWEWGGCSPDMGFGERFSKDFLDSREPHRDIHARMRLHNNRVGRQAVMENMRRKCKCHGTSGSCQLKTCWQVTPEFRTVGALLRSRFHRATLIRPHNRNGGQLEPGPAGAPSPAPGAPGPRRRASPADLVYFEKSPDFCEREPRLDSAGTVGRLCNKSSAGSDGCGSMCCGRGHNILRQTRSERCHCRFHWCCFVVCEECRITEWVSVCK

SEQ ID NO: 5268 - protein, 391 aa, unidentified
MLRPGGAEEAAQLPLRRASAPVPVPSPAAPDGSRASARLGLACLLLLLLLTLPARVDTSWWYIGALGARVICDNIPGLVSRQRQLCQRYPDIMRSVGEGAREWIRECQHQFRHHRWNCTTLDRDHTVFGRVMLRSSREAAFVYAISSAGVVHAITRACSQGELSVCSCDPYTRGRHHDQRGDFDWGGCSDNIHYGVRFAKAFVDAKEKRLKDARALMNLHNNRCGRTAVRRFLKLECKCHGVSGSCTLRTCWRALSDFRRTGDYLRRRYDGAVQVMATQDGANFTAARQGYRRATRTDLVYFDNSPDYCVLDKAAGSLGTAGRVCSKTSKGTDGCEIMCCGRGYDTTRVTRVTQCECKFHWCCAVRCKECRNTVDVHTCKAPKKAEWLDQT

SEQ ID NO: 5269 - protein, 351 aa, unidentified
MSPRSCLRSLRLLVFAVFSAAASNWLYLAKLSSVGSISEEETCEKLKGLIQRQVQMCKRNLEVMDSVRRGAQLAIEECQYQFRNRRWNCSTLDSLPVFGKVVTQGTREAAFVYAISSAGVAFAVTRACSSGELEKCGCDRTVHGVSPQGFQWSGCSDNIAYGVAFSQSFVDVRERSKGASSSRALMNLHNNEAGRKAILTHMRVECKCHGVSGSCEVKTCWRAVPPFRQVGHALKEKFDGATEVEPRRVGSSRALVPRNAQFKPHTDEDLVYLEPSPDFCEQDMRSGVLGTRGRTCNKTSKAIDGCELLCCGRGFHTAQVELAERCSCKFHWCCFVKCRQCQRLVELHTCR

SEQ ID NO: 5270 - protein, 174 aa, unidentified
MSSAAADHWAWLLVLSFVFGCNVLRILLPSFSSFMSRVLQKDAEQESQMRAEIQDMKQELSTVNMMDEFARYARLERKINKMTDKLKTHVKARTAQLAKIKWVISVAFYVLQAALMISLIWKYYSVPVAVVPSKWITPLDRLVAFPTRVAGGVGITCWILVCNKVVAIVLHPFS

SEQ ID NO: 5271 - protein, 922 aa, unidentified
MATASPRSDTSNNHSGRLQLQVTVSSAKLKRKKNWFGTAIYTEVVVDGEITKTAKSSSSSNPKWDEQLTVNVTPQTTLEFQVWSHRTLKADALLGKATIDLKQALLIHNRKLERVKEQLKLSLENKNGIAQTGELTVVLDGLVIEQENITNCSSSPTIEIQENGDALHENGEPSARTTARLAVEGTNGIDNHVPTSTLVQNSCCSYVVNGDNTPSSPSQVAARPKNTPAPKPLASEPADDTVNGESSSFAPTDNASVTGTPVVSEENALSPNCTSTTVEDPPVQEILTSSENNECIPSTSAELESEARSILEPDTSNSRSSSAFEAAKSRQPDGCMDPVRQQSGNANTETLPSGWEQRKDPHGRTYYVDHNTRTTTWERPQPLPPGWERRVDDRRRVYYVDHNTRTTTWQRPTMESVRNFEQWQSQRNQLQGAMQQFNQRYLYSASMLAAENDPYGPLPPGWEKRVDSTDRVYFVNHNTKTTQWEDPRTQGLQNEEPLPEGWEIRYTREGVRYFVDHNTRTTTFKDPRNGKSSVTKGGPQIAYERGFRWKLAHFRYLCQSNALPSHVKINVSRQTLFEDSFQQIMALKPYDLRRRLYVIFRGEEGLDYGGLAREWFFLLSHEVLNPMYCLFEYAGKNNYCLQINPASTINPDHLSYFCFIGRFIAMALFHGKFIDTGFSLPFYKRMLSKKLTIKDLESIDTEFYNSLIWIRDNNIEECGLEMYFSVDMEILGKVTSHDLKLGGSNILVTEENKDEYIGLMTEWRFSRGVQEQTKAFLDGFNEVVPLQWLQYFDEKELEVMLCGMQEVDLADWQRNTVYRHYTRNSKQIIWFWQFVKETDNEVRMRLLQFVTGTCRLPLGGFAELMGSNGPQKFCIEKVGKDTWLPRSHTCFNRLDLPPYKSYEQLKEKLLFAIEETEGFGQE

SEQ ID NO: 5272 - protein, 261 aa, unidentified
MVVVAAAPNPADGTPKVLLLSGQPASAAGAPAGQALPLMVPAQRGASPEAASGGLPQARKRQRLTHLSPEEKALRRKLKNRVAAQTARDRKKARMSELEQQVVDLEEENQKLLLENQLLREKTHGLVVENQELRQRLGMDALVAEEEAEAKGNEVRPVAGSAESAALRLRAPLQQVQAQLSPLQNISPWILAVLTLQIQSLISCWAFWTTWTQSCSSNALPQSLPAWRSSQRSTQKDPVPYQPPFLCQWGRHQPSWKPLMN

SEQ ID NO: 5273 - protein, 333 aa, unidentified
MESSGNPESTTFFYYDLQSQPCENQAWVFATLATTVLYCLVFLLSLVGNSLVLWVLVKYESLESLTNIFILNLCLSDLVFACLLPVWISPYHWGWVLGDFLCKLLNMIFSISLYSSIFFLTIMTIHRYLSVVSPLSTLRVPTLRCRVLVTMAVWVASILSSILDTIFHKVLSSGCDYSELTWYLTSVYQHNLFFLLSLGIILFCYVEILRTLFRSRSKRRHRTVKLIFAIVVAYFLSWGPYNFTLFLQTLFRTQIIRSCEAKQQLEYALLICRNLAFSHCCFNPVLYVFVGVKFRTHLKHVLRQFWFCRLQAPSPASIPHSPGAFAYEGASFY

SEQ ID NO: 5274 - protein, 180 aa, unidentified
MESWWGLPCLAFLCFLMHARGQRDFDLADALDDPEPTKKPNSDIYPKPKPPYYPQPENPDSGGNIYPRPKPRPQPQPGNSGNSGGYFNDVDRDDGRYPPRPRPRPPAGGGGGGYSSYGNSDNTHGGDHHSTYGNPEGNMVAKIVSPIVSVVVVTLLGAAASYFKLNNRRNCFRTHEPENV

SEQ ID NO: 5275 - protein, 444 aa, unidentified
MKFPASVLASVFLFVAETTAALSLSSTYRSGGDRMWQALTLLFSLLPCALVQLTLLFVHRDLSRDRPLVLLLHLLQLGPLFRCFEVFCIYFQSGNNEEPYVSITKKRQMPKNGLSEEIEKEVGQAEGKLITHRSAFSRASVIQAFLGSAPQLTLQLYISVMQQDVTVGRSLLMTISLLSIVYGALRCNILAIKIKYDEYEVKVKPLAYVCIFLWRSFEIATRVVVLVLFTSVLKTWVVVIILINFFSFFLYPWILFWCSGSPFPENIEKALSRVGTTIVLCFLTLLYTGINMFCWSAVQLKIDSPDLISKSHNWYQLLVYYMIRFIENAILLLLWYLFKTDIYMYVCAPLLVLQLLIGYCTAILFMLVFYQFFHPCKKLFSSSVSEGFQRWLRCFCWACRQQKPCEPIGKEDLQSSRDRDETPSSSKTSPEPGQFLNAEDLCSA

SEQ ID NO: 5276 - protein, 459 aa, unidentified
METVFEEMDEESTGGVSSSKEEIVLGQRLHLSFPFSIIFSTVLYCGEVAFGLYMFEIYRKANDTFWMSFTISFIIVGAILDQIILMFFNKDLRRNKAALLFWHILLLGPIVRCLHTIRNYHKWLKNLKQEKEETQVSITKRNTMLEREIAFSIRDNFMQQKAFKYMSVIQAFLGSVPQLILQMYISLTIREWPLNRALLMTFSLLSVTYGAIRCNILAIQISNDDTTIKLPPIEFFCVVMWRFLEVISRVVTLAFFIASLKLKSLPVLLIIYFVSLLAPWLEFWKSGAHLPGNKENNSNMVGTVLMLFLITLLYAAINFSCWSAVKLQLSDDKIIDGRQRWGHRILHYSFQFLENVIMILVFRFFGGKTLLNCCDSLIAVQLIISYLLATGFMLLFYQYLYPWQSGKVLPGRTENQPEAPYYYVNIEKTEKNKNKQLRNYCHSCNRVGYFSIRKSMTCS

SEQ ID NO: 5277 - protein, 650 aa, unidentified
MAAKSDGRLKMKKSSDVAFTPLQNSDHSGSVQGLAPGLPSGSGAEDEEAAGGGCCPDGGGCSRCCCCCAGSGGSAGSGGSGGVAGPGGGGAGSAALCLRLGREQRRYSLWDCLWILAAVAVYFADVGTDVWLAVDYYLRGQRWWFGLTLFFVVLGSLSVQVFSFRWFVHDFSTEDSATAAAASSCPQPGADCKTVVGGGSAAGEGEARPSTPQRQASNASKSNIAAANSGSNSSGATRASGKHRSASCSFCIWLLQSLIHILQLGQIWRYFHTIYLGIRSRQSGENDRWRFYWKMVYEYADVSMLHLLATFLESAPQLVLQLCIIVQTHSLQALQGFTAAASLVSLAWALASYQKALRDSRDDKKPISYMAVIIQFCWHFFTIAARVITFALFASVFQLYFGIFIVLHWCIMTFWIVHCETEFCITKWEEIVFDMVVGIIYIFSWFNVKEGRTRCRLFIYYFVILLENTALSALWYLYKAPQIADAFAIPALCVVFSSFLTGVVFMLMYYAFFHPNGPRFGQSPSCACEDPAAAFTLPPDVATSTLRSISNNRSVVSDRDQKFAERDGCVPVFQVRPTAPSTPSSRPPRIEESVIKIDLFRNRYPAWERHVLDRSLRKAILAFECSPSPPRLQYKDDALIQERLEYETTL

SEQ ID NO: 5278 - protein, 641 aa, unidentified
MAAKSDGGGVGVGFAQLHNLDEAVGSGGEEDGEPGGGGCGGGGDGSEPGESSSMHICHCCNTSSCYWGCRSACLRSLLGRKPRRSAAADGGDQPLQPPAAPGAGRQPPTPSAARPEPPPPQVERPWLDCLWIVLALLVFFGDVGTDLWLALDYYRKGDYVYFGLTLFFVLVPSLLVQSLSFRWFVQDYTGGGLGAVEGLTSRGPPMMGAGYVHGAARGGPGVRVSPTPGAQRLCRLSVWIWQSVIHLLQMGQVWRYIRTMYLGIQSQRRKEHQRRFYWAMMYEYADVNMLRLLETFLESAPQLVLQLYIMLQKNSAETLPCVSSVTSLMSLAWVLASYHKLLRDSRDDKKSMSYRGAIIQVFWRLFTISSRVISFALFASIFQLYFGIFVVVHWCAMAFWIIHGGTDFCMSKWEEILFNMVVGIVYIFCWFNVKEGRTRYRMFAYYTIVLTENAALTFLWYFYRDPETTDSYAVPALCCVFISFVAGIAMMLLYYGVLHPTGPRAKILASSCCAELLWGIPLPPDVEPMAPEIPGYRGTQVTPTRAVTEQQEDLTADTCLPVFQVRPMGPPTPLGRPYLPEGPLIKIDMPRKRYPAWDAHFVDRRLRRTINILQYVTPTAVGIRYRDGPLLYELLQYESSL

SEQ ID NO: 5279 - protein, 579 aa, unidentified
MAAKSDGAAASASPDPEGAAGGARGSAGGRGEAAAAAGPPGVVGAGGPGPRYELRDCCWVLCALLVFFSDGATDLWLAASYYLQNQHTYFSLTLLFVLLPSLVVQLLSFRWFVYDYSEPAGSPGPAVSTKDSVAGGAAISTKDSAGAFRTKEGSPEPGPQPAPSSASAYRRRCCRLCIWLLQTLVHLLQLGQVWRYLRALYLGLQSRWRGERLRRHFYWQMLFESADVSMLRLLETFLRSAPQLVLQLSLLVHRGGAPDLLPALSTSASLVSLAWTLASYQKVLRDSRDDKRPLSYKGAVAQVLWHLFSIAARGLAFALFASVYKLYFGIFIVAHWCVMTFWVIQGETDFCMSKWEEIIYNMVVGIIYIFCWFNVKEGRSRRRMTLYHCIVLLENAALTGFWYSSRNFSTDFYSLIMVCVVASSFALGIFFMCVYYCLLHPNGPMLGPQAPGCIFRKASEPCGPPADAITSPPRSLPRTTGAERDGASAGERAGTPTPPVFQVRPGLPPTPVARTLRTEGPVIRIDLPRKKYPAWDAHFIDRRLRKTILALEYSSPATPRLQYRSVGTSQELLEYETTV

SEQ ID NO: 5280 - protein, 395 aa, unidentified
MPWSSRGALLRDLVLGVLGTAAFLLDLGTDLWAAVQYALGGRYLWAALVLALLGLASVALQLFSWLWLRADPAGLHGSQPPRRCLALLHLLQLGYLYRCVQELRQGLLVWQQEEPSEFDLAYADFLALDISMLRLFETFLETAPQLTLVLAIMLQSGRAEYYQWVGICTSFLGISWALLDYHRALRTCLPSKPLLGLGSSVIYFLWNLLLLWPRVLAVALFSALFPSYVALHFLGLWLVLLLWVWLQGTDFMPDPSSEWLYRVTVATILYFSWFNVAEGRTRGRAIIHFAFLLSDSILLVATWVTHSSWLPSGIPLQLWLPVGCGCFFLGLALRLVYYHWLHPSCCWKPDPDQVDGARSLLSPEGYQLPQNRRMTHLAQKFFPKAKDEAASPVKG

SEQ ID NO: 5281 - protein, 373 aa, unidentified
MKYTKQNFMMSVLGIIIYVTDLIVDIWVSVRFFHEGQYVFSALALSFMLFGTLVAQCFSYSWFKADLKKAGQESQHCFLLLHCLQGGVFTRYWFALKRGYHAAFKYDSNTSNFVEEQIDLHKEVIDRVTDLSMLRLFETYLEGCPQLILQLYILLEHGQANFSQYAAIMVSCCAISWSTVDYQVALRKSLPDKKLLNGLCPKITYLFYKLFTLLSWMLSVVLLLFLNVKIALFLLLFLWLLGIIWAFKNNTQFCTCISMEFLYRIVVGFILIFTFFNIKGQNTKCPMSCYYIVRVLGTLGILTVFWVCPLTIFNPDYFIPISITIVLTLLLGILFLIVYYGSFHPNRSAETKCDEIDGKPVLRECRMRYFLME

SEQ ID NO: 5282 - protein, 449 aa, unidentified
MDRVYEIPEEPNVDPVSSLEEDVIRGANPRFTFPFSILFSTFLYCGEAASALYMVRIYRKNSETYWMTYTFSFFMFSSIMVQLTLIFVHRDLAKDKPLSLFMHLILLGPVIRCLEAMIKYLTLWKKEEQEEPYVSLTRKKMLIDGEEVLIEWEVGHSIRTLAMHRNAYKRMSQIQAFLGSVPQLTYQLYVSLISAEVPLGRVVLMVFSLVSVTYGATLCNMLAIQIKYDDYKIRLGPLEVLCITIWRTLEITSRLLILVLFSATLKLKAVPFLVLNFLIILFEPWIKFWRSGAQMPNNIEKNFSRVGTLVVLISVTILYAGINFSCWSALQLRLADRDLVDKGQNWGHMGLHYSVRLVENVIMVLVFKFFGVKVLLNYCHSLIALQLIIAYLISIGFMLLFFQYLHPLRSLFTHNVVDYLHCVCCHQHPRTRVENSEPPFETEARQSVV

SEQ ID NO: 5283 - protein, 1087 aa, unidentified
MADHVQSLAQLENLCKQLYETTDTTTRLQAEKALVEFTNSPDCLSKCQLLLERGSSSYSQLLAATCLTKLVSRTNNPLPLEQRIDIRNYVLNYLATRPKLATFVTQALIQLYARITKLGWFDCQKDDYVFRNAITDVTRFLQDSVEYCIIGVTILSQLTNEINQADTTHPLTKHRKIASSFRDSSLFDIFTLSCNLLKQASGKNLNLNDESQHGLLMQLLKLTHNCLNFDFIGTSTDESSDDLCTVQIPTSWRSAFLDSSTLQLFFDLYHSIPPSFSPLVLSCLVQIASVRRSLFNNAERAKFLSHLVDGVKRILENPQSLSDPNNYHEFCRLLARLKSNYQLGELVKVENYPEVIRLIANFTVTSLQHWEFAPNSVHYLLSLWQRLAASVPYVKATEPHMLETYTPEVTKAYITSRLESVHIILRDGLEDPLEDTGLVQQQLDQLSTIGRCEYEKTCALLVQLFDQSAQSYQELLQSASASPMDIAVQEGRLTWLVYIIGAVIGGRVSFASTDEQDAMDGELVCRVLQLMNLTDSRLAQAGNEKLELAMLSFFEQFRKIYIGDQVQKSSKLYRRLSEVLGLNDETMVLSVFIGKIITNLKYWGRCEPITSKTLQLLNDLSIGYSSVRKLVKLSAVQFMLNNHTSEHFSFLGINNQSNLTDMRCRTTFYTALGRLLMVDLGEDEDQYEQFMLPLTAAFEAVAQMFSTNSFNEQEAKRTLVGLVRDLRGIAFAFNAKTSFMMLFEWIYPSYMPILQRAIELWYHDPACTTPVLKLMAELVHNRSQRLQFDVSSPNGILLFRETSKMITMYGNRILTLGEVPKDQVYALKLKGISICFSMLKAALSGSYVNFGVFRLYGDDALDNALQTFIKLLLSIPHSDLLDYPKLSQSYYSLLEVLTQDHMNFIASLEPHVIMYILSSISEGLTALDTMVCTGCCSCLDHIVTYLFKQLSRSTKKRTTPLNQESDRFLHIMQQHPEMIQQMLSTVLNIIIFEDCRNQWSMSRPLLGLILLNEKYFSDLRNSIVNSQPPEKQQAMHLCFENLMEGIERNLLTKNRDRFTQNLSAFRREVNDSMKNSTYGVNSNDMMS

SEQ ID NO: 5284 - protein, 696 aa, unidentified
MKFAEHLSAHITPEWRKQYIQYEAFKDMLYSAQDQAPSVEVTDEDTVKRYFAKFEEKFFQTCEKELAKINTFYSEKLAEAQRRFATLQNELQSSLDAQKESTGVTTLRQRRKPVFHLSHEERVQHRNIKDLKLAFSEFYLSLILLQNYQNLNFTGFRKILKKHDKILETSRGADWRVAHVEVAPFYTCKKINQLISETEAVVTNELEDGDRQKAMKRLRVPPLGAAQPAPAWTTFRVGLFCGIFIVLNITLVLAAVFKLETDRSIWPLIRIYRGGFLLIEFLFLLGINTYGWRQAGVNHVLIFELNPRSNLSHQHLFEIAGFLGILWCLSLLACFFAPISVIPTYVYPLALYGFMVFFLINPTKTFYYKSRFWLLKLLFRVFTAPFHKVGFADFWLADQLNSLSVILMDLEYMICFYSLELKWDESKGLLPNNSEESGICHKYTYGVRAIVQCIPAWLRFIQCLRRYRDTKRAFPHLVNAGKYSTTFFMVTFAALYSTHKERGHSDTMVFFYLWIVFYIISSCYTLIWDLKMDWGLFDKNAGENTFLREEIVYPQKAYYYCAIIEDVILRFAWTIQISITSTTLLPHSGDIIATVFAPLEVFRRFVWNFFRLENEHLNNCGEFRAVRDISVAPLNADDQTLLEQMMDQDDGVRNRQKNRSWKYNQSISLRRPRLASQSKARDTKVLIEDTDDEANT

SEQ ID NO: 5285 - protein, 293 aa, unidentified
MAYHSGYGAHGSKHRARAAPDPPPLFDDTSGGYSSQPGGYPATGADVAFSVNHLLGDPMANVAMAYGSSIASHGKDMVHKELHRFVSVSKLKYFFAVDTAYVAKKLGLLVFPYTHQNWEVQYSRDAPLPPRQDLNAPDLYIPTMAFITYVLLAGMALGIQKRFSPEVLGLCASTALVWVVMEVLALLLGLYLATVRSDLSTFHLLAYSGYKYVGMILSVLTGLLFGSDGYYVALAWTSSALMYFIVRSLRTAALGPDSMGGPVPRQRLQLYLTLGAAAFQPLIIYWLTFHLVR

SEQ ID NO: 5286 - protein, 314 aa, unidentified
MHPAGLAAAAAGTPRLRKWPSKRRIPVSQPGMADPHQLFDDTSSAQSRGYGAQRAPGGLSYPAASPTPHAAFLADPVSNMAMAYGSSLAAQGKELVDKNIDRFIPITKLKYYFAVDTMYVGRKLGLLFFPYLHQDWEVQYQQDTPVAPRFDVNAPDLYIPAMAFITYVLVAGLALGTQDRFSPDLLGLQASSALAWLTLEVLAILLSLYLVTVNTDLTTIDLVAFLGYKYVGMIGGVLMGLLFGKIGYYLVLGWCCVAIFVFMIRTLRLKILADAAAEGVPVRGARNQLRMYLTMAVAAAQPMLMYWLTFHLVR

SEQ ID NO: 5287 - protein, 306 aa, unidentified
MAAVDDLQFEEFGNAATSLTANPDATTVNIEDPGETPKHQPGSPRGSGREEDDELLGNDDSDKTELLAGQKKSSPFWTFEYYQTFFDVDTYQVFDRIKGSLLPIPGKNFVRLYIRSNPDLYGPFWICATLVFAIAISGNLSNFLIHLGEKTYHYVPEFRKVSIAATIIYAYAWLVPLALWGFLMWRNSKVMNIVSYSFLEIVCVYGYSLFIYIPTAILWIIPQKAVRWILVMIALGISGSLLAMTFWPAVREDNRRVALATIVTIVLLHMLLSVGCLAYFFDAPEMDHLPTTTATPNQTVAAAKSS

SEQ ID NO: 5288 - protein, 316 aa, unidentified
MASADELTFHEFEEATNLLADTPDAATTSRSDQLTPQGHVAVAVGSGGSYGAEDEVEEESDKAALLQEQQQQQQPGFWTFSYYQSFFDVDTSQVLDRIKGSLLPRPGHNFVRHHLRNRPDLYGPFWICATLAFVLAVTGNLTLVLAQRRDPSIHYSPQFHKVTVAGISIYCYAWLVPLALWGFLRWRKGVQERMGPYTFLETVCIYGYSLFVFIPMVVLWLIPVPWLQWLFGALALGLSAAGLVFTLWPVVREDTRLVATVLLSVVVLLHALLAMGCKLYFFQSLPPENVAPPPQITSLPSNIALSPTLPQSLAPS

SEQ ID NO: 5289 - protein, 350 aa, unidentified
MATTAAPAGGARNGAGPEWGGFEENIQGGGSAVIDMENMDDTSGSSFEDMGELHQRLREEEVDADAADAAAAEEEDGEFLGMKGFKGQLSRQVADQMWQAGKRQASRAFSLYANIDILRPYFDVEPAQVRSRLLESMIPIKMVNFPQKIAGELYGPLMLVFTLVAILLHGMKTSDTIIREGTLMGTAIGTCFGYWLGVSSFIYFLAYLCNAQITMLQMLALLGYGLFGHCIVLFITYNIHLHALFYLFWLLVGGLSTLRMVAVLVSRTVGPTQRLLLCGTLAALHMLFLLYLHFAYHKVVEGILDTLEGPNIPPIQRVPRDIPAMLPAARLPTTVLNATAKAVAVTLQSH

SEQ ID NO: 5290 - protein, 244 aa, unidentified
MQPPGPPPAYAPTNGDFTFVSSADAEDLSGSIASPDVKLNLGGDFIKESTATTFLRQRGYGWLLEVEDDDPEDNKPLLEELDIDLKDIYYKIRCVLMPMPSLGFNRQVVRDNPDFWGPLAVVLFFSMISLYGQFRVVSWIITIWIFGSLTIFLLARVLGGEVAYGQVLGVIGYSLLPLIVIAPVLLVVGSFEVVSTLIKLFGVFWAAYSAASLLVGEEFKTKKPLLIYPIFLLYIYFLSLYTGV

SEQ ID NO: 5291 - protein, 257 aa, unidentified
MSGFENLNTDFYQTSYSIDDQSQQSYDYGGSGGPYSKQYAGYDYSQQGRFVPPDMMQPQQPYTGQIYQPTQAYTPASPQPFYGNNFEDEPPLLEELGINFDHIWQKTLTVLHPLKVADGSIMNETDLAGPMVFCLAFGATLLLAGKIQFGYVYGISAIGCLGMFCLLNLMSMTGVSFGCVASVLGYCLLPMILLSSFAVIFSLQGMVGIILTAGIIGWCSFSASKIFISALAMEGQQLLVAYPCALLYGVFALISVF

SEQ ID NO: 5292 - protein, 236 aa, unidentified
MAEAEESPGDPGTASPRPLFAGLSDISISQDIPVEGEITIPMRSRIREFDSSTLNESVRNTIMRDLKAVGKKFMHVLYPRKSNTLLRDWDLWGPLILCVTLALMLQRDSADSEKDGGPQFAEVFVIVWFGAVTITLNSKLLGGNISFFQSLCVLGYCILPLTVAMLICRLVLLADPGPVNFMVRLFVVIVMFAWSIVASTAFLADSQPPNRRALAVYPVFLFYFVISWMILTFTPQ

SEQ ID NO: 5293 - protein, 280 aa, unidentified
MDLLKISHTKLHLLEDLSIKNKQRMSNLAQFDSDFYQSNFTIDNQEQSGNDSNAYGNLYGSRKQQAGEQPQPASFVPSEMLMSSGYAGQFFQPASNSDYYSQSPYIDSFDEEPPLLEELGIHFDHIWQKTLTVLNPMKPVDGSIMNETDLTGPILFCVALGATLLLAGKVQFGYVYGMSAIGCLVIHALLNLMSSSGVSYGCVASVLGYCLLPMVILSGCAMFFSLQGIFGIMSSLVIIGWCSLSASKIFIAALHMEGQQLLVAYPCAILYGLFALLTIF

SEQ ID NO: 5294 - protein, 773 aa, unidentified
MFSLSSTVQPQVTVPLSHLINAFHTPKNTSVSLSGVSVSQNQHRDVVPEHEAPSSECMFSDFLTKLNIVSIGKGKIFEGYRSMFMEPAKRMKKSLDTTDNWHIRPEPFSLSIPPSLNLRDLGLSELKIGQIDQLVENLLPGFCKGKNISSHWHTSHVSAQSFFENKYGNLDIFSTLRSSCLYRHHSRALQSICSDLQYWPVFIQSRGFKTLKSRTRRLQSTSERLAETQNIAPSFVKGFLLRDRGSDVESLDKLMKTKNIPEAHQDAFKTGFAEGFLKAQALTQKTNDSLRRTRLILFVLLLFGIYGLLKNPFLSVRFRTTTGLDSAVDPVQMKNVTFEHVKGVEEAKQELQEVVEFLKNPQKFTILGGKLPKGILLVGPPGTGKTLLARAVAGEADVPFYYASGSEFDEMFVGVGASRIRNLFREAKANAPCVIFIDELDSVGGKRIESPMHPYSRQTINQLLAEMDGFKPNEGVIIIGATNFPEALDNALIRPGRFDMQVTVPRPDVKGRTEILKWYLNKIKFDQSVDPEIIARGTVGFSGAELENLVNQAALKAAVDGKEMVTMKELEFSKDKILMGPERRSVEIDNKNKTITAYHESGHAIIAYYTKDAMPINKATIMPRGPTLGHVSLLPENDRWNETRAQLLAQMDVSMGGRVAEELIFGTDHITTGASSDFDNATKIAKRMVTKFGMSEKLGVMTYSDTGKLSPETQSAIEQEIRILLRDSYERAKHILKTHAKEHKNLAEALLTYETLDAKEIQIVLEGKKLEVR

SEQ ID NO: 5295 - protein, 412 aa, unidentified
MMALWSLLHLTFLGFSITLLLVHGQGFQGTAAIWPSLFNVNLSKKVQESIQIPNNGSAPLLVDVRVFVSNVFNVDILRYTMSSMLLLRLSWLDTRLAWNTSAHPRHAITLPWESLWTPRLTILEALWVDWRDQSPQARVDQDGHVKLNLALATETNCNFELLHFPRDHSNCSLSFYALSNTAMELEFQAHVVNEIVSVKREYVVYDLKTQVPPQQLVPCFQVTLRLKNTALKSIIALLVPAEALLLADVCGGLLPLRAIERIGYKVTLLLSYLVLHSSLVQALPSSSSCNPLLIYYFTILLLLLFLSTIETVLLAGLLARGNLGAKSGPSPAPRGEQREHGNPGPHPAEEPSRGVKGSQRSWPETADRIFFLVYVVGVLCTQFVFAGIWMWAACKSDAAPGEAAPHGRRPRL

SEQ ID NO: 5296 - protein, 2812 aa, unidentified
MVPPVWTLLLLVGAALFRKEKPPDQKLVVRSSRDNYVLTQCDFEDDAKPLCDWSQVSADDEDWVRASGPSPTGSTGAPGGYPNGEGSYLHMESNSFHRGGVARLLSPDLWEQGPLCVHFAHHMFGLSWGAQLRLLLLSGEEGRRPDVLWKHWNTQRPSWMLTTVTVPAGFTLPTRLMFEGTRGSTAYLDIALDALSIRRGSCNRVCMMQTCSFDIPNDLCDWTWIPTASGAKWTQKKGSSGKPGVGPDGDFSSPGSGCYMLLDPKNARPGQKAVLLSPVSLSSGCLSFSFHYILRGQSPGAALHIYASVLGSIRKHTLFSGQPGPNWQAVSVNYTAVGRIQFAVVGVFGKTPEPAVAVDATSIAPCGEGFPQCDFEDNAHPFCDWVQTSGDGGHWALGHKNGPVHGMGPAGGFPNAGGHYIYLEADEFSQAGQSVRLVSRPFCAPGDICVEFAYHMYGLGEGTMLELLLGSPAGSPPIPLWKRVGSQRPYWQNTSVTVPSGHQQPMQLIFKGIQGSNTASVVAMGFILINPGTCPVKVLPELPPVSPVSSTGPSETTGLTENPTISTKKPTVSIEKPSVTTEKPTVPKEKPTIPTEKPTISTEKPTIPSEKPNMPSEKPTIPSEKPTILTEKPTIPSEKPTIPSEKPTISTEKPTVPTEEPTTPTEETTTSMEEPVIPTEKPSIPTEKPSIPTEKPTISMEETIISTEKPTISPEKPTIPTEKPTIPTEKSTISPEKPTTPTEKPTIPTEKPTISPEKPTTPTEKPTISPEKLTIPTEKPTIPTEKPTIPTEKPTISTEEPTTPTEETTISTEKPSIPMEKPTLPTEETTTSVEETTISTEKLTIPMEKPTISTEKPTIPTEKPTISPEKLTIPTEKLTIPTEKPTIPIEETTISTEKLTIPTEKPTISPEKPTISTEKPTIPTEKPTIPTEETTISTEKLTIPTEKPTISPEKLTIPTEKPTISTEKPTIPTEKLTIPTEKPTIPTEKPTIPTEKLTALRPPHPSPTATGLAALVMSPHAPSTPMTSVILGTTTTSRSSTERCPPNARYESCACPASCKSPRPSCGPLCREGCVCNPGFLFSDNHCIQASSCNCFYNNDYYEPGAEWFSPNCTEHCRCWPGSRVECQISQCGTHTVCQLKNGQYGCHPYAGTATCLVYGDPHYVTFDGRHFGFMGKCTYILAQPCGNSTDPFFRVTAKNEEQGQEGVSCLSKVYVTLPESTVTLLKGRRTLVGGQQVTLPAIPSKGVFLGASGRFVELQTEFGLRVRWDGDQQLYVTVSSTYSGKLCGLCGNYDGNSDNDHLKLDGSPAGDKEELGNSWQTDQDEDQECQKYQVVNSPSCDSSLQSSMSGPGFCGRLVDTHGPFETCLLHVKAASFFDSCMLDMCGFQGLQHLLCTHMSTMTTTCQDAGHAVKPWREPHFCPMACPPNSKYSLCAKPCPDTCHSGFSGMFCSDRCVEACECNPGFVLSGLECIPRSQCGCLHPAGSYFKVGERWYKPGCKELCVCESNNRIRCQPWRCRAQEFCGQQDGIYGCHAQGAATCTASGDPHYLTFDGALHHFMGTCTYVLTRPCWSRSQDSYFVVSATNENRGGILEVSYIKAVHVTVFDLSISLLRGCKVMLNGHRVALPVWLAQGRVTIRLSSNLVLLYTNFGLQVRYDGSHLVEVTVPSSYGGQLCGLCGNYNNNSLDDNLRPDRKLAGDSMQLGAAWKLPESSEPGCFLVGGKPSSCQENSMADAWNKNCAILINPQGPFSQCHQVVPPQSSFASCVHGQCGTKGDTTALCRSLQAYASLCAQAGQAPAWRNRTFCPMRCPPGSSYSPCSSPCPDTCSSINNPRDCPKALPCAESCECQKGHILSGTSCVPLGQCGCTDPAGSYHPVGERWYTENTCTRLCTCSVHNNITCFQSTCKPNQICWALDGLLHCRASGVGVCQLPGESHYVSFDGSNHSIPDACTLVLVKVCHPAMALPFFKISAKHEKEEGGTEAFRLHEVYIDIYDAQVTLQKGHRVLINSKQVTLPAISQIPGVSVKSSSIYSIVNIKIGVQVKFDGNHLLEIEIPTTYYGKVCGMCGNFNDEEEDELMMPSDEVANSDSEFVNSWKDKDIDPSCQSLLVDEQQIPAEQQENPSGNCRAADLRRAREKCEAALRAPVWAQCASRIDLTPFLVDCANTLCEFGGLYQALCQALQAFGATCQSQGLKPPLWRNSSFCPLECPAYSSYTNCLPSCSPSCWDLDGRCEGAKVPSACAEGCICQPGYVLSEDKCVPRSQCGCKDAHGGSIPLGKSWVSSGCTEKCVCTGGAIQCGDFRCPSGSHCQLTSDNSNSNCVSDKSEQCSVYGDPRYLTFDGFSYRLQGRMTYVLIKTVDVLPEGVEPLLVEGRNKMDPPRSSIFLQEVITTVYGYKVQLQAGLELVVNNQKMAVPYRPNEHLRVTLWGQRLYLVTDFELVVSFGGRKNAVISLPSMYEGLVSGLCGNYDKNRKNDMMLPSGALTQNLNTFGNSWEVKTEDALLRFPRAIPAEEEGQGAELGLRTGLQVSECSPEQLASNSTQACRVLADPQGPFAACHQTVAPEPFQEHCVLDLCSAQDPREQEELRCQVLSGHGVSSRYHISELYDTLPSILCQPGRPRGLRGPLRGRLRQHPRLCLQWHPEPPLADCGCTSNGIYYQLGSSFLTEDCSQRCTCASSRILLCEPFSCRAGEVCTLGNHTQGCFPESPCLQNPCQNDGQCREQGATFTCECEVGYGGGLCMEPRDAPPPRKPASNLVGVLLGLLVPVVVVLLAVTRECIYRTRRKREKTQEGDRLARLVDTDTVLDCAC

SEQ ID NO: 5297 - protein, 1053 aa, unidentified
MSSEESYRAILRYLTNEREPYAPGTEGNVKRKIRKAAACYVVRGGTLYYQRRQRHRKTFAELEVVLQPERRRDLIEAAHLGPGGTHHTRHQTWHYLSKTYWWRGILKQVKDYIKQCSKCQEKLDRSRPISDVSEMLEELGLDLESGEESNESEDDLSNFTSSPTTASKPAKKKPVSKHELVFVDTKGVVKRSSPKHCQAVLKQLNEQRLSNQFCDVTLLIEGEEYKAHKSVLSANSEYFRDLFIEKGAVSSHEAVVDLSGFCKASFLPLLEFAYTSVLSFDFCSMADVAILARHLFMSEVLEICESVHKLMEEKQLTVYKKGEVQTVASTQDLRVQNGGTAPPVASSEGTTTSLPTELGDCEIVLLVNGELPEAEQNGEVGRQPEPQVSSEAESALSSVGCIADSHPEMESVDLITKNNQTELETSNNRENNTVSNIHPKLSKENVISSSPEDSGMGNDISAEDICAEDIPKHRQKVDQPLKDQENLVASTAKTDFGPDDDTYRSRLRQRSVNEGAYIRLHKGMEKKLQKRKAVPKSAVQQVAQKLVQRGKKMKQPKRDAKENTEEASHKCGECGMVFQRRYALIMHKLKHERARDYKCPLCKKQFQYSASLRAHLIRHTRKDAPSSSSSNSTSNEASGTSSEKGRTKREFICSICGRTLPKLYSLRIHMLKHTGVKPHACQVCGKTFIYKHGLKLHQSLHQSQKQFQCELCVKSFVTKRSLQEHMSIHTGESKYLCSVCGKSFHRGSGLSKHFKKHQPKPEVRGYHCTQCEKSFFEARDLRQHMNKHLGVKPFQCQFCDKCYSWKKDWYSHVKSHSVTEPYRCNICGKEFYEKALFRRHVKKATHGKKGRAKQNLERVCEKCGRKFTQLREYRRHMNNHEGVKPFECLTCGVAWADARSLKRHVRTHTGERPYVCPVCSEAYIDARTLRKHMTKFHRDYVPCKIMLEKDTLQFHNQGTQVAHAVSILTAGMQEQESSGPQELETVVVTGETMEALEAVAATEEYPSVSTLSDQSIMQVVNYVLAQQQGQKLSEVAEAIQTVKVEVAHISGGE

SEQ ID NO: 5298 - protein, 485 aa, unidentified
MYKMNICNKPSNKTAPEKSVWTAPAQPSGPSPELQGQRSRRNGWSWPPHPLQIVAWLLYLFFAVIGFGILVPLLPHHWVPAGYACMGAIFAGHLVVHLTAVSIDPADANVRDKSYAGPLPIFNRSQHAHVIEDLHCNLCNVDVSARSKHCSACNKCVCGFDHHCKWLNNCVGERNYRLFLHSVASALLGVLLLVLVATYVFVEFFVNPMRLRTNRHFEVLKNHTDVWFVFLPAAPVETQAPAILALAALLILLGLLSTALLGHLLCFHIYLMWHKLTTYEYIVQHRPPQEAKGVHRELESCPPKMRPIQEMEFYMRTFRHMRPEPPGQAGPAAVNAKHSRPASPDPTPGRRDCAGPPVQVEWDRKKPLPWRSPLLLLAMWGPQAPPCLCRKRGRGACIKCERLRPRIRRRGLGPPAAAPARRRIPRTPALCTPLALPAPTTRRRQSPWTRFQWRRRAWAAPLWPPRGAGADSPRWRGRRVRPPFS

SEQ ID NO: 5299 - protein, 412 aa, unidentified
MDTRSGSQCSVTPEAILNNEKLVLPPRISRVNGWSLPLHYFQVVTWAVFVGLSSATFGIFIPFLPHAWKYIAYVVTGGIFSFHLVVHLIASCIDPADSNVRLMKNYSQPMPLFDRSKHAHVIQNQFCHLCKVTVNKKTKHCISCNKCVSGFDHHCKWINNCVGSRNYWFFFSTVASATAGMLCLIAILLYVLVQYLVNPGVLRTDPRYEDVKNMNTWLLFLPLFPVQVQTLIVVIIGMLVLLLDFLGLVHLGQLLIFHIYLKAKKMTTFEYLINNRKEESSKHQAVRKDPYVQMDKGVLQQGAGALGSSAQGVKAKSSLLIHKHLCHFCTSVNQDGDSTAREGDEDPCPSALGAKARNSRLICRRLCQFSTRVHPDGGSMAQEADDAPSISTLGLQQETTEPMKTDSAESED

SEQ ID NO: 5300 - protein, 371 aa, unidentified
MDTRSGSQCSVTPEAIRNNEELVLPPRISRVNGWSLPLHYFRVVTWAVFVGLSLATFRIFIPLLPHSWKYIAYVVTGGIFSFHLVVHLIASCIDPADSNVRLMKNYSQPMPLFDRSKHAHVIQNQFCHLCKVTVNKKTKHCISCNKCVSGFDHHCKWINNCVGSRNYWFFFSTVASATAGMLCLIAILLYVLVQYLVNPRVLRTDPRYEDVKNMNTWLLFLPLFPVQVQTLIVVIIRMLVLLLDLLGLVQLGQLLIFHIYLKAKKMTTFEYLINTRKEESSKHQAVRKDPYVQMDKGFLQQGAGALGSSAQGVKAKSSLLIYKCPCHFCTSVNQDGDSKAQEADDAPSTSTLGLQQETTEPMKTDSAESED

SEQ ID NO: 5301 - protein, 267 aa, unidentified
MAPWALLSPGVLVRTGHTVLTWGITLVLFLHDTELRQWEEQGELLLPLTFLLLVLGSLLLYLAVSLMDPGYVNVQPQPQEELKEEQTAMVPPAIPLRRCRYCLVLQPLRARHCRECRRCVRRYDHHCPWMENCVGERNHPLFVVYLALQLVVLLWGLYLAWSGLRFFQPWGQWLRSSGLLFATFLLLSLFSLVASLLLVSHLYLVASNTTTWEFISSHRIAYLRQRPSNPFDRGLTRNLAHFFCGWPSGSWETLWAEEEEEGSSPAV

SEQ ID NO: 5302 - protein, 622 aa, unidentified
MEGPGLGSQCRNHSHGPHPPGFGRYGICAHENKELANAREALPLIEDSSNCDIVKATQYGIFERCKELVEAGYDVRQPDKENVSLLHWAAINNRLDLVKFYISKGAVVDQLGGDLNSTPLHWAIRQGHLPMVILLLQHGADPTLIDGEGFSSIHLAVLFQHMPIIAYLISKGQSVNMTDVNGQTPLMLSAHKVIGPEPTGFLLKFNPSLNVVDKIHQNTPLHWAVAAGNVNAVDKLLEAGSSLDIQNVKGETPLDMALQNKNQLIIHMLKTEAKMRANQKFRLWRWLQKCELFLLLMLSVITMWAIGYILDFNSDSWLLKGCLLVTLFFLTSLFPRFLVGYKNLVYLPTAFLLSSVFWIFMTWFILFFPDLAGAPFYFSFIFSIVAFLYFFYKTWATDPGFTKASEEEKKVNIITLAETGSLDFRTFCTSCLIRKPLRSLHCHVCNCCVARYDQHCLWTGRCIGFGNHHYYIFFLFFLSMVCGWIIYGSFIYLSSHCATTFKEDGLWTYLNQIVACSPWVLYILMLATFHFSWSTFLLLNQLFQIAFLGLTSHERISLQKQSKHMKQTLSLRKTPYNLGFMQNLADFFQCGCFGLVKPCVVDWTSQYTMVFHPAREKVLRSV

SEQ ID NO: 5303 - protein, 488 aa, unidentified
MPPGGGGPMKDCEYSQISTHSSSPMESPHKKKKIAARRKWEVFPGRNKFFCNGRIMMARQTGVFYLTLVLILVTSGLFFAFDCPYLAVKITPAIPAVAGILFFFVMGTLLRTSFSDPGVLPRATPDEAADLERQIDIANGTSSGGYRPPPRTKEVIINGQTVKLKYCFTCKIFRPPRASHCSLCDNCVERFDHHCPWVGNCVGKRNYRFFYMFILSLSFLTVFIFAFVITHVILRSQQTGFLNALKDSPASVLEAVVCFFSVWSIVGLSGFHTYLISSNQTTNEDIKGSWSNKRGKENYNPYSYGNIFTNCCVALCGPISPSLIDRRGYIQPDTPQPAAPSNGITMYGATQSQSDMCDQDQCIQSTKFVLQAAATPLLQSEPSLTSDELHLPGKPGLGTPCASLTLGPPTPPASMPNLAEATLADVMPRKDEHMGHQFLTPDEAPSPPRLLAAGSPLAHSRTMHVLGLASQDSLHEDSVRGLVKLSSV

SEQ ID NO: 5304 - protein, 337 aa, unidentified
MRRGWKMALSGGLRCCRRVLSWVPVLVIVLVVLWSYYAYVFELCLVTVLSPAEKVIYLILYHAIFVFFTWTYWKSIFTLPQQPNQKFHLSYTDKERYENEERPEVQKQMLVDMAKKLPVYTRTGSGAVRFCDRCHLIKPDRCHHCSVCAMCVLKMDHHCPWVNNCIGFSNYKFFLQFLAYSVLYCLYIATTVFSYFIKYWRGELPSVRSKFHVLFLLFVACMFFVSLVILFGYHCWLVSRNKTTLEAFCTPVFTSGPEKNGFNLGFIKNIQQVFGDKKKFWLIPIGSSPGDGHSFPMRSMNESQNPLLANEETWEDNEDDNQDYPEGSSSLAVETET

SEQ ID NO: 5305 - protein, 377 aa, unidentified
MRGQRSLLLGPARLCLRLLLLLGYRRRCPPLLRGLVQRWRYGKVCLRSLLYNSFGGSDTAVDAAFEPVYWLVDNVIRWFGVVFVVLVIVLTGSIVAIAYLCVLPLILRTYSVPRLCWHFFYSHWNLILIVFHYYQAITTPPGYPPQGRNDIATVSICKKCIYPKPARTHHCSICNRCVLKMDHHCPWLNNCVGHYNHRYFFSFCFFMTLGCVYCSYGSWDLFREAYAAIEKMKQLDKNKLQAVANQTYHQTPPPTFSFRERMTHKSLVYLWFLCSSVALALGALTVWHAVLISRGETSIERHINKKERRRLQAKGRVFRNPYNYGCLDNWKVFLGVDTGRHWLTRVLLPSSHLPHGNGMSWEPPPWVTAHSASVMAV

SEQ ID NO: 5306 - protein, 632 aa, unidentified
MQREEGFNTKMADGPDEYDTEAGCVPLLHPEEIKPQSHYNHGYGEPLGRKTHIDDYSTWDIVKATQYGIYERCRELVEAGYDVRQPDKENVTLLHWAAINNRIDLVKYYISKGAIVDQLGGDLNSTPLHWATRQGHLSMVVQLMKYGADPSLIDGEGCSCIHLAAQFGHTSIVAYLIAKGQDVDMMDQNGMTPLMWAAYRTHSVDPTRLLLTFNVSVNLGDKYHKNTALHWAVLAGNTTVISLLLEAGANVDAQNIKGESALDLAKQRKNVWMINHLQEARQAKGYDNPSFLRKLKADKEFRQKVMLGTPFLVIWLVGFIADLNIDSWLIKGLMYGGVWATVQFLSKSFFDHSMHSALPLGIYLATKFWMYVTWFFWFWNDLNFLFIHLPFLANSVALFYNFGKSWKSDPGIIKATEEQKKKTIVELAETGSLDLSIFCSTCLIRKPVRSKHCGVCNRCIAKFDHHCPWVGNCVGAGNHRYFMGYLFFLLFMICWMIYGCISYWGLHCETTYTKDGFWTYITQIATCSPWMFWMFLNSVFHFMWVAVLLMCQMYQISCLGITTNERMNARRYKHFKVTTTSIESPFNHGCVRNIIDFFEFRCCGLFRPVIVDWTRQYTIEYDQISGSGYQLV

SEQ ID NO: 5307 - protein, 388 aa, unidentified
MKDCEYQQISPGAAPLPASPGARRPGPAASPTPGPGPAPPAAPAPPRWSSSGSGSGSGSGSLGRRPRRKWEVFPGRNRFYCGGRLMLAGHGGVFALTLLLILTTTGLFFVFDCPYLARKLTLAIPIIAAILFFFVMSCLLQTSFTDPGILPRATVCEAAALEKQIDNTGSSTYRPPPRTREVLINGQMVKLKYCFTCKMFRPPRTSHCSVCDNCVERFDHHCPWVGNCVGRRNYRFFYAFILSLSFLTAFIFACVVTHLTLRAQGSNFLSTLKETPASVLELVICFFSIWSILGLSGFHTYLVASNLTTNEDIKGSWSSKRGGEASVNPYSHKSIITNCCAVLCGPLPPSLIDRRGFVQSDTVLPSPIRSDEPACRAKPDASMVGGHP

SEQ ID NO: 5308 - protein, 309 aa, unidentified
MTLLTDATPLVKEPHPLPLVPRPWFLPSLFAAFNVVLLVFFSGLFFAFPCRWLAQNGEWAFPVITGSLFVLTFFSLVSLNFSDPGILHQGSAEQGPLTVHVVWVNHGAFRLQWCPKCCFHRPPRTYHCPWCNICVEDFDHHCKWVNNCIGHRNFRFFMLLVLSLCLYSGAMLVTCLIFLVRTTHLPFSTDKAIAIVVAVSAAGLLVPLSLLLLIQALSVSSADRTYKGKCRHLQGYNPFDQGCASNWYLTICAPLGPKYMAEAVQLQRVVGPDWTSMPNLHPPMSPSALNPPAPTSGSLQSREGTPGAW

SEQ ID NO: 5309 - protein, 367 aa, unidentified
MAPSGPGSSARRRCRRVLYWIPVVFITLLLGWSYYAYAIQLCIVSMENTGEQVVCLMAYHLLFAMFVWSYWKTIFTLPMNPSKEFHLSYAEKDLLEREPRGEAHQEVLRRAAKDLPIYTRTMSGAIRYCDRCQLIKPDRCHHCSVCDKCILKMDHHCPWVNNCVGFSNYKFFLLFLAYSLLYCLFIAATDLQYFIKFWTNGLPDTQAKFHIMFLFFAAAMFSVSLSSLFGYHCWLVSKNKSTLEAFRSPVFRHGTDKNGFSLGFSKNMRQVFGDEKKYWLLPIFSSLGDGCSFPTCLVNQDPEQASTPAGLNSTAKNLENHQFPAKPLRESQSHLLTDSQSWTESSINPGKCKAGMSNPALTMENET

SEQ ID NO: 5310 - protein, 365 aa, unidentified
MAPWTLWRCCQRVVGWVPVLFITFVVVWSYYAYVVELCVFTIFGNEENGKTVVYLVAFHLFFVMFVWSYWMTIFTSPASPSKEFYLSNSEKERYEKEFSQERQQEILRRAARALPIYTTSASKTIRYCEKCQLIKPDRAHHCSACDSCILKMDHHCPWVNNCVGFSNYKFFLLFLLYSLLYCLFVAATVLEYFIKFWTNELTDTRAKFHVLFLFFVSAMFFISVLSLFSYHCWLVGKNRTTIESFRAPTFSYGPDGNGFSLGCSKNWRQVFGDEKKYWLLPIFSSLGDGCSFPTRLVGMDPEQASVTNQNEYARSSGSNQPFPIKPLSESKNRLLDSESQWLENGAEEGIVKSGTNNHVTVAIEN

SEQ ID NO: 5311 - protein, 265 aa, unidentified
MGLRIHFVVDPHGWCCMGLIVFVWLYNIVLIPKIVLFPHYEEGHIPGILIIIFYGISIFCLVALVRASITDPGRLPENPKIPHGEREFWELCNKCNLMRPKRSHHCSRCGHCVRRMDHHCPWINNCVGEDNHWLFLQLCFYTELLTCYALMFSFCHYYYFLPLKKRNLDLFVFRHELAIMRLAAFMGITMLVGITGLFYTQLIGIITDTTSIEKMSNCCEDISRPRKPWQQTFSEVFGTRWKILWFIPFRQRQPLRVPYHFANHV

SEQ ID NO: 5312 - protein, 263 aa, unidentified
MLALRLLNVVAPAYFLCISLVTFVLQLFLFLPSMREDPAAARLFSPALLHGALFLFLSANALGNYVLVIQNSPDDLGACQGASARKTPCPSPSTHFCRVCARVTLRHDHHCFFTGNCIGSRNMRNFVLFCLYTSLACLYSMVAGVAYISAVLSISFAHPLAFLTLLPTSISQFFSGAVLGSEMFVILMLYLWFAIGLACAGFCCHQLLLILRGQTRHQVRKGVAVRARPWRKNLQEVFGKRWLLGLLVPMFNVGSESSKQQDK

SEQ ID NO: 5313 - protein, 409 aa, unidentified
MTQKGSMKPVKKKKTEEPELEPLCCCEYIDRNGEKNHVATCLCDCQDLDEGCDRWITCKSLQPETCERIMDTISDRLRIPWLRGAKKVNISIIPPLVLLPVFLHVASWHFLLGVVVLTSLPVLALWYYYLTHRRKEQTLFFLSLGLFSLGYMYYVFLQEVVPKGRVGPVQLAVLTCGLFLILLALHRAKKNPGYLSNPASGDRSLSSSQLECLSRKGQEKTKGFPGADMSGSLNNRTTKDDPKGSSKMPAGSPTKAKEDWCAKCQLVRPARAWHCRICGICVRRMDHHCVWINSCVGESNHQAFILALLIFLLTSVYGITLTLDTICRDRSVFTALFYCPGVYANYSSALSFTCVWYSVIITAGMAYIFLIQLINISYNVTEREVQQALRQKTGRRLLCGLIVDTGLLG

SEQ ID NO: 5314 - protein, 284 aa, unidentified
MGQPWAAGSTDGAPAQLPLVLTALWAAAVGLELAYVLVLGPGPPPLGPLARALQLALAAFQLLNLLGNVGLFLRSDPSIRGVMLAGRGLGQGWAYCYQCQSQVPPRSGHCSACRVCILRRDHHCRLLGRCVGFGNYRPFLCLLLHAAGVLLHVSVLLGPALSALLRAHTPLHMAALLLLPWLMLLTGRVSLAQFALAFVTDTCVAGALLCGAGLLFHGMLLLRGQTTWEWARGQHSYDLGPCHNLQAALGPRWALVWLWPFLASPLPGDGITFQTTADVGHTAS

SEQ ID NO: 5315 - protein, 299 aa, unidentified
MMLIPTHHFRNIERKPEYLQPEKCVPPPYPGPVGTMWFIRDGCGIACAIVTWFLVLYAEFVVLFVMLIPSRDYVYSIINGIVFNLLAFLALASHCRAMLTDPGAVPKGNATKEFIESLQLKPGQVVYKCPKCCSIKPDRAHHCSVCKRCIRKMDHHCPWVNNCVGENNQKYFVLFTMYIALISLHALIMVGFHFLHCFEEDWTKCSSFSPPTTVILLILLCFEGLLFLIFTSVMFGTQVHSICTDETGIEQLKKEERRWAKKTKWMNMKAVFGHPFSLGWASPFATPDQGKADPYQYVV

SEQ ID NO: 5316 - protein, 344 aa, unidentified
MDFLVLFLFYLASVLMGLVLICVCSKTHSLKGLARGGAQIFSCIIPECLQRAVHGLLHYLFHTRNHTFIVLHLVLQGMVYTEYTWEVFGYCQELELSLHYLLLPYLLLGVNLFFFTLTCGTNPGIITKANELLFLHVYEFDEVMFPKNVRCSTCDLRKPARSKHCSVCNWCVHRFDHHCVWVNNCIGAWNIRYFLIYVLTLTASAATVAIVSTTFLVHLVVMSDLYQETYIDDLGHLHVMDTVFLIQYLFLTFPRIVFMLGFVVVLSFLLGGYLLFVLYLAATNQTTNEWYRGDWAWCQRCPLVAWPPSAEPQVHRNIHSHGLRSNLQEIFLPAFPCHERKKQE

SEQ ID NO: 5317 - protein, 715 aa, unidentified
MPAESGKRFKPSKYVPVSAAAIFLVGATTLFFAFTCPGLSLYVSPAVPIYNAIMFLFVLANFSMATFMDPGIFPRAEEDEDKEDDFRAPLYKTVEIKGIQVRMKWCATCRFYRPPRCSHCSVCDNCVEEFDHHCPWVNNCIGRRNYRYFFLFLLSLTAHIMGVFGFGLLYVLYHIEELSGVRTAVTMAVMCVAGLFFIPVAGLTGFHVVLVARGRTTNEQVTGKFRGGVNPFTNGCCNNVSRVLCSSPAPRYLGRPKKEKTIVIRPPFLRPEVSDGQITVKIMDNGIQGELRRTKSKGSLEITESQSADAEPPPPPKPDLSRYTGLRTHLGLATNEDSSLLAKDSPPTPTMYKYRPGYSSSSTSAAMPHSSSAKLSRGDSLKEPTSIAESSRHPSYRSEPSLEPESFRSPTFGKSFHFDPLSSGSRSSSLKSAQGTGFELGQLQSIRSEGTTSTSYKSLANQTRNGSLSYDSLLTPSDSPDFESVQAGPEPDPPLGYTSPFLSARLAQQREAERHPRLVPTGPTHREPSPVRYDNLSRHIVASLQEREKLLRQSPPLPGREEEPGLGDSGIQSTPGSGHAPRTSSSSDDSKRSPLGKTPLGRPAVPRFGKPDGLRGRGVGSPEPGPTAPYLGRSMSYSSQKAQPGVSETEEVALQPLLTPKDEVQLKTTYSKSNGQPKSLGSASPGPGQPPLSSPTRGGVKKVSGVGGTTYEISV

SEQ ID NO: 5318 - protein, 413 aa, unidentified
MGTFCSVIKFENLQELKRLCHWGPIIALGVIAICSTMAMIDSVLWYWPLHTTGGSVNFIMLINWTVMILYNYFNAMFVGPGFVPLGWKPEISQDTMYLQYCKVCQAYKAPRSHHCRKCNRCVMKMDHHCPWINNCCGYQNHASFTLFLLLAPLGCIHAAFIFVMTMYTQLYHRLSFGWNTVKIDMSAARRDPLPIVPFGLAAFATTLFALGLALGTTIAVGMLFFIQMKIILRNKTSIESWIEEKAKDRIQYYQLDEVFVFPYDMGSRWRNFKQVFTWSGVPEGDGLEWPVREGCHQYSLTIEQLKQKADKRVRSVRYKVIEDYSGACCPLNKGIKTFFTSPCTEEPRIQLQKGEFILATRGLRYWLYGDKILDDSFIEGVSRIRGWFPRKCVEKCPCDAETDQAPEGEKKNR

SEQ ID NO: 5319 - protein, 308 aa, unidentified
MQPSGHRLRDVEHHPLLAENDNYDSSSSSSSEADVADRVWFIRDGCGMICAVMTWLLVAYADFVVTFVMLLPSKDFWYSVVNGVIFNCLAVLALSSHLRTMLTDPGAVPKGNATKEYMESLQLKPGEVIYKCPKCCCIKPERAHHCSICKRCIRKMDHHCPWVNNCVGEKNQRFFVLFTMYIALSSVHALILCGFQFISCVRGQWTECSDFSPPITVILLIFLCLEGLLFFTFTAVMFGTQIHSICNDETEIERLKSEKPTWERRLRWEGMKSVFGGPPSLLWMNPFVGFRFRRLPTRPRKGGPEFSV

SEQ ID NO: 5320 - protein, 765 aa, unidentified
MPRSPGTRLKPAKYIPVATAAALLVGSSTLFFVFTCPWLTRAVSPAVPVYNGIIFLFVLANFSMATFMDPGVFPRADEDEDKEDDFRAPLYKNVDVRGIQVRMKWCATCHFYRPPRCSHCSVCDNCVEDFDHHCPWVNNCIGRRNYRYFFLFLLSLSAHMVGVVAFGLVYVLNHAEGLGAAHTTITMAVMCVAGLFFIPVIGLTGFHVVLVTRGRTTNEQVTGKFRGGVNPFTRGCCGNVEHVLCSPLAPRYVVEPPRLPLAVSLKPPFLRPELLDRAAPLKVKLSDNGLKAGLGRSKSKGSLDRLDEKPLDLGPPLPPKIEAGTFSSDLQTPRPGSAESALSVQRTSPPTPAMYKFRPAFPTGPKVPFCGPGEQVPGPDSLTLGDDSIRSLDFVSEPSLDLPDYGPGGLHAAYPPSPPLSASDAFSGALRSLSLKASSRRGGDHVALQPLRSEGGPPTPHRSIFAPHALPNRNGSLSYDSLLNPGSPGGHACPAHPAVGVAGYHSPYLHPGATGDPPRPLPRSFSPVLGPRPREPSPVRYDNLSRTIMASIQERKDREERERLLRSQADSLFGDSGVYDAPSSYSLQQASVLSEGPRGPALRYGSRDDLVAGPGFGGARNPALQTSLSSLSSSVSRAPRTSSSSLQADQASSNAPGPRPSSGSHRSPARQGLPSPPGTPHSPSYAGPKAVAFIHTDLPEPPPSLTVQRDHPQLKTPPSKLNGQSPGLARLGPATGPPGPSASPTRHTLVKKVSGVGGTTYEISV

SEQ ID NO: 5321 - protein, 364 aa, unidentified
MSVMVVRKKVTRKWEKLPGRNTFCCDGRVMMARQKGIFYLTLFLILGTCTLFFAFECRYLAVQLSPAIPVFAAMLFLFSMATLLRTSFSDPGVIPRALPDEAAFIEMEIEATNGAVPQGQRPPPRIKNFQINNQIVKLKYCYTCKIFRPPRASHCSICDNCVERFDHHCPWVGNCVGKRNYRYFYLFILSLSLLTIYVFAFNIVYVALKSLKIGFLETLKETPGTVLEVLICFFTLWSVVGLTGFHTFLVALNQTTNEDIKGSWTGKNRVQNPYSHGNIVKNCCEVLCGPLPPSVLDRRGILPLEESGSRPPSTQETSSSLLPQSPAPTEHLNSNEMPEDSSTPEEMPPPEPPEPPQEAAEAEK

SEQ ID NO: 5322 - protein, 310 aa, unidentified
MGLCKCPKRKVTNLFCFEHRVNVCEHCLVANHAKCIVQSYLQWLQDSDYNPNCRLCNIPLASRETTRLVCYDLFHWACLNERAAQLPRNTAPAGYQCPSCNGPIFPPTNLAGPVASALREKLATVNWARAGLGLPLIDEVVSPEPEPLNTSDFSDWSSFNASSTPGPEEVDSASAAPAFYSQAPRPPASPGRPEQHTVIHMGNPEPLTHAPRKVYDTRDDDRTPGLHGDCDDDKYRRRPALGWLARLLRSRAGSRKRPLTLLQRAGLLLLLGLLGFLALLALMSRLGRAAADSDPNLDPLMNPHIRVGPS

SEQ ID NO: 5323 - protein, 411 aa, unidentified
MQTSEREGSGPELSPSVMPEAPLESPPFPTKSPAFDLFNLVLSYKRLEIYLEPLKDAGDGVRYLLRWQMPLCSLLTCLGLNVLFLTLNEGAWYSVGALMISVPALLGYLQEVCRARLPDSELMRRKYHSVRQEDLQRGRLSRPEAVAEVKSFLIQLEAFLSRLCCTCEAAYRVLHWENPVVSSQFYGALLGTVCMLYLLPLCWVLTLLNSTLFLGNVEFFRVVSEYRASLQQRMNPKQEEHAFESPPPPDVGGKDGLMDSTPALTPTEDLTPGSVEEAEEAEPDEEFKDAIEETHLVVLEDDEGAPCPAEDELALQDNGFLSKNEVLRSKVSRLTERLRKRYPTNNFGNCTGCSATFSVLKKRRSCSNCGNSFCSRCCSFKVPKSSMGATAPEAQRETVFVCASCNQTLSK

SEQ ID NO: 5324 - protein, 475 aa, unidentified
MGMWASLDALWEMPAEKRIFGAVLLFSWTVYLWETFLAQRQRRIYKTTTHVPPELGQIMDSETFEKSRLYQLDKSTFSFWSGLYSETEGTLILLFGGIPYLWRLSGRFCGYAGFGPEYEITQSLVFLLLATLFSALTGLPWSLYNTFVIEEKHGFNQQTLGFFMKDAIKKFVVTQCILLPVSSLLLYIIKIGGDYFFIYAWLFTLVVSLVLVTIYADYIAPLFDKFTPLPEGKLKEEIEVMAKSIDFPLTKVYVVEGSKRSSHSNAYFYGFFKNKRIVLFDTLLEEYSVLNKDIQEDSGMEPRNEEEGNSEEIKAKVKNKKQGCKNEEVLAVLGHELGHWKLGHTVKNIIISQMNSFLCFFLFAVLIGRKELFAAFGFYDSQPTLIGLLIIFQFIFSPYNEVLSFCLTVLSRRFEFQADAFAKKLGKAKDLYSALIKLNKDNLGFPVSDWLFSMWHYSHPPLLERLQALKTMKQH

SEQ ID NO: 5325 - protein, 669 aa, unidentified
MEKCSVGGLELTEQTPALLGNMAMATSLMDIGDSFGHPACPLVSRSRNSPVEDDDDDDDVVFIESIQPPSISAPAIADQRNFIFASSKNEKPQGNYSVIPPSSRDLASQKGNISETIVIDDEEDIETNGGAEKKSSCFIEWGLPGTKNKTNDLDFSTSSLSRSKTKTGVRPFNPGRMNVAGDLFQNGEFATHHSPDSWISQSASFPSNQKQPGVDSLSPVALLRKQNFQPTAQQQLTKPAKITCANCKKPLQKGQTAYQRKGSAHLFCSTTCLSSFSHKRTQNTRSIICKKDASTKKANVILPVESSKSFQEFYSTSCLSPCENNWNLKKGVFNKSRCTICSKLAEIRHEVSVNNVTHKLCSNHCFNKYRLANGLIMNCCEHCGEYMPSKSTGNNILVIGGQQKRFCCQSCINEYKQMMETKSKKLTASENRKRNAFREENEKQLYGSSNTLLKKIEGIPEKKEKTSQLQLSVECGTDTLLIQENVNLPPSSTSTIADTFQEQLEEKNFEDSIVPVVLSADPGTWPRILNIKQRDTLVENVPPQVRNFNFPKDNTGRKFSETYYTRILPNGEKTTRSWLLYSTSKDSVFCLYCKLFGEGKNQLKNENGCKDWQHLSHILSKHEESEMHVNNSVKYSKLKSDLKKNKAIDAAEHRLYENEKNDGVLLLYT

SEQ ID NO: 5326 - protein, 1325 aa, unidentified
MKEPLDGECGKAVVPQQELLDKIKEEPDNAQEYGCVQQPKTQESKLKIGGVSSVNERPIAQQLNPGFQLSFASSGPSVLLPSVPAVAIKVFCSGCKKMLYKGQTAYHKTGSTQLFCSTRCITRHSSPACLPPPPKKTCTNCSKDILNPKDVITTRFENSYPSKDFCSQSCLSSYELKKKPVVTIYTKSISTKCSMCQKNADTRFEVKYQNVVHGLCSDACFSKFHSTNNLTMNCCENCGSYCYSSSGPCQSQKVFSSTSVTAYKQNSAQIPPYALGKSLRPSAEMIETTNDSGKTELFCSINCLSAYRVKTVTSSGVQVSCHSCKTSAIPQYHLAMSNGTIYSFCSSSCVVAFQNVFSKPKGTNSSAVPLSQGQVVVSPPSSRSAVSIGGGNTSAVSPSSIRGSAAASLQPLAEQSQQVALTHTVVKLKCQHCNHLFATKPELLFYKGKMFLFCGKNCSDEYKKKNKVVAMCDYCKLQKIIKETVRFSGVDKPFCSEVCKFLSARDFGERWGNYCKMCSYCSQTSPNLVENRLEGKLEEFCCEDCMSKFTVLFYQMAKCDGCKRQGKLSESIKWRGNIKHFCNLFCVLEFCHQQIMNDCLPQNKVNISKAKTAVTELPSARTDTTPVITSVMSLAKIPATLSTGNTNSVLKGAVTKEAAKIIQDESTQEDAMKFPSSQSSQPSRLLKNKGISCKPVTQTKATSCKPHTQHKECQTDLPMPNEKNDAELDSPPSKKKRLGFFQTYDTEYLKVGFIICPGSKESSPRPQCVICGEILSSENMKPANLSHHLKTKHSELENKPVDFFEQKSLEMECQNSSLKKCLLVEKSLVKASYLIAFQTAASKKPFSIAEELIKPYLVEMCSEVLGSSAGDKMKTIPLSNVTIQHRIDELSADIEDQLIQKVRESKWFALQIDESSEISNITLLLCYIRFIDYDCRDVKEELLFCIEMPTQITGFEIFELINKYIDSKSLNWKHCVGLCTDGAASMTGRYSGLKAKIQEVAMNTAAFTHCFIHRERLVAEKLSPCLHKILLQSAQILSFIKSNALNSRMLTILCEEMGSEHVSLPLHAEVRWISRGRMLKRLFELRHEIEIFLSQKHSDLAKYFHDEEWVGKLAYLSDIFSLINELNLSLQGTLTTFFNLCNKIDVFKRKLKMWLKRTQENDYDMFPSFSEFSNSSGLNMTDITRIIFEHLEGLSQVFSDCFPPEQDLRSGNLWIIHPFMNHQNNNLTDFEEEKLTELSSDLGLQALFKSVSVTQFWINAKTSYPELHERAMKFLLPFSTVYLCDAAFSALTESKQKNLLGSGPALRLAVTSLIPRIEKLVKEKE

SEQ ID NO: 5327 - protein, 602 aa, unidentified
MARLTKRRQADTKAIQHLWAAIEIIRNQKQIANIDRITKYMSRVHGMHPKETTRQLSLAVKDGLIVETLTVGCKGSKAGIEQEGYWLPGDEIDWETENHDWYCFECHLPGEVLICDLCFRVYHSKCLSDEFRLRDSSSPWQCPVCRSIKKKNTNKQEMGTYLRFIVSRMKERAIDLNKKGKDNKHPMYRRLVHSAVDVPTIQEKVNEGKYRSYEEFKADAQLLLHNTVIFYGADSEQADIARMLYKDTCHELDELQLCKNCFYLSNARPDNWFCYPCIPNHELVWAKMKGFGFWPAKVMQKEDNQVDVRFFGHHHQRAWIPSENIQDITVNIHRLHVKRSMGWKKACDELELHQRFLREGRFWKSKNEDRGEEEAESSISSTSNEQLKVTQEPRAKKGRRNQSVEPKKEEPEPETEAVSSSQEIPTMPQPIEKVSVSTQTKKLSASSPRMLHRSTQTTNDGVCQSMCHDKYTKIFNDFKDRMKSDHKRETERVVREALEKLRSEMEEEKRQAVNKAVANMQGEMDRKCKQVKEKCKEEFVEEIKKLATQHKQLISQTKKKQWCYNCEEEAMYHCCWNTSYCSIKCQQEHWHAEHKRTCRRKR

SEQ ID NO: 5328 - protein, 665 aa, unidentified
MESVTFEDVAVEFIQEWALLDSARRSLCKYRMLDQCRTLASRGTPPCKPSCVSQLGQRAEPKATERGILRATGVAWESQLKPEELPSMQDLLEEASSRDMQMGPGLFLRMQLVPSIEERETPLTREDRPALQEPPWSLGCTGLKAAMQIQRVVIPVPTLGHRNPWVARDSAVPARDPAWLQEDKVEEEAMAPGLPTACSQEPVTFADVAVVFTPEEWVFLDSTQRSLYRDVMLENYRNLASVADQLCKPNALSYLEERGEQWTTDRGVLSDTCAEPQCQPQEAIPSQDTFTEILSIDVKGEQPQPGEKLYKYNELEKPFNSIEPLFQYQRIHAGEASCECQEIRNSFFQSAHLIVPEKIRSGDKSYACNKCEKSFRYSSDLIRHEKTHTAEKCFDCQECGQAFKYSSNLRRHMRTHTGEKPFECSQCGKTFTRNFNLILHQRNHTGEKPYECKDCGKAFNQPSSLRSHVRTHTGEKPFECSQCGKAFREHSSLKTHLRTHTREKPYECNQCGKPFRTSTHLNVHKRIHTGEKLYECATCGQVLSRLSTLKSHMRTHTGEKPYVCQECGRAFSEPSSLRKHARTHSGKKPYACQECGRAFGQSSHLIVHVRTHSAGRPYQCNQCEKAFRHSSSLTVHKRTHVGRETIRNGSLPLSMSHPYCGPLAN

SEQ ID NO: 5329 - protein, 252 aa, unidentified
MQLPPALCARLAAGPGAAEPLPVERDPAAGAAPFRFVARPVRFPREHQFFEDGDVQRHLYLQDVIMQVADVPEKPRVPAFACQVAGCCQVFDALDDYEHHYHTLHGNVCSFCKRAFPSGHLLDAHILEWHDSLFQILSERQDMYQCLVEGCTEKFKTSRDRKDHMVRMHLYPADFRFDKPKKSRSPASAEAPGDSGERSEGEAMEICSEPVAASPAPAGERRIYRHRIPSTICFGQGAARGFKSNKKKTKQC

SEQ ID NO: 5330 - protein, 421 aa, unidentified
MAGEAEAQLDPSLQGLVMFEDVTVYFSREEWGLLNVTQKGLYRDVMLENFALVSSLGLAPSRSPVFTQLEDDEQSWVPSWVDVTPVSRAEARRGFGLDGLCRVEDERAHPEHLKSYRVIQHQDTHSEGKPRRHTEHGAAFPPGSSCGQQQEVHVAEKLFKCSDCGKVFLKAFALLDHLITHSEERPFRCPTGRSAFKKSAHINPRKIHTGETAHVCNECGKAFSYPSKLRKHQKVHTGIKPFKCSDCGKTFNRKDALVLHQRIHTGERPYECSKCGKTFSVLSTLIRHRKVHIGERPYECTECGKFFKYNNSFILHQRVHTGERPFECKQCGKGYVTRSGLYQHWKVHTGERPYECSLCGKTFTTRSYRNRHQQFHTEERSYECTECGKAFKHSSTLLQHKKVHTPERRQEDRAHGKVVSC

SEQ ID NO: 5331 - protein, 651 aa, unidentified
MLREEATKKSKEKEPGMALPQGRLTFRDVAIEFSLEEWKCLNPAQRALYRAVMLENYRNLEFVDSSLKSMMEFSSTRHSITGEVIHTGTLQRHKSHHIGDFCFPEMKKDIHHFEFQWQEVERNGHEAPMTKIKKLTGSTDRSDHRHAGNKPIKDQLGLSFHSHLPELHMFQTKGKISNQLDKSIGASSASESQRISCRLKTHISNKYGKNFLHSSFTQIQEICMREKPCQSNECGKAFNYSSLLRRHHITHSREREYKCDVCGKIFNQKQYIVYHHRCHTGEKTYKCNECGKTFTQMSSLVCHRRLHTGEKPYKCNECGKTFSEKSSLRCHRRLHTGEKPYKCNECGKTFGRNSALVIHKAIHTGEKPYKCNECGKTFSQKSSLQCHHILHTGEKPYKCEECDNVYIRRSHLERHRKIHTGEGSYKCKVCDKVFRSDSYLAEHQRVHTGEKPYKCNKCGRSFSRKSSLQYHHTLHTGEKPYTCNECGKVFSRRENLARHHRLHAGEKPYKCEECDKVFSRRSHLERHRRIHTGEKPYKCKVCDKAFRSDSCLANHTRVHTGEKPYKCNKCAKVFNQKGILAQHQRVHTGEKPYKCNECGKVFNQKASLAKHQRVHTAEKPYKCNECGKAFTGQSTLIHHQAIHGCRETLQM

SEQ ID NO: 5332 - protein, 936 aa, unidentified
MRPRSGGRPGATGRRRRRLRRRPRGLRCSRLPPPPPLPLLLGLLLAAAGPGAARAKETAFVEVVLFESSPSGDYTTYTTGLTGRFSRAGATLSAEGEIVQMHPLGLCNNNDEEDLYEYGWVGVVKLEQPELDPKPCLTVLGKAKRAVQRGATAVIFDVSENPEAIDQLNQGSEDPLKRPVVYVKGADAIKLMNIVNKQKVARARIQHRPPRQPTEYFDMGIFLAFFVVVSLVCLILLVKIKLKQRRSQNSMNRLAVQALEKMETRKFNSKSKGRREGSCGALDTLSSSSTSDCAICLEKYIDGEELRVIPCTHRFHRKCVDPWLLQHHTCPHCRHNIIEQKGNPSAVCVETSNLSRGRQQRVTLPVHYPGRVHRTNAIPAYPTRTSMDSHGNPVTLLTMDRHGEQSLYSPQTPAYIRSYPPLHLDHSLAAHRCGLEHRAYSPAHPFRRPKLSGRSFSKAACFSQYETMYQHYYFQGLSYPEQEGQSPPSLAPRGPARAFPPSGSGSLLFPTVVHVAPPSHLESGSTSSFSCYHGHRSVCSGYLADCPGSDSSSSSSSGQCHCSSSDSVVDCTEVSNQGVYGSCSTFRSSLSSDYDPFIYRSRSPCRASEAGGSGSSGRGPALCFEGSPPPEELPAVHSHGAGRGEPWPGPASPSGDQVSTCSLEMNYSSNSSLEHRGPNSSTSEVGLEASPGAAPDLRRTWKGGHELPSCACCCEPQPSPAGPSAGAAGSSTLFLGPHLYEGSGPAGGEPQSGSSQGLYGLHPDHLPRTDGVKYEGLPCCFYEEKQVARGGGGGSGCYTEDYSVSVQYTLTEEPPPGCYPGARDLSQRIPIIPEDVDCDLGLPSDCQGTHSLGSWGGTRGPDTPRPHRGLGATREEERALCCQARALLRPGCPPEEAGAVRANFPSALQDTQESSTTATEAAGPRSHSADSSSPGA

SEQ ID NO: 5333 - protein, 429 aa, unidentified
MPLCRPEHLMPRASRVPVAASLPLSHAVIPTQLPSRPGHRPPGRPRRCPKASCLPPPVGPSSTQTAKRVTMGWPRPGRALVAVKALLVLSLLQVPAQAVVRAVLEDNSSSVDFADLPALFGVPLAPEGIRGYLMEVKPANACHPIEAPRLGNRSLGAIVLIRRYDCTFDLKVLNAQRAGFEAAIVHNVHSDDLVSMTHVYEDLRGQIAIPSVFVSEAASQDLRVILGCNKSAHALLLPDDPPCHDLGCHPVLTVSWVLGCTLALVVSAFFVLNHLWLWAQACCSHRRPVKTSTCQKAQVRTFTWHNDLCAICLDEYEEGDQLKILPCSHTYHCKCIDPWFSQAPRRSCPVCKQSVAATEDSFDSTTYSFRDEDPSLPGHRPPIWAIQVQLRSRRLELLGRASPHCHCSTTSLEAEYTTVSSAPPEAPGQ

SEQ ID NO: 5334 - protein, 638 aa, unidentified
MAGGSATTWGYPVALLLLVATLGLGRWLQPDPGLPGLRHSYDCGIKGMQLLVFPRPGQTLRFKVVDEFGNRFDVNNCSICYHWVTSRPQEPAVFSADYRGCHVLEKDGRFHLRVFMEAVLPNGRVDVAQDATLICPKPDPSRTLDSQLAPPAMFSVSTPQTLSFLPTSGHTSQGSGHAFPSPLDPGHSSVHPTPALPSPGPGPTLATLAQPHWGTLEHWDVNKRDYIGTHLSQEQCQVASGHLPCIVRRTSKEACQQAGCCYDNTREVPCYYGNTATVQCFRDGYFVLVVSQEMALTHRITLANIHLAYAPTSCSPTQHTEAFVVFYFPLTHCGTTMQVAGDQLIYENWLVSGIHIQKGPQGSITRDSTFQLHVRCVFNASDFLPIQASIFPPPSPAPMTQPGPLRLELRIAKDETFSSYYGEDDYPIVRLLREPVHVEVRLLQRTDPNLVLLLHQCWGAPSANPFQQPQWPILSDGCPFKGDSYRTQMVALDGATPFQSHYQRFTVATFALLDSGSQRALRGLVYLFCSTSACHTSGLETCSTACSTGTTRQRRSSGHRNDTARPQDIVSSPGPVGFEDSYGQEPTLGPTDSNGNSSLRPLLWAVLLLPAVALVLGFGVFVGLSQTWAQKLWESNRQ

SEQ ID NO: 5335 - protein, 745 aa, unidentified
MACRQRGGSWSPSGWFNAGWSTYRSISLFFALVTSGNSIDVSQLVNPAFPGTVTCDEREITVEFPSSPGTKKWHASVVDPLGLDMPNCTYILDPEKLTLRATYDNCTRRVHGGHQMTIRVMNNSAALRHGAVMYQFFCPAMQVEETQGLSASTICQKDFMSFSLPRVFSGLADDSKGTKVQMGWSIEVGDGARAKTLTLPEAMKEGFSLLIDNHRMTFHVPFNATGVTHYVQGNSHLYMVSLKLTFISPGQKVIFSSQAICAPDPVTCNATHMTLTIPEFPGKLKSVSFENQNIDVSQLHDNGIDLEATNGMKLHFSKTLLKTKLSEKCLLHQFYLASLKLTFLLRPETVSMVIYPECLCESPVSIVTGELCTQDGFMDVEVYSYQTQPALDLGTLRVGNSSCQPVFEAQSQGLVRFHIPLNGCGTRYKFEDDKVVYENEIHALWTDFPPSKISRDSEFRMTVKCSYSRNDMLLNINVESLTPPVASVKLGPFTLILQSYPDNSYQQPYGENEYPLVRFLRQPIYMEVRVLNRDDPNIKLVLDDCWATSTMDPDSFPQWNVVVDGCAYDLDNYQTTFHPVGSSVTHPDHYQRFDMKAFAFVSEAHVLSSLVYFHCSALICNRLSPDSPLCSVTCPVSSRHRRATGATEAEKMTVSLPGPILLLSDDSSFRGVGSSDLKASGSSGEKSRSETGEEVGSRGAMDTKGHKTAGDVGSKAVAAVAAFAGVVATLGFIYYLYEKRTVSNH

SEQ ID NO: 5336 - protein, 424 aa, unidentified
MELSYRLFICLLLWGSTELCYPQPLWLLQGGASHPETSVQPVLVECQEATLMVMVSKDLFGTGKLIRAADLTLGPEACEPLVSMDTEDVVRFEVGLHECGNSMQVTDDALVYSTFLLHDPRPVGNLSIVRTNRAEIPIECRYPRQGNVSSQAILPTWLPFRTTVFSEEKLTFSLRLMEENWNAEKRSPTFHLGDAAHLQAEIHTGSHVPLRLFVDHCVATPTPDQNASPYHTIVDFHGCLVDGLTDASSAFKVPRPGPDTLQFTVDVFHFANDSRNMIYITCHLKVTLAEQDPDELNKACSFSKPSNSWFPVEGSADICQCCNKGDCGTPSHSRRQPHVMSQWSRSASRNRRHVTEEADVTVGPLIFLDRRGDHEVEQWALPSDTSVVLLGVGLAVVVSLTLTAVILVLTRRCRTASHPVSASE

SEQ ID NO: 5337 - protein, 540 aa, unidentified
MWLLRCVLLCVSLSLAVSGQHKPEAPDYSSVLHCGPWSFQFAVNLNQEATSPPVLIAWDNQGLLHELQNDSDCGTWIRKGPGSSVVLEATYSSCYVTEWDSHYIMPVGVEGAGAAEHKVVTERKLLKCPMDLLARDAPDTDWCDSIPARDRLPCAPSPISRGDCEGLGCCYSSEEVNSCYYGNTVTLHCTREGHFSIAVSRNVTSPPLLLDSVRLALRNDSACNPVMATQAFVLFQFPFTSCGTTRQITGDRAVYENELVATRDVKNGSRGSVTRDSIFRLHVSCSYSVSSNSLPINVQVFTLPPPFPETQPGPLTLELQIAKDKNYGSYYGVGDYPVVKLLRDPIYVEVSILHRTDPYLGLLLQQCWATPSTDPLSQPQWPILVKGCPYIGDNYQTQLIPVQKALDLPFPSHHQRFSIFTFSFVNPTVEKQALRGPVHLHCSVSVCQPAETPSCVVTCPDLSRRRNFDNSSQNTTASVSSKGPMILLQATKDPPEKLRVPVDSKVLWVAGLSGTLILGALLVSYLAVKKQKSCPDQMCQ

SEQ ID NO: 5338 - protein, 415 aa, unidentified
MEQIWLLLLLTIRVLPGSAQFNGYNCDANLHSRFPAERDISVYCGVQAITMKINFCTVLFSGYSETDLALNGRHGDSHCRGFINNNTFPAVVIFIINLSTLEGCGNNLVVSTIPGVSAYGNATSVQVGNISGYIDTPDPPTIISYLPGLLYKFSCSYPLEYLVNNTQLASSSAAISVRENNGTFVSTLNLLLYNDSTYNQQLIIPSIGLPLKTKVFAAVQATNLDGRWNVLMDYCYTTPSGNPNDDIRYDLFLSCDKDPQTTVIENGRSQRGRFSFEVFRFVKHKNQKMSTVFLHCVTKLCRADDCPFLMPICSHRERRDAGRRTTWSPQSSSGSAVLSAGPIITRSDETPTNNSQLGSPSMPPFQLNAITSALISGMVILGVTSFSLLLCSLALLHRKGPTSLVLNGIRNPVFD

SEQ ID NO: 5339 - protein, 2961 aa, unidentified
MGNAPSHSSEDEAAAAGGEGWGPHQDWAAVSGTTPGPGVAAPALPPAAALLEPARLREAAAALLPTPPCESLVSRHRGALFRWLEERLGRGEESVTLEQFRELLEARGAGCSSEQFEEAFAQFDAEGDGTVDAENMLEALKNSSGANLQGELSHIIRQLQACSLVPGFTDIFSESKEGLDIHSSMILRFLHRNRLSSAVMPYPMLEHCNNMCTMRSSVLKESLDQLVQKEKESPGDLTRSPEMDKLKSVAKCYAYIETSSNSADIDKMTNGETSSYWQSDGSACSHWIRLKMKPDVVLRHLSIAVAATDQSYMPQQVTVAVGRNASDLQEVRDVHIPSNVTGYVTLLENANVSQLYVQINIKRCLSDGCDTRIHGLRAVGFQRVKKSGVSVSDASAIWYWSLLTSLVTASMETNPAFVQTVLHNTQKALRHMPPLSLSPGSTDFSTFLSPNVLEEVDSFLIRITSCCSTPEVELTLLAFALARGSVAKVMSSLCTITDHLDTQYDASSLILSMASVRQNLLLKYGKPLQLTLQACDVKGKEDKSGPENLLVEPWTRDGFLTETGKTRASTIFSTGTESAFQVTQIRIMVRRGGIGAQCGLVFAYNSSSDKFCAEEHFKRFEKYDKWKLQELRQFVKSRIGCSSDDLGEDDPIGWFELEEEWDEADVKLQQCRVAKYLMVKFLCTRQESAERLGVQGLTISGYLRPARAEAEQSVTCAHCRKDTEESVCGATLLLRTLQFIQQLAHDLVQQKESGLKYKSFLDFAGLDLQIFWNFYSKLKQNPREECVSAQTLLLQLLQSCFSVLQGDVLAASEEEKAPIQSPKGVEAAKELYTHLCDVVDKVDGDSVPMEILKQEVRNTLLNGAAIFFPNRQTRRNHLFTMMNVTEQEHKQSLQLTFRSLCTYFSDKDPGGLLLLPEKNDLAKMNISEVLAVMDTLVSVAARECELLMLSGAPGEVGSVLFSLFWSVQGSLLSWCYLQLKSTDSGAKDLAVDLIEKYVGQFLASMRAILESLFSQYSGKTIVERLCNSVFSMAARQLVIFLLDFCTLDIPHCVLLREFSVLTELLKKLCSGPEGGLRKLDVETWQQEQPVVLHTWTKESAHNYENNCHEVSVFVSPGATYFEVEFDDRCETEKRYDYLEFTDARGRKTRYDTKVGTDKWPKKVTFKAGPRLQFLFHSDSSHNEWGYKFTVTACGLPDVAVSWGLDLQLLVSRLMGRLASQCMALKSVRQLGSNMVVPQAKMALVLSSPLWKPVFRHQVCPELELEASWPTHPHRNSKEVKNIPDDPCRHFLLDFAQSEPAQNFCGPYSELFKGFIQACRKQAPKTDIVAGSTIDQAVNATFAALVYRTPDLYEKLQKYVNSGGKIALSEEFAQVYSLADGIRIWMLEMKQKSLMSLGNEAEEKHSSEATEVNPESLAKECIEKSLLLLKFLPTGISSKESCEKLETADETSHLQPLNKRQRTSSVVEEHFQASVSPTEAAPPATGDQSPGLGTQPKLPSSSGLPAADVSPATAEEPLSPSTPTRRPPFTRGRLRLLSFRSMEEARLVPTVKEKYPVLKDVMDFIKDQSLSHRSVVKVLSLRKAQAQSILEVLKITQHCAESLGQPHCFHPPFILFLLELLTCQKDFTNYFGHLEGCGADLHKEIRDTYYQLVLFLVKAVKGFSSLNDRSLLPALSCVQTALLHLLDMGWEPNDLAFFVDIQLPDLLMKMSQENISVHDSVISQWSEEDELADAKQNSEWMDECQDGMFEAWYEKIAQEDPEKQRKMHMFIARYCDLLNVDISCDGCDEIAPWHRYRCLQCSDMDLCKTCFLGGVKPEGHGDDHEMVNMEFTCDHCQGLIIGRRMNCNVCDDFDLCYGCYAAKKYSYGHLPTHSITAHPMVTIRISDRQRLIQPYIHNYSWLLFAALALYSAHLASAEDVDGEKLDPQTRSSATTLRSQCMQLVGDCLMKAHQGKGLKALALLGVLPDGDSSLEDQALPVTVPTGASEEQLEKKAVQGAELSEAGNGKRAVHEEIRPVDFKQRNKADKGVSLSKDPSCQTQISDSPADASPPTGLPDAEDSEVSSQKPIEEKAVTPSPEQVFAECSQKRILGLLAAMLPPLKSGPTVPLIDLEHVLPLMFQVVISNAGHLNETYHLTLGLLGQLIIRLLPAEVDAAVIKVLSAKHNLFAAGDSSIVPDGWKTTHLLFSLGAVCLDSRVGLDWACSMAEILRSLNSAPLWRDVIATFTDHCIKQLPFQLKHTNIFTLLVLVGFPQVLCVGTRCVYMDNANEPHNVIILKHFTEKNRAVIVDVKTRKRKTVKDYQLVQKGGGQECGDSRAQLSQYSQHFAFIASHLLQSSMDSHCPEAVEATWVLSLALKGLYKTLKAHGFEEIRATFLQTDLLKLLVKKCSKGTGFSKTWLLRDLEILSIMLYSSKKEINALAEHGDLELDERGDREEEVERPVSSPGDPEQKKLDPLEGLDEPTRICFLMAHDALNAPLHILRAIYELQMKKTDYFFLEVQKRFDGDELTTDERIRSLAQRWQPSKSLRLEEQSAKAVDTDMIILPCLSRPARCDQATAESNPVTQKLISSTESELQQSYAKQRRSKSAALLHKELNCKSKRAVRDYLFRVNEATAVLYARHVLASLLAEWPSHVPVSEDILELSGPAHMTYILDMFMQLEEKHEWEKILQKVLQGCREDMLGTMALAACQFMEEPGMEVQVRESKHPYNNNTNFEDKVHIPGAIYLSIKFDSQCNTEEGCDELAMSSSSDFQQDRHSFSGSQQKWKDFELPGDTLYYRFTSDMSNTEWGYRFTVTAGHLGRFQTGFEILKQMLSEERVVPHLPLAKIWEWLVGVACRQTGHQRLKAIHLLLRIVRCCGHSDLCDLALLKPLWQLFTHMEYGLFEDVTQPGILLPLHRALTELFFVTENRAQELGVLQDYLLALTTDDHLLRCAAQALQNIAAISLAINYPNKATRLWNVEC

SEQ ID NO: 5340 - protein, 495 aa, unidentified
MSMLVVFLLLWGVTWGPVTEAAIFYETQPSLWAESESLLKPLANVTLTCQAHLETPDFQLFKNGVAQEPVHLDSPAIKHQFLLTGDTQGRYRCRSGLSTGWTQLSKLLELTGPKSLPAPWLSMAPVSWITPGLKTTAVCRGVLRGVTFLLRREGDHEFLEVPEAQEDVEATFPVHQPGNYSCSYRTDGEGALSEPSATVTIEELAAPPPPVLMHHGESSQVLHPGNKVTLTCVAPLSGVDFQLRRGEKELLVPRSSTSPDRIFFHLNAVALGDGGHYTCRYRLHDNQNGWSGDSAPVELILSDETLPAPEFSPEPESGRALRLRCLAPLEGARFALVREDRGGRRVHRFQSPAGTEALFELHNISVADSANYSCVYVDLKPPFGGSAPSERLELHVDGPPPRPQLRATWSGAVLAGRDAVLRCEGPIPDVTFELLREGETKAVKTVRTPGAAANLELIFVGPQHAGNYRCRYRSWVPHTFESELSDPVELLVAES

SEQ ID NO: 5341 - protein, 1474 aa, unidentified
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDNEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTQNLLQMPYGCGEQNMVLFAPNIYVLDYLNETQQLTPEIKSKAIGYLNTGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAHTSFQISLSVSYTGSRSASNMAIVDVKMVSGFIPLKPTVKMLERSNHVSRTEVSSNHVLIYLDKVSNQTLSLFFTVLQDVPVRDLKPAIVKVYDYYETDEFAIAEYNAPCSKDLGNA

SEQ ID NO: 5342 - protein, 340 aa, unidentified
MRKELQLSLSVTLLLVCGFLYQFTLKSSCLFCLPSFKSHQGLEALLSHRRGIVFLETSERMEPPHLVSCSVESAAKIYPEWPVVFFMKGLTDSTPMPSNSTYPAFSFLSAIDNVFLFPLDMKRLLEDTPLFSWYNQINASAERNWLHISSDASRLAIIWKYGGIYMDTDVISIRPIPEENFLAAQASRYSSNGIFGFLPHHPFLWECMENFVEHYNSAIWGNQGPELMTRMLRVWCKLEDFQEVSDLRCLNISFLHPQRFYPISYREWRRYYEVWDTEPSFNVSYALHLWNHMNQEGRAVIRGSNTLVENLYRKHCPRTYRDLIKGPEGSVTGELGPGNK

SEQ ID NO: 5343 - protein, 401 aa, unidentified
MGLKALCLGLLCVLFVSHFYTPMPDNIEESWKIMALDAIAKTCTFTAMCFENMRIMRYEEFISMIFRLDYTQPLSDEYITVTDTTFVDIPVRLYLPKRKSETRRRAVIYFHGGGFCFGSSKQRAFDFLNRWTANTLDAVVVGVDYRLAPQHHFPAQFEDGLAAVKFFLLEKILTKYGVDPTRICIAGDSSGGNLATAVTQQVQNDAEIKHKIKMQVLLYPGLQITDSYLPSHRENEHGIVLTRDVAIKLVSLYFTKDEALPWAMRRNQHMPLESRHLFKFVNWSILLPEKYRKDYVYTEPILGGLSYSLPGLTDSRALPLLANDSQLQNLPLTYILTCQHDLLRDDGLMYVTRLRNVGVQVVHEHIEDGIHGALSFMTSPFYLRLGLRIRDMYVSWLDKNL

SEQ ID NO: 5344 - protein, 207 aa, unidentified
MSTQSTHPLKPEAPRLPPGIPESPSCQRRHTLPASEFRCLTPEDAVSAFEIEREAFISVLGVCPLYLDEIRHFLTLCPELSLGWFEEGCLVAFIIGSLWDKERLMQESLTLHRSGGHIAHLHVLAVHRAFRQQGRGPILLWRYLHHLGSQPAVRRAALMCEDALVPFYERFSFHAVGPCAITVGSLTFMELHCSLRGHPFLRRNSGC

SEQ ID NO: 5345 - protein, 678 aa, unidentified; identical to SEQ ID NO: 211

SEQ ID NO: 5346 - protein, 405 aa, unidentified; identical to SEQ ID NO: 216

SEQ ID NO: 5347 - protein, 306 aa, unidentified
MAVARLAAVAAWVPCRSWGWAAVPFGPHRGLSVLLARIPQRAPRWLPACRQKTSLSFLNRPDLPNLAYKKLKGKSPGIIFIPGYLSYMNGTKALAIEEFCKSLGHACIRFDYSGVGSSDGNSEESTLGKWRKDVLSIIDDLADGPQILVGSSLGGWLMLHAAIARPEKVVALIGVATAADTLVTKFNQLPVELKKEVEMKGVWSMPSKYSEEGVYNVQYSFIKEAEHHCLLHSPIPVNCPIRLLHGMKDDIVPWHTSMQVADRVLSTDVDVILRKHSDHRMREKADIQLLVYTIDDLIDKLSTIVN

SEQ ID NO: 5348 - protein, 271 aa, unidentified; identical to SEQ ID NO: 219

SEQ ID NO: 5349 - protein, 468 aa, unidentified
MPPWGAALALILAVLALLGLLGPRLRGPWGRAVGERTLPGAQDRDDGEEADGGGPADQFSDGREPLPGGCSLVCKPSALAQCLLRALRRSEALEAGPRSWFSGPHLQTLCHFVLPVAPGPELAREYLQLADDGLVALDWVVGPCVRGRRITSAGGLPAVLLVIPNAWGRLTRNVLGLCLLALERGYYPVIFHRRGHHGCPLVSPRLQPFGDPSDLKEAVTYIRFRHPAAPLFAVSEGSGSALLLSYLGECGSSSYVTGAACISPVLRCREWFEAGLPWPYERGFLLHQKIALSRYATALEDTVDTSRLFRSRSLREFEEALFCHTKSFPISWDTYWDRNDPLRDVDEAAVPVLCICSADDPVCGPPDHTLTTELFHSNPYFFLLLSRHGGHCGFLRQEPLPAWSHEVILESFRALTEFFRTEERIKGLSRHRASFLGGRRRGGALQRREVSSSSNLEEIFNWKRSYTR

SEQ ID NO: 5350 - protein, 1075 aa, unidentified
MRGGKCNMLSSLGCLLLCGSITLALGNAQKLPKGKRPNLKVHINTTSDSILLKFLRPSPNVKLEGLLLGYGSNVSPNQYFPLPAEGKFTEAIVDAEPKYLIVVRPAPPPSQKKSCSGKTRSRKPLQLVVGTLTPSSVFLSWGFLINPHHDWTLPSHCPNDRFYTIRYREKDKEKKWIFQICPATETIVENLKPNTVYEFGVKDNVEGGIWSKIFNHKTVVGSKKVNGKIQSTYDQDHTVPAYVPRKLIPITIIKQVIQNVTHKDSAKSPEKAPLGGVILVHLIIPGLNETTVKLPASLMFEISDALKTQLAKNETLALPAESKTPEVEKISARPTTVTPETVPRSTKPTTSSALDVSETTLASSEKPWIVPTAKISEDSKVLQPQTATYDVFSSPTTSDEPEISDSYTATSDRILDSIPPKTSRTLEQPRATLAPSETPFVPQKLEIFTSPEMQPTTPAPQQTTSIPSTPKRRPRPKPPRTKPERTTSAGTITPKISKSPEPTWTTPAPGKTQFISLKPKIPLSPEVTHTKPAPKQTPRAPPKPKTSPRPRIPQTQPVPKVPQRVTAKPKTSPSPEVSYTTPAPKDVLLPHKPYPEVSQSEPAPLETRGIPFIPMISPSPSQEELQTTLEETDQSTQEPFTTKIPRTTELAKTTQAPHRFYTTVRPRTSDKPHIRPGVKQAPRPSGADRNVSVDSTHPTKKPGTRRPPLPPRPTHPRRKPLPPNNVTGKPGSAGIISSGPITTPPLRSTPRPTGTPLERIETDIKQPTVPASGEELENITDFSSSPTRETDPLGKPRFKGPHVRYIQKPDNSPCSITDSVKRFPKEEATEGNATSPPQNPPTNLTVVTVEGCPSFVILDWEKPLNDTVTEYEVISRENGSFSGKNKSIQMTNQTFSTVENLKPNTSYEFQVKPKNPLGEGPVSNTVAFSTESADPRVSEPVSAGRDAIWTERPFNSDSYSECKGKQYVKRTWYKKFVGVQLCNSLRYKIYLSDSLTGKFYNIGDQRGHGEDHCQFVDSFLDGRTGQQLTSDQLPIKEGYFRAVRQEPVQFGEIGGHTQINYVQWYECGTTIPGKW

SEQ ID NO: 5351 - protein, 2458 aa, unidentified
MVLLLCLSCLIFSCLTFSWLKIWGKMTDSKPITKSKSEANLIPSQEPFPASDNSGETPQRNGEGHTLPKTPSQAEPASHKGPKDAGRRRNSLPPSHQKPPRNPLSSSDAAPSPELQANGTGTQGLEATDTNGLSSSARPQGQQAGSPSKEDKKQANIKRQLMTNFILGSFDDYSSDEDSVAGSSRESTRKGSRASLGALSLEAYLTTGEAETRVPTMRPSMSGLHLVKRGREHKKLDLHRDFTVASPAEFVTRFGGDRVIEKVLIANNGIAAVKCMRSIRRWAYEMFRNERAIRFVVMVTPEDLKANAEYIKMADHYVPVPGGPNNNNYANVELIVDIAKRIPVQAVWAGWGHASENPKLPELLCKNGVAFLGPPSEAMWALGDKIASTVVAQTLQVPTLPWSGSGLTVEWTEDDLQQGKRISVPEDVYDKGCVKDVDEGLEAAERIGFPLMIKASEGGGGKGIRKAESAEDFPILFRQVQSEIPGSPIFLMKLAQHARHLEVQILADQYGNAVSLFGRDCSIQRRHQKIVEEAPATIAPLAIFEFMEQCAIRLAKTVGYVSAGTVEYLYSQDGSFHFLELNPRLQVEHPCTEMIADVNLPAAQLQIAMGVPLHRLKDIRLLYGESPWGVTPISFETPSNPPLARGHVIAARITSENPDEGFKPSSGTVQELNFRSSKNVWGYFSVAATGGLHEFADSQFGHCFSWGENREEAISNMVVALKELSIRGDFRTTVEYLINLLETESFQNNDIDTGWLDYLIAEKVQAEKPDIMLGVVCGALNVADAMFRTCMTDFLHSLERGQVLPADSLLNLVDVELIYGGVKYILKVARQSLTMFVLIMNGCHIEIDAHRLNDGGLLLSYNGNSYTTYMKEEVDSYRITIGNKTCVFEKENDPTVLRSPSAGKLTQYTVEDGGHVEAGSSYAEMEVMKMIMTLNVQERGRVKYIKRPGAVLEAGCVVARLELDDPSKVHPAEPFTGELPAQQTLPILGEKLHQVFHSVLENLTNVMSGFCLPEPVFSIKLKEWVQKLMMTLRHPSLPLLELQEIMTSVAGRIPAPVEKSVRRVMAQYASNITSVLCQFPSQQIATILDCHAATLQRKADREVFFINTQSIVQLVQRYRSGIRGYMKTVVLDLLRRYLRVEHHFQQAHYDKCVINLREQFKPDMSQVLDCIFSHAQVAKKNQLVIMLIDELCGPDPSLSDELISILNELTQLSKSEHCKVALRARQILIASHLPSYELRHNQVESIFLSAIDMYGHQFCPENLKKLILSETTIFDVLPTFFYHANKVVCMASLEVYVRRGYIAYELNSLQHRQLPDGTCVVEFQFMLPSSHPNRMTVPISITNPDLLRHSTELFMDSGFSPLCQRMGAMVAFRRFEDFTRNFDEVISCFANVPKDTPLFSEARTSLYSEDDCKSLREEPIHILNVSIQCADHLEDEALVPILRTFVQSKKNILVDYGLRRITFLIAQEKEFPKFFTFRARDEFAEDRIYRHLEPALAFQLELNRMRNFDLTAVPCANHKMHLYLGAAKVKEGVEVTDHRFFIRAIIRHSDLITKEASFEYLQNEGERLLLEAMDELEVAFNNTSVRTDCNHIFLNFVPTVIMDPFKIEESVRYMVMRYGSRLWKLRVLQAEVKINIRQTTTGSAVPIRLFITNESGYYLDISLYKEVTDSRSGNIMFHSFGNKQGPQHGMLINTPYVTKDLLQAKRFQAQTLGTTYIYDFPEMFRQALFKLWGSPDKYPKDILTYTELVLDSQGQLVEMNRLPGGNEVGMVAFKMRFKTQEYPEGRDVIVIGNDITFRIGSFGPGEDLLYLRASEMARAEGIPKIYVAANSGARIGMAEEIKHMFHVAWVDPEDPHKGFKYLYLTPQDYTRISSLNSVHCKHIEEGGESRYMITDIIGKDDGLGVENLRGSGMIAGESSLAYEEIVTISLVTCRAIGIGAYLVRLGQRVIQVENSHIILTGASALNKVLGREVYTSNNQLGGVQIMHYNGVSHITVPDDFEGVYTILEWLSYMPKDNHSPVPIITPTDPIDREIEFLPSRAPYDPRWMLAGRPHPTLKGTWQSGFFDHGSFKEIMAPWAQTVVTGRARLGGIPVGVIAVETRTVEVAVPADPANLDSEAKIIQQAGQVWFPDSAYKTAQAVKDFNREKLPLMIFANWRGFSGGMKDMYDQVLKFGAYIVDGLRQYKQPILIYIPPYAELRGGSWVVIDATINPLCIEMYADKESRGGVLEPEGTVEIKFRKKDLIKSMRRIDPAYKKLMEQLGEPDLSDKDRKDLEGRLKAREDLLLPIYHQVAVQFADFHDTPGRMLEKGVISDILEWKTARTFLYWRLRRLLLEDQVKQEILQASGELSHVHIQSMLRRWFVETEGAVKAYLWDNNQVVVQWLEQHWQAGDGPRSTIRENITYLKHDSVLKTIRGLVEENPEVAVDCVIYLSQHISPAERAQVVHLLSTMDSPAST

SEQ ID NO: 5352 - protein, 1306 aa, unidentified; identical to SEQ ID NO: 226

SEQ ID NO: 5353 - protein, 614 aa, unidentified; identical to SEQ ID NO: 231

SEQ ID NO: 5354 - protein, 423 aa, unidentified; identical to SEQ ID NO: 236

SEQ ID NO: 5355 - protein, 325 aa, unidentified
MDMWTALLILQALLLPSLADGATPALRFVAVGDWGGVPNAPFHTAREMANAKEIARTVQILGADFILSLGDNFYFTGVQDINDKRFQETFEDVFSDRSLRKVPWYVLAGNHDHLGNVSAQIAYSKISKRWNFPSPFYRLHFKIPQTNVSVAIFMLDTVTLCGNSDDFLSQQPERPRDVKLARTQLSWLKKQLAAAREDYVLVAGHYPVWSIAEHGPTHCLVKQLRPLLATYGVTAYLCGHDHNLQYLQDENGVGYVLSGAGNFMDPSKRHQRKVPNGYLRFHYGTEDSLGGFAYVEISSKEMTVTYIEASGKSLFKTRLPRRARP

SEQ ID NO: 5356 - protein, 428 aa, unidentified
MITGVFSMRLWTPVGVLTSLAYCLHQRRVALAELQEADGQCPVDRSLLKLKMVQVVFRHGARSPLKPLPLEEQVEWNPQLLEVPPQTQFDYTVTNLAGGPKPYSPYDSQYHETTLKGGMFAGQLTKVGMQQMFALGERLRKNYVEDIPFLSPTFNPQEVFIRSTNIFRNLESTRCLLAGLFQCQKEGPIIIHTDEADSEVLYPNYQSCWSLRQRTRGRRQTASLQPGISEDLKKVKDRMGIDSSDKVDFFILLDNVAAEQAHNLPSCPMLKRFARMIEQRAVDTSLYILPKEDRESLQMAVGPFLHILESNLLKAMDSATAPDKIRKLYLYAAHDVTFIPLLMTLGIFDHKWPPFAVDLTMELYQHLESKEWFVQLYYHGKEQVPRGCPDGLCPLDMFLNAMSVYTLSPEKYHALCSQTQVMEVGNEE

SEQ ID NO: 5357 - protein, 386 aa, unidentified; identical to SEQ ID NO: 237

SEQ ID NO: 5358 - protein, 421 aa, unidentified
MVEMLPTAILLVLAVSVVAKDNATCDGPCGLRFRQNPQGGVRIVGGKAAQHGAWPWMVSLQIFTYNSHRYHTCGGSLLNSRWVLTAAHCFVGKNNVHDWRLVFGAKEITYGNNKPVKAPLQERYVEKIIIHEKYNSATEGNDIALVEITPPISCGRFIGPGCLPHFKAGLPRGSQSCWVAGWGYIEEKAPRPSSILMEARVDLIDLDLCNSTQWYNGRVQPTNVCAGYPVGKIDTCQGDSGGPLMCKDSKESAYVVVGITSWGVGCARAKRPGIYTATWPYLNWIASKIGSNALRMIQSATPPPPTTRPPPIRPPFSHPISAHLPWYFQPPPRPLPPRPPAAQPRPPPSPPPPPPPPASPLPPPPPPPPPTPSSTTKLPQGLSFAKRLQQLIEVLKGKTYSDGKNHYDMETTELPELTSTS

SEQ ID NO: 5359 - protein, 543 aa, unidentified
MRKPAAGFLPSLLKVLLLPLAPAAAQDSTQASTPGSPLSPTEYERFFALLTPTWKAETTCRLRATHGCRNPTLVQLDQYENHGLVPDGAVCSNLPYASWFESFCQFTHYRCSNHVYYAKRVLCSQPVSILSPNTLKEIEASAEVSPTTMTSPISPHFTVTERQTFQPWPERLSNNVEELLQSSLSLGGQEQAPEHKQEQGVEHRQEPTQEHKQEEGQKQEEQEEEQEEEGKQEEGQGTKEGREAVSQLQTDSEPKFHSESLSSNPSSFAPRVREVESTPMIMENIQELIRSAQEIDEMNEIYDENSYWRNQNPGSLLQLPHTEALLVLCYSIVENTCIITPTAKAWKYMEEEILGFGKSVCDSLGRRHMSTCALCDFCSLKLEQCHSEASLQRQQCDTSHKTPFVSPLLASQSLSIGNQVGSPESGRFYGLDLYGGLHMDFWCARLATKGCEDVRVSGWLQTEFLSFQDGDFPTKICDTDYIQYPNYCSFKSQQCLMRNRNRKVSRMRCLQNETYSALSPGKSEDVVLRWSQEFSTLTLGQFG

SEQ ID NO: 5360 - protein, 265 aa, unidentified
MNRFLLLMSLYLLGSARGTSSQPNELSGSIDHQTSVQQLPGEFFSLENPSDAEALYETSSGLNTLSEHGSSEHGSSKHTVAEHTSGEHAESEHASGEPAATEHAEGEHTVGEQPSGEQPSGEHLSGEQPLSELESGEQPSDEQPSGEHGSGEQPSGEQASGEQPSGEHASGEQASGAPISSTSTGTILNCYTCAYMNDQGKCLRGEGTCITQNSQQCMLKKIFEGGKLQFMVQGCENMCPSMNLFSHGTRMQIICCRNQSFCNKI

SEQ ID NO: 5361 - protein, 615 aa, unidentified; identical to SEQ ID NO: 240

SEQ ID NO: 5362 - protein, 245 aa, unidentified
MASTALLALCSTGAFSGLAVEAGAGVCHATPIYAGHSWHQATFRLNVAGSTLSRYLRDLLVAANPDLLQQALPRKAITHLKKRSCYVSLDFEGDLRDPARHHPASFSVGNGCCVCLSSERFRCPEPIFQPGLLGQAEQGLPALAFRALQKMPKTLRTRLADTVVLAGGSTLFPGFAERLDKELEAQCRRHGYAALRPHLVAKHGRGMAVWTGGSMVASLHSFQRRWITRAMYQECGSRLLYDVFN

SEQ ID NO: 5363 - protein, 509 aa, unidentified; identical to SEQ ID NO: 255

SEQ ID NO: 5364 - protein, 493 aa, unidentified; identical to SEQ ID NO: 257

SEQ ID NO: 5365 - protein, 503 aa, unidentified; identical to SEQ ID NO: 260

SEQ ID NO: 5366 - protein, 99 aa, unidentified
MAEGNTLISVDYEIFGKVQGVFFRKHTQAEGKKLGLVGWVQNTDRGTVQGQLQGPISKVRHMQEWLETRGSPKSHIDKANFNNEKVILKLDYSDFQIVK

SEQ ID NO: 5367 - protein, 99 aa, unidentified
MSTAQSLKSVDYEVFGRVQGVCFRMYTEDEARKIGVVGWVKNTSKGTVTGQVQGPEDKVNSMKSWLSKVGSPSSRIDRTNFSNEKTISKLEYSNFSIRY

SEQ ID NO: 5368 - protein, 748 aa, unidentified; identical to SEQ ID NO: 261

SEQ ID NO: 5369 - protein, 909 aa, unidentified; identical to SEQ ID NO: 263

SEQ ID NO: 5370 - protein, 863 aa, unidentified; identical to SEQ ID NO: 264

SEQ ID NO: 5371 - protein, 824 aa, unidentified; identical to SEQ ID NO: 265

SEQ ID NO: 5372 - protein, 739 aa, unidentified; identical to SEQ ID NO: 266

SEQ ID NO: 5373 - protein, 906 aa, unidentified; identical to SEQ ID NO: 271

SEQ ID NO: 5374 - protein, 775 aa, unidentified; identical to SEQ ID NO: 273

SEQ ID NO: 5375 - protein, 820 aa, unidentified; identical to SEQ ID NO: 274

SEQ ID NO: 5376 - protein, 787 aa, unidentified; identical to SEQ ID NO: 276

SEQ ID NO: 5377 - protein, 813 aa, unidentified; identical to SEQ ID NO: 277

SEQ ID NO: 5378 - protein, 754 aa, unidentified; identical to SEQ ID NO: 278

SEQ ID NO: 5379 - protein, 824 aa, unidentified; identical to SEQ ID NO: 279

SEQ ID NO: 5380 - protein, 819 aa, unidentified; identical to SEQ ID NO: 280

SEQ ID NO: 5381 - protein, 470 aa, unidentified
MLRGISQLPAVATMSWVLLPVLWLIVQTQAIAIKQTPELTLHEIVCPKKLHILHKREIKNNQTEKHGKEERYEPEVQYQMILNGEEIILSLQKTKHLLGPDYTETLYSPRGEEITTKPENMEHCYYKGNILNEKNSVASISTCDGLRGYFTHHHQRYQIKPLKSTDEKEHAVFTSNQEEQDPANHTCGVKSTDGKQGPIRISRSLKSPEKEDFLRAQKYIDLYLVLDNAFYKNYNENLTLIRSFVFDVMNLLNVIYNTIDVQVALVGMEIWSDGDKIKVVPSASTTFDNFLRWHSSNLGKKIHDHAQLLSGISFNNRRVGLAASNSLCSPSSVAVIEAKKKNNVALVGVMSHELGHVLGMPDVPFNTKCPSGSCVMNQYLSSKFPKDFSTSCRAHFERYLLSQKPKCLLQAPIPTNIMTTPVCGNHLLEVGEDCDCGSPKECTNLCCEALTCKLKPGTDCGGDAPNHTTE

SEQ ID NO: 5382 - protein, 967 aa, unidentified; identical to SEQ ID NO: 281

SEQ ID NO: 5383 - protein, 1103 aa, unidentified
MAPACQILRWALALGLGLMFEVTHAFRSQDEFLSSLESYEIAFPTRVDHNGALLAFSPPPPRRQRRGTGATAESRLFYKVASPSTHFLLNLTRSSRLLAGHVSVEYWTREGLAWQRAARPHCLYAGHLQGQASTSHVAISTCGGLHGLIVADEEEYLIEPLHGGPKGSRSPEESGPHVVYKRSSLRHPHLDTACGVRDEKPWKGRPWWLRTLKPPPARPLGNETERGQPGLKRSVSRERYVETLVVADKMMVAYHGRRDVEQYVLAIMNIVAKLFQDSSLGSTVNILVTRLILLTEDQPTLEITHHAGKSLDSFCKWQKSIVNHSGHGNAIPENGVANHDTAVLITRYDICIYKNKPCGTLGLAPVGGMCERERSCSVNEDIGLATAFTIAHEIGHTFGMNHDGVGNSCGARGQDPAKLMAAHITMKTNPFVWSSCSRDYITSFLDSGLGLCLNNRPPRQDFVYPTVAPGQAYDADEQCRFQHGVKSRQCKYGEVCSELWCLSKSNRCITNSIPAAEGTLCQTHTIDKGWCYKRVCVPFGSRPEGVDGAWGPWTPWGDCSRTCGGGVSSSSRHCDSPRPTIGGKYCLGERRRHRSCNTDDCPPGSQDFREVQCSEFDSIPFRGKFYKWKTYRGGGVKACSLTCLAEGFNFYTERAAAVVDGTPCRPDTVDICVSGECKHVGCDRVLGSDLREDKCRVCGGDGSACETIEGVFSPASPGAGYEDVVWIPKGSVHIFIQDLNLSLSHLALKGDQESLLLEGLPGTPQPHRLPLAGTTFQLRQGPDQVQSLEALGPINASLIVMVLARTELPALRYRFNAPIARDSLPPYSWHYAPWTKCSAQCAGGSQVQAVECRNQLDSSAVAPHYCSAHSKLPKRQRACNTEPCPPDWVVGNWSLCSRSCDAGVRSRSVVCQRRVSAAEEKALDDSACPQPRPPVLEACHGPTCPPEWAALDWSECTPSCGPGLRHRVVLCKSADHRATLPPAHCSPAAKPPATMRCNLRRCPPARWVAGEWGECSAQCGVGQRQRSVRCTSHTGQASHECTEALRPPTTQQCEAKCDSPTPGDGPEECKDVNKVAYCPLVLKFQFCSRAYFRQMCCKTCHGH

SEQ ID NO: 5384 - protein, 1594 aa, unidentified
MPCAQRSWLANLSVVAQLLNFGALCYGRQPQPGPVRFPDRRQEHFIKGLPEYHVVGPVRVDASGHFLSYGLHYPITSSRRKRDLDGSEDWVYYRISHEEKDLFFNLTVNQGFLSNSYIMEKRYGNLSHVKMMASSAPLCHLSGTVLQQGTRVGTAALSACHGLTGFFQLPHGDFFIEPVKKHPLVEGGYHPHIVYRRQKVPETKEPTCGLKDSVNISQKQELWREKWERHNLPSRSLSRRSISKERWVETLVVADTKMIEYHGSENVESYILTIMNMVTGLFHNPSIGNAIHIVVVRLILLEEEEQGLKIVHHAEKTLSSFCKWQKSINPKSDLNPVHHDVAVLLTRKDICAGFNRPCETLGLSHLSGMCQPHRSCNINEDSGLPLAFTIAHELGHSFGIQHDGKENDCEPVGRHPYIMSRQLQYDPTPLTWSKCSEEYITRFLDRGWGFCLDDIPKKKGLKSKVIAPGVIYDVHHQCQLQYGPNATFCQEVENVCQTLWCSVKGFCRSKLDAAADGTQCGEKKWCMAGKCITVGKKPESIPGGWGRWSPWSHCSRTCGAGVQSAERLCNNPEPKFGGKYCTGERKRYRLCNVHPCRSEAPTFRQMQCSEFDTVPYKNELYHWFPIFNPAHPCELYCRPIDGQFSEKMLDAVIDGTPCFEGGNSRNVCINGICKMVGCDYEIDSNATEDRCGVCLGDGSSCQTVRKMFKQKEGSGYVDIGLIPKGARDIRVMEIEGAGNFLAIRSEDPEKYYLNGGFIIQWNGNYKLAGTVFQYDRKGDLEKLMATGPTNESVWIQLLFQVTNPGIKYEYTIQKDGLDNDVEQQMYFWQYGHWTECSVTCGTGIRRQTAHCIKKGRGMVKATFCDPETQPNGRQKKCHEKACPPRWWAGEWEACSATCGPHGEKKRTVLCIQTMVSDEQALPPTDCQHLLKPKTLLSCNRDILCPSDWTVGNWSECSVSCGGGVRIRSVTCAKNHDEPCDVTRKPNSRALCGLQQCPSSRRVLKPNKGTISNGKNPPTLKPVPPPTSRPRMLTTPTGPESMSTSTPAISSPSPTTASKEGDLGGKQWQDSSTQPELSSRYLISTGSTSQPILTSQSLSIQPSEENVSSSDTGPTSEGGLVATTTSGSGLSSSRNPITWPVTPFYNTLTKGPEMEIHSGSGEEREQPEDKDESNPVIWTKIRVPGNDAPVESTEMPLAPPLTPDLSRESWWPPFSTVMEGLLPSQRPTTSETGTPRVEGMVTEKPANTLLPLGGDHQPEPSGKTANRNHLKLPNNMNQTKSSEPVLTEEDATSLITEGFLLNASNYKQLTNGHGSAHWIVGNWSECSTTCGLGAYWRRVECSTQMDSDCAAIQRPDPAKRCHLRPCAGWKVGNWSKCSRNCSGGFKIREIQCVDSRDHRNLRPFHCQFLAGIPPPLSMSCNPEPCEAWQVEPWSQCSRSCGGGVQERGVFCPGGLCDWTKRPTSTMSCNEHLCCHWATGNWDLCSTSCGGGFQKRTVQCVPSEGNKTEDQDQCLCDHKPRPPEFKKCNQQACKKSADLLCTKDKLSASFCQTLKAMKKCSVPTVRAECCFSCPQTHITHTQRQRRQRLLQKSKEL

SEQ ID NO: 5385 - protein, 1427 aa, unidentified
MHQRHPRARCPPLCVAGILACGFLLGCWGPSHFQQSCLQALEPQAVSSYLSPGAPLKGRPPSPGFQRQRQRQRRAAGGILHLELLVAVGPDVFQAHQEDTERYVLTNLNIGAELLRDPSLGAQFRVHLVKMVILTEPEGAPNITANLTSSLLSVCGWSQTINPEDDTDPGHADLVLYITRFDLELPDGNRQVRGVTQLGGACSPTWSCLITEDTGFDLGVTIAHEIGHSFGLEHDGAPGSGCGPSGHVMASDGAAPRAGLAWSPCSRRQLLSLLSAGRARCVWDPPRPQPGSAGHPPDAQPGLYYSANEQCRVAFGPKAVACTFAREHLDMCQALSCHTDPLDQSSCSRLLVPLLDGTECGVEKWCSKGRCRSLVELTPIAAVHGRWSSWGPRSPCSRSCGGGVVTRRRQCNNPRPAFGGRACVGADLQAEMCNTQACEKTQLEFMSQQCARTDGQPLRSSPGGASFYHWGAAVPHSQGDALCRHMCRAIGESFIMKRGDSFLDGTRCMPSGPREDGTLSLCVSGSCRTFGCDGRMDSQQVWDRCQVCGGDNSTCSPRKGSFTAGRAREYVTFLTVTPNLTSVYIANHRPLFTHLAVRIGGRYVVAGKMSISPNTTYPSLLEDGRVEYRVALTEDRLPRLEEIRIWGPLQEDADIQVYRRYGEEYGNLTRPDITFTYFQPKPRQAWVWAAVRGPCSVSCGAGLRWVNYSCLDQARKELVETVQCQGSQQPPAWPEACVLEPCPPYWAVGDFGPCSASCGGGLRERPVRCVEAQGSLLKTLPPARCRAGAQQPAVALETCNPQPCPARWEVSEPSSCTSAGGAGLALENETCVPGADGLEAPVTEGPGSVDEKLPAPEPCVGMSCPPGWGHLDATSAGEKAPSPWGSIRTGAQAAHVWTPAAGSCSVSCGRGLMELRFLCMDSALRVPVQEELCGLASKPGSRREVCQAVPCPARWQYKLAACSVSCGRGVVRRILYCARAHGEDDGEEILLDTQCQGLPRPEPQEACSLEPCPPRWKVMSLGPCSASCGLGTARRSVACVQLDQGQDVEVDEAACAALVRPEASVPCLIADCTYRWHVGTWMECSVSCGDGIQRRRDTCLGPQAQAPVPADFCQHLPKPVTVRGCWAGPCVGQGTPSLVPHEEAAAPGRTTATPAGASLEWSQARGLLFSPAPQPRRLLPGPQENSVQSSACGRQHLEPTGTIDMRGPGQADCAVAIGRPLGEVVTLRVLESSLNCSAGDMLLLWGRLTWRKMCRKLLDMTFSSKTNTLVVRQRCGRPGGGVLLRYGSQLAPETFYRECDMQLFGPWGEIVSPSLSPATSNAGGCRLFINVAPHARIAIHALATNMGAGTEGANASYILIRDTHSLRTTAFHGQQVLYWESESSQAEMEFSEGFLKAQASLRGQYWTLQSWVPEMQDPQSWKGKEGT

SEQ ID NO: 5386 - protein, 1223 aa, unidentified
MAPLRALLSYLLPLHCALCAAAGSRTPELHLSGKLSDYGVTVPCSTDFRGRFLSHVVSGPAAASAGSMVVDTPPTLPRHSSHLRVARSPLHPGGTLWPGRVGRHSLYFNVTVFGKELHLRLRPNRRLVVPGSSVEWQEDFRELFRQPLRQECVYTGGVTGMPGAAVAISNCDGLAGLIRTDSTDFFIEPLERGQQEKEASGRTHVVYRREAVQQEWAEPDGDLHNEAFGLGDLPNLLGLVGDQLGDTERKRRHAKPGSYSIEVLLVVDDSVVRFHGKEHVQNYVLTLMNIVDEIYHDESLGVHINIALVRLIMVGYRQSLSLIERGNPSRSLEQVCRWAHSQQRQDPSHAEHHDHVVFLTRQDFGPSGYAPVTGMCHPLRSCALNHEDGFSSAFVIAHETGHVLGMEHDGQGNGCADETSLGSVMAPLVQAAFHRFHWSRCSKLELSRYLPSYDCLLDDPFDPAWPQPPELPGINYSMDEQCRFDFGSGYQTCLAFRTFEPCKQLWCSHPDNPYFCKTKKGPPLDGTECAPGKWCFKGHCIWKSPEQTYGQDGGWSSWTKFGSCSRSCGGGVRSRSRSCNNPSPAYGGRLCLGPMFEYQVCNSEECPGTYEDFRAQQCAKRNSYYVHQNAKHSWVPYEPDDDAQKCELICQSADTGDVVFMNQVVHDGTRCSYRDPYSVCARGECVPVGCDKEVGSMKADDKCGVCGGDNSHCRTVKGTLGKASKQAGALKLVQIPAGARHIQIEALEKSPHRIVVKNQVTGSFILNPKGKEATSRTFTAMGLEWEDAVEDAKESLKTSGPLPEAIAILALPPTEGGPRSSLAYKYVIHEDLLPLIGSNNVLLEEMDTYEWALKSWAPCSKACGGGIQFTKYGCRRRRDHHMVQRHLCDHKKRPKPIRRRCNQHPCSQPVWVTEEWGACSRSCGKLGVQTRGIQCLLPLSNGTHKVMPAKACAGDRPEARRPCLRVPCPAQWRLGAWSQCSATCGEGIQQRQVVCRTNANSLGHCEGDRPDTVQVCSLPACGGNHQNSTVRADVWELGTPEGQWVPQSEPLHPINKISSTEPCTGDRSVFCQMEVLDRYCSIPGYHRLCCVSCIKKASGPNPGPDPGPTSLPPFSTPGSPLPGPQDPADAAEPPGKPTGSEDHQHGRATQLPGALDTSSPGTQHPFAPETPIPGASWSISPTTPGGLPWGWTQTPTPVPEDKGQPGEDLRHPGTSLPAASPVT

SEQ ID NO: 5387 - protein, 950 aa, unidentified
MLLLGILTLAFAGRTAGGSEPEREVVVPIRLDPDINGRRYYWRGPEDSGDQGLIFQITAFQEDFYLHLTPDAQFLAPAFSTEHLGVPLQGLTGGSSDLRRCFYSGDVNAEPDSFAAVSLCGGLRGAFGYRGAEYVISPLPNASAPAAQRNSQGAHLLQRRGVPGGPSGDPTSRCGVASGWNPAILRALDPYKPRRAGFGESRSRRRSGRAKRFVSIPRYVETLVVADESMVKFHGADLEHYLLTLLATAARLYRHPSILNPINIVVVKVLLLRDRDSGPKVTGNAALTLRNFCAWQKKLNKVSDKHPEYWDTAILFTRQDLCGATTCDTLGMADVGTMCDPKRSCSVIEDDGLPSAFTTAHELGHVFNMPHDNVKVCEEVFGKLRANHMMSPTLIQIDRANPWSACSAAIITDFLDSGHGDCLLDQPSKPISLPEDLPGASYTLSQQCELAFGVGSKPCPYMQYCTKLWCTGKAKGQMVCQTRHFPWADGTSCGEGKLCLKGACVERHNLNKHRVDGSWAKWDPYGPCSRTCGGGVQLARRQCTNPTPANGGKYCEGVRVKYRSCNLEPCPSSASGKSFREEQCEAFNGYNHSTNRLTLAVAWVPKYSGVSPRDKCKLICRANGTGYFYVLAPKVVDGTLCSPDSTSVCVQGKCIKAGCDGNLGSKKRFDKCGVCGGDNKSCKKVTGLFTKPMHGYNFVVAIPAGASSIDIRQRGYKGLIGDDNYLALKNSQGKYLLNGHFVVSAVERDLVVKGSLLRYSGTGTAVESLQASRPILEPLTVEVLSVGKMTPPRVRYSFYLPKEPREDKSSHPKDPRGPSVLHNSVLSLSNQVEQPDDRPPARWVAGSWGPCSASCGSGLQKRAVDCRGSAGQRTVPACDAAHRPVETQACGEPCPTWELSAWSPCSKSCGRGFQRRSLKCVGHGGRLLARDQCNLHRKPQELDFCVLRPC

SEQ ID NO: 5388 - protein, 1224 aa, unidentified
MKPRARGWRGLAALWMLLAQVAEQAPACAMGPAAAAPGSPSVPRPPPPAERPGWMEKGEYDLVSAYEVDHRGDYVSHEIMHHQRRRRAVPVSEVESLHLRLKGSRHDFHMDLRTSSSLVAPGFIVQTLGKTGTKSVQTLPPEDFCFYQGSLRSHRNSSVALSTCQGLSGMIRTEEADYFLRPLPSHLSWKLGRAAQGSSPSHVLYKRSTEPHAPGASEVLVTSRTWELAHQPLHSSDLRLGLPQKQHFCGRRKKYMPQPPKEDLFILPDEYKSCLRHKRSLLRSHRNEELNVETLVVVDKKMMQNHGHENITTYVLTILNMVSALFKDGTIGGNINIAIVGLILLEDEQPGLVISHHADHTLSSFCQWQSGLMGKDGTRHDHAILLTGLDICSWKNEPCDTLGFAPISGMCSKYRSCTINEDTGLGLAFTIAHESGHNFGMIHDGEGNMCKKSEGNIMSPTLAGRNGVFSWSPCSRQYLHKFLSTAQAICLADQPKPVKEYKYPEKLPGELYDANTQCKWQFGEKAKLCMLDFKKDICKALWCHRIGRKCETKFMPAAEGTICGHDMWCRGGQCVKYGDEGPKPTHGHWSDWSSWSPCSRTCGGGVSHRSRLCTNPKPSHGGKFCEGSTRTLKLCNSQKCPRDSVDFRAAQCAEHNSRRFRGRHYKWKPYTQVEDQDLCKLYCIAEGFDFFFSLSNKVKDGTPCSEDSRNVCIDGICERVGCDNVLGSDAVEDVCGVCNGNNSACTIHRGLYTKHHHTNQYYHMVTIPSGARSIRIYEMNVSTSYISVRNALRRYYLNGHWTVDWPGRYKFSGTTFDYRRSYNEPENLIATGPTNETLIVELLFQGRNPGVAWEYSMPRLGTEKQPPAQPSYTWAIVRSECSVSCGGGQMTVREGCYRDLKFQVNMSFCNPKTRPVTGLVPCKVSACPPSWSVGNWSACSRTCGGGAQSRPVQCTRRVHYDSEPVPASLCPQPAPSSRQACNSQSCPPAWSAGPWAECSHTCGKGWRKRAVACKSTNPSARAQLLPDAVCTSEPKPRMHEACLLQRCHKPKKLQWLVSAWSQCSVTCERGTQKRFLKCAEKYVSGKYRELASKKCSHLPKPSLELERACAPLPCPRHPPFAAAGPSRGSWFASPWSQCTASCGGGVQTRSVQCLAGGRPASGCLLHQKPSASLACNTHFCPIAEKKDAFCKDYFHWCYLVPQHGMCSHKFYGKQCCKTCSKSNL

SEQ ID NO: 5389 - protein, 1095 aa, unidentified
MCDGALLPPLVLPVLLLLVWGLDPGTAVGDAAADVEVVLPWRVRPDDVHLPPLPAAPGPRRRRRPRTPPAAPRARPGERALLLHLPAFGRDLYLQLRRDLRFLSRGFEVEEAGAARRRGRPAELCFYSGRVLGHPGSLVSLSACGAAGGLVGLIQLGQEQVLIQPLNNSQGPFSGREHLIRRKWSLTPSPSAEAQRPEQLCKVLTEKKKPTWGRPSRDWRERRNAIRLTSEHTVETLVVADADMVQYHGAEAAQRFILTVMNMVYNMFQHQSLGIKINIQVTKLVLLRQRPAKLSIGHHGERSLESFCHWQNEEYGGARYLGNNQVPGGKDDPPLVDAAVFVTRTDFCVHKDEPCDTVGIAYLGGVCSAKRKCVLAEDNGLNLAFTIAHELGHNLGMNHDDDHSSCAGRSHIMSGEWVKGRNPSDLSWSSCSRDDLENFLKSKVSTCLLVTDPRSQHTVRLPHKLPGMHYSANEQCQILFGMNATFCRNMEHLMCAGLWCLVEGDTSCKTKLDPPLDGTECGADKWCRAGECVSKTPIPEHVDGDWSPWGAWSMCSRTCGTGARFRQRKCDNPPPGPGGTHCPGASVEHAVCENLPCPKGLPSFRDQQCQAHDRLSPKKKGLLTAVVVDDKPCELYCSPLGKESPLLVADRVLDGTPCGPYETDLCVHGKCQKIGCDGIIGSAAKEDRCGVCSGDGKTCHLVKGDFSHARGTALKDSGKGSINSDWKIELPGEFQIAGTTVRYVRRGLWEKISAKGPTKLPLHLMVLLFHDQDYGIHYEYTVPVNRTAENQSEPEKPQDSLFIWTHSGWEGCSVQCGGGERRTIVSCTRIVNKTTTLVNDSDCPQASRPEPQVRRCNLHPCQSRWVAGPWSPCSATCEKGFQHREVTCVYQLQNGTHVATRPLYCPGPRPAAVQSCEGQDCLSIWEASEWSQCSASCGKGVWKRTVACTNSQGKCDASTRPRAEEACEDYSGCYEWKTGDWSTCSSTCGKGLQSRVVQCMHKVTGRHGSECPALSKPAPYRQCYQEVCNDRINANTITSPRLAALTYKCTRDQWTVYCRVIREKNLCQDMRWYQRCCQTCRDFYANKMRQPPPNS

SEQ ID NO: 5390 - protein, 1221 aa, unidentified
MECALLLACAFPAAGSGPPRGLAGLGRVAKALQLCCLCCASVAAALASDSSSGASGLNDDYVFVTPVEVDSAGSYISHDILHNGRKKRSAQNARSSLHYRFSAFGQELHLELKPSAILSSHFIVQVLGKDGASETQKPEVQQCFYQGFIRNDSSSSVAVSTCAGLSGLIRTRKNEFLISPLPQLLAQEHNYSSPAGHHPHVLYKRTAEEKIQRYRGYPGSGRNYPGYSPSHIPHASQSRETEYHHRRLQKQHFCGRRKKYAPKPPTEDTYLRFDEYGSSGRPRRSAGKSQKGLNVETLVVADKKMVEKHGKGNVTTYILTVMNMVSGLFKDGTIGSDINVVVVSLILLEQEPGGLLINHHADQSLNSFCQWQSALIGKNGKRHDHAILLTGFDICSWKNEPCDTLGFAPISGMCSKYRSCTINEDTGLGLAFTIAHESGHNFGMIHDGEGNPCRKAEGNIMSPTLTGNNGVFSWSSCSRQYLKKFLSTPQAGCLVDEPKQAGQYKYPDKLPGQIYDADTQCKWQFGAKAKLCSLGFVKDICKSLWCHRVGHRCETKFMPAAEGTVCGLSMWCRQGQCVKFGELGPRPIHGQWSAWSKWSECSRTCGGGVKFQERHCNNPKPQYGGLFCPGSSRIYQLCNINPCNENSLDFRAQQCAEYNSKPFRGWFYQWKPYTKVEEEDRCKLYCKAENFEFFFAMSGKVKDGTPCSPNKNDVCIDGVCELVGCDHELGSKAVSDACGVCKGDNSTCKFYKGLYLNQHKANEYYPVVLIPAGARSIEIQELQVSSSYLAVRSLSQKYYLTGGWSIDWPGEFPFAGTTFEYQRSFNRPERLYAPGPTNETLVFEILMQGKNPGIAWKYALPKVMNGTPPATKRPAYTWSIVQSECSVSCGGGYINVKAICLRDQNTQVNSSFCSAKTKPVTEPKICNAFSCPAYWMPGEWSTCSKACAGGQQSRKIQCVQKKPFQKEEAVLHSLCPVSTPTQVQACNSHACPPQWSLGPWSQCSKTCGRGVRKRELLCKGSAAETLPESQCTSLPRPELQEGCVLGRCPKNSRLQWVASSWSECSATCGLGVRKREMKCSEKGFQGKLITFPERRCRNIKKPNLDLEETCNRRACPAHPVYNMVAGWYSLPWQQCTVTCGGGVQTRSVHCVQQGRPSSSCLLHQKPPVLRACNTNFCPAPEKREDPSCVDFFNWCHLVPQHGVCNHKFYGKQCCKSCTRKI

SEQ ID NO: 5391 - protein, 1207 aa, unidentified
MRLTHICCCCLLYQLGFLSNGIVSELQFAPDREEWEVVFPALWRREPVDPAGGSGGSADPGWVRGVGGGGSARAQAAGSSREVRSVAPVPLEEPVEGRSESRLRPPPPSEGEEDEELESQELPRGSSGAAALSPGAPASWQPPPPPQPPPSPPPAQHAEPDGDEVLLRIPAFSRDLYLLLRRDGRFLAPRFAVEQRPNPGPGPTGAASAPQPPAPPDAGCFYTGAVLRHPGSLASFSTCGGGLMGFIQLNEDFIFIEPLNDTMAITGHPHRVYRQKRSMEEKVTEKSALHSHYCGIISDKGRPRSRKIAESGRGKRYSYKLPQEYNIETVVVADPAMVSYHGADAARRFILTILNMVFNLFQHKSLSVQVNLRVIKLILLHETPPELYIGHHGEKMLESFCKWQHEEFGKKNDIHLEMSTNWGEDMTSVDAAILITRKDFCVHKDEPCDTVGIAYLSGMCSEKRKCIIAEDNGLNLAFTIAHEMGHNMGINHDNDHPSCADGLHIMSGEWIKGQNLGDVSWSRCSKEDLERFLRSKASNCLLQTNPQSVNSVMVPSKLPGMTYTADEQCQILFGPLASFCQEMQHVICTGLWCKVEGEKECRTKLDPPMDGTDCDLGKWCKAGECTSRTSAPEHLAGEWSLWSPCSRTCSAGISSRERKCPGLDSEARDCNGPRKQYRICENPPCPAGLPGFRDWQCQAYSVRTSSPKHILQWQAVLDEEKPCALFCSPVGKEQPILLSEKVMDGTSCGYQGLDICANGRCQKVGCDGLLGSLAREDHCGVCNGNGKSCKIIKGDFNHTRGAGYVEVLVIPAGARRIKVVEEKPAHSYLALRDAGKQSINSDWKIEHSGAFNLAGTTVHYVRRGLWEKISAKGPTTAPLHLLVLLFQDQNYGLHYEYTIPSDPLPENQSSKAPEPLFMWTHTSWEDCDATCGGGERKTTVSCTKIMSKNISIVDNEKCKYLTKPEPQIRKCNEQPCQTRWMMTEWTPCSRTCGKGMQSRQVACTQQLSNGTLIRARERDCIGPKPASAQRCEGQDCMTVWEAGVWSECSVKCGKGIRHRTVRCTNPRKKCVLSTRPREAEDCEDYSKCYVWRMGDWSKCSITCGKGMQSRVIQCMHKITGRHGNECFSSEKPAAYRPCHLQPCNEKINVNTITSPRLAALTFKCLGDQWPVYCRVIREKNLCQDMRWYQRCCETCRDFYAQKLQQKS

SEQ ID NO: 5392 - protein, 1211 aa, unidentified
MDPPAGAARRLLCPALLLLLLLLPPPLLPPPPPPANARLAAAADPPGGPLGHGAERILAVPVRTDAQGRLVSHVVSAATSRAGVRARRAAPVRTPSFPGGNEEEPGSHLFYNVTVFGRDLHLRLRPNARLVAPGATMEWQGEKGTTRVEPLLGSCLYVGDVAGLAEASSVALSNCDGLAGLIRMEEEEFFIEPLEKGLAAQEAEQGRVHVVYRRPPTSPPLGGPQALDTGASLDSLDSLSRALGVLEEHANSSRRRARRHAADDDYNIEVLLGVDDSVVQFHGKEHVQKYLLTLMNIVNEIYHDESLGAHINVVLVRIILLSYGKSMSLIEIGNPSQSLENVCRWAYLQQKPDTGHDEYHDHAIFLTRQDFGPSGMQGYAPVTGMCHPVRSCTLNHEDGFSSAFVVAHETGHVLGMEHDGQGNRCGDEVRLGSIMAPLVQAAFHRFHWSRCSQQELSRYLHSYDCLLDDPFAHDWPALPQLPGLHYSMNEQCRFDFGLGYMMCTAFRTFDPCKQLWCSHPDNPYFCKTKKGPPLDGTMCAPGKHCFKGHCIWLTPDILKRDGSWGAWSPFGSCSRTCGTGVKFRTRQCDNPHPANGGRTCSGLAYDFQLCSRQDCPDSLADFREEQCRQWDLYFEHGDAQHHWLPHEHRDAKERCHLYCESRETGEVVSMKRMVHDGTRCSYKDAFSLCVRGDCRKVGCDGVIGSSKQEDKCGVCGGDNSHCKVVKGTFTRSPKKHGYIKMFEIPAGARHLLIQEVDATSHHLAVKNLETGKFILNEENDVDASSKTFIAMGVEWEYRDEDGRETLQTMGPLHGTITVLVIPVGDTRVSLTYKYMIHEDSLNVDDNNVLEEDSVVYEWALKKWSPCSKPCGGGSQFTKYGCRRRLDHKMVHRGFCAALSKPKAIRRACNPQECSQPVWVTGEWEPCSQTCGRTGMQVRSVRCIQPLHDNTTRSVHAKHCNDARPESRRACSRELCPGRWRAGPWSQCSVTCGNGTQERPVLCRTADDSFGICQEERPETARTCRLGPCPRNISDPSKKSYVVQWLSRPDPDSPIRKISSKGHCQGDKSIFCRMEVLSRYCSIPGYNKLCCKSCNLYNNLTNVEGRIEPPPGKHNDIDVFMPTLPVPTVAMEVRPSPSTPLEVPLNASSTNATEDHPETNAVDEPYKIHGLEDEVQPPNLIPRRPSPYEKTRNQRIQELIDEMRKKEMLGKF

SEQ ID NO: 5393 - protein, 1910 aa, unidentified
MWVAKWLTGLLYHLSLFITRSWEVDFHPRQEALVRTLTSYEVVIPERVNEFGEVFPQSHHFSRQKRSSEALEPMPFRTHYRFTAYGQLFQLNLTADASFLAAGYTEVHLGTPERGAWESDAGPSDLRHCFYRGQVNSQEDYKAVVSLCGGLTGTFKGQNGEYFLEPIMKADGNEYEDGHNKPHLIYRQDLNNSFLQTLKYCSVSESQIKETSLPFHTYSNMNEDLNVMKERVLGHTSKNVPLKDERRHSRKKRLISYPRYIEIMVTADAKVVSAHGSNLQNYILTLMSIVATIYKDPSIGNLIHIVVVKLVMIHREEEGPVINFDGATTLKNFCSWQQTQNDLDDVHPSHHDTAVLITREDICSSKEKCNMLGLSYLGTICDPLQSCFINEEKGLISAFTIAHELGHTLGVQHDDNPRCKEMKVTKYHVMAPALSFHMSPWSWSNCSRKYVTEFLDTGYGECLLDKPDEEIYNLPSELPGSRYDGNKQCELAFGPGSQMCPHINICMHLWCTSTEKLHKGCFTQHVPPADGTDCGPGMHCRHGLCVNKETETRPVNGEWGPWEPYSSCSRTCGGGIESATRRCNRPEPRNGGNYCVGRRMKFRSCNTDSCPKGTQDFREKQCSDFNGKHLDISGIPSNVRWLPRYSGIGTKDRCKLYCQVAGTNYFYLLKDMVEDGTPCGTETHDICVQGQCMAAGCDHVLNSSAKIDKCGVCGGDNSSCKTITGVFNSSHYGYNVVVKIPAGATNVDIRQYSYSGQPDDSYLALSDAEGNFLFNGNFLLSTSKKEINVQGTRTVIEYSGSNNAVERINSTNRQEKEILIEVLCVGNLYNPDVHYSFNIPLEERSDMFTWDPYGPWEGCTKMCQGLQRRNITCIHKSDHSVVSDKECDHLPLPSFVTQSCNTDCELRWHVIGKSECSSQCGQGYRTLDIHCMKYSIHEGQTVQVDDHYCGDQLKPPTQELCHGNCVFTRWHYSEWSQCSRSCGGGERSRESYCMNNFGHRLADNECQELSRVTRENCNEFSCPSWAASEWSECLVTCGKGTKQRQVWCQLNVDHLSDGFCNSSTKPESLSPCELHTCASWQVGPWGPCTTTCGHGYQMRDVKCVNELASAVLEDTECHEASRPSDRQSCVLTPCSFISKLETALLPTVLIKKMAQWRHGSWTPCSVSCGRGTQARYVSCRDALDRIADESYCAHLPRPAEIWDCFTPCGEWQAGDWSPCSASCGHGKTTRQVLCMNYHQPIDENYCDPEVRPLMEQECSLAACPPAHSHFPSSPVQPSYYLSTNLPLTQKLEDNENQVVHPSVRGNQWRTGPWGSCSSSCSGGLQHRAVVCQDENGQSASYCDAASKPPELQQCGPGPCPQWNYGNWGECSQTCGGGIKSRLVICQFPNGQILEDHNCEIVNKPPSVIQCHMHACPADVSWHQEPWTSCSASCGKGRKYREVFCIDQFQRKLEDTNCSQVQKPPTHKACRSVRCPSWKANSWNECSVTCGSGVQQRDVYCRLKGVGQVVEEMCDQSTRPCSQRRCWSQDCVQHKGMERGRLNCSTSCERKDSHQRMECTDNQIRQVNEIVYNSSTISLTSKNCRNPPCNYIVVTADSSQCANNCGFSYRQRITYCTEIPSTKKHKLHRLRPIVYQECPVVPSSQVYQCINSCLHLATWKVGKWSKCSVTCGIGIMKRQVKCITKHGLSSDLCLNHLKPGAQKKCYANDCKSFTTCKEIQVKNHIRKDGDYYLNIKGRIIKIYCADMYLENPKEYLTLVQGEENFSEVYGFRLKNPYQCPFNGSRREDCECDNGHLAAGYTVFSKIRIDLTSMQIKTTDLLFSKTIFGNAVPFATAGDCYSAFRCPQGQFSINLSGTGMKISSTAKWLTQGSYTSVSIRRSEDGTRFFGKCGGYCGKCLPHMTTGLPIQVI

SEQ ID NO: 5394 - protein, 1205 aa, unidentified
MVLLSLWLIAAALVEVRTSADGQAGNEEMVQIDLPIKRYREYELVTPVSTNLEGRYLSHTLSASHKKRSARDVSSNPEQLFFNITAFGKDFHLRLKPNTQLVAPGAVVEWHETSLVPGNITDPINNHQPGSATYRIRRTEPLQTNCAYVGDIVDIPGTSVAISNCDGLAGMIKSDNEEYFIEPLERGKQMEEEKGRIHVVYKRSAVEQAPIDMSKDFHYRESDLEGLDDLGTVYGNIHQQLNETMRRRRHAGENDYNIEVLLGVDDSVVRFHGKEHVQNYLLTLMNIVNEIYHDESLGVHINVVLVRMIMLGYAKSISLIERGNPSRSLENVCRWASQQQRSDLNHSEHHDHAIFLTRQDFGPAGMQGYAPVTGMCHPVRSCTLNHEDGFSSAFVVAHETGHVLGMEHDGQGNRCGDETAMGSVMAPLVQAAFHRYHWSRCSGQELKRYIHSYDCLLDDPFDHDWPKLPELPGINYSMDEQCRFDFGVGYKMCTAFRTFDPCKQLWCSHPDNPYFCKTKKGPPLDGTECAAGKWCYKGHCMWKNANQQKQDGNWGSWTKFGSCSRTCGTGVRFRTRQCNNPMPINGGQDCPGVNFEYQLCNTEECQKHFEDFRAQQCQQRNSHFEYQNTKHHWLPYEHPDPKKRCHLYCQSKETGDVAYMKQLVHDGTHCSYKDPYSICVRGECVKVGCDKEIGSNKVEDKCGVCGGDNSHCRTVKGTFTRTPRKLGYLKMFDIPPGARHVLIQEDEASPHILAIKNQATGHYILNGKGEEAKSRTFIDLGVEWDYNIEDDIESLHTDGPLHDPVIVLIIPQENDTRSSLTYKYIIHEDSVPTINSNNVIQEELDTFEWALKSWSQCSKPCGGGFQYTKYGCRRKSDNKMVHRSFCEANKKPKPIRRMCNIQECTHPLWVAEEWEHCTKTCGSSGYQLRTVRCLQPLLDGTNRSVHSKYCMGDRPESRRPCNRVPCPAQWKTGPWSECSVTCGEGTEVRQVLCRAGDHCDGEKPESVRACQLPPCNDEPCLGDKSIFCQMEVLARYCSIPGYNKLCCESCSKRSSTLPPPYLLEAAETHDDVISNPSDLPRSLVMPTSLVPYHSETPAKKMSLSSISSVGGPNAYAAFRPNSKPDGANLRQRSAQQAGSKTVRLVTVPSSPPTKRVHLSSASQMAAASFFAASDSIGASSQARTSKKDGKIIDNRRPTRSSTLER

SEQ ID NO: 5395 - protein, 930 aa, unidentified
MLLGWASLLLCAFRLPLAAVGPAATPAQDKAGQPPTAAAAAQPRRRQGEEVQERAEPPGHPHPLAQRRRSKGLVQNIDQLYSGGGKVGYLVYAGGRRFLLDLERDGSVGIAGFVPAGGGTSAPWRHRSHCFYRGTVDGSPRSLAVFDLCGGLDGFFAVKHARYTLKPLLRGPWAEEEKGRVYGDGSARILHVYTREGFSFEALPPRASCETPASTPEAHEHAPAHSNPSGRAALASQLLDQSALSPAGGSGPQTWWRRRRRSISRARQVELLLVADASMARLYGRGLQHYLLTLASIANRLYSHASIENHIRLAVVKVVVLGDKDKSLEVSKNAATTLKNFCKWQHQHNQLGDDHEEHYDAAILFTREDLCGHHSCDTLGMADVGTICSPERSCAVIEDDGLHAAFTVAHEIGHLLGLSHDDSKFCEETFGSTEDKRLMSSILTSIDASKPWSKCTSATITEFLDDGHGNCLLDLPRKQILGPEELPGQTYDATQQCNLTFGPEYSVCPGMDVCARLWCAVVRQGQMVCLTKKLPAVEGTPCGKGRICLQGKCVDKTKKKYYSTSSHGNWGSWGSWGQCSRSCGGGVQFAYRHCNNPAPRNNGRYCTGKRAIYRSCSLMPCPPNGKSFRHEQCEAKNGYQSDAKGVKTFVEWVPKYAGVLPADVCKLTCRAKGTGYYVVFSPKVTDGTECRLYSNSVCVRGKCVRTGCDGIIGSKLQYDKCGVCGGDNSSCTKIVGTFNKKSKGYTDVVRIPEGATHIKVRQFKAKDQTRFTAYLALKKKNGEYLINGKYMISTSETIIDINGTVMNYSGWSHRDDFLHGMGYSATKEILIVQILATDPTKPLDVRYSFFVPKKSTPKVNSVTSHGSNKVGSHTSQPQWVTGPWLACSRTCDTGWHTRTVQCQDGNRKLAKGCPLSQRPSAFKQCLLKKC

SEQ ID NO: 5396 - protein, 1117 aa, unidentified
MEILWKTLTWILSLIMASSEFHSDHRLSYSSQEEFLTYLEHYQLTIPIRVDQNGAFLSFTVKNDKHSRRRRSMDPIDPQQAVSKLFFKLSAYGKHFHLNLTLNTDFVSKHFTVEYWGKDGPQWKHDFLDNCHYTGYLQDQRSTTKVALSNCVGLHGVIATEDEEYFIEPLKNTTEDSKHFSYENGHPHVIYKKSALQQRHLYDHSHCGVSDFTRSGKPWWLNDTSTVSYSLPINNTHIHHRQKRSVSIERFVETLVVADKMMVGYHGRKDIEHYILSVMNIVAKLYRDSSLGNVVNIIVARLIVLTEDQPNLEINHHADKSLDSFCKWQKSILSHQSDGNTIPENGIAHHDNAVLITRYDICTYKNKPCGTLGLASVAGMCEPERSCSINEDIGLGSAFTIAHEIGHNFGMNHDGIGNSCGTKGHEAAKLMAAHITANTNPFSWSACSRDYITSFLDSGRGTCLDNEPPKRDFLYPAVAPGQVYDADEQCRFQYGATSRQCKYGEVCRELWCLSKSNRCVTNSIPAAEGTLCQTGNIEKGWCYQGDCVPFGTWPQSIDGGWGPWSLWGECSRTCGGGVSSSLRHCDSPAPSGGGKYCLGERKRYRSCNTDPCPLGSRDFREKQCADFDNMPFRGKYYNWKPYTGGGVKPCALNCLAEGYNFYTERAPAVIDGTQCNADSLDICINGECKHVGCDNILGSDAREDRCRVCGGDGSTCDAIEGFFNDSLPRGGYMEVVQIPRGSVHIEVREVAMSKNYIALKSEGDDYYINGAWTIDWPRKFDVAGTAFHYKRPTDEPESLEALGPTSENLIVMVLLQEQNLGIRYKFNVPITRTGSGDNEVGFTWNHQPWSECSATCAGGVQRQEVVCKRLDDNSIVQNNYCDPDSKPPENQRACNTEPCPPEWFIGDWLECSKTCDGGMRTRAVLCIRKIGPSEEETLDYSGCLTHRPVEKEPCNNQSCPPQWVALDWSECTPKCGPGFKHRIVLCKSSDLSKTFPAAQCPEESKPPVRIRCSLGRCPPPRWVTGDWGQCSAQCGLGQQMRTVQCLSYTGQASSDCLETVRPPSMQQCESKCDSTPISNTEECKDVNKVAYCPLVLKFKFCSRAYFRQMCCKTCQGH

SEQ ID NO: 5397 - protein, 1686 aa, unidentified
MPGGPSPRSPAPLLRPLLLLLCALAPGAPGPAPGRATEGRAALDIVHPVRVDAGGSFLSYELWPRALRKRDVSVRRDAPAFYELQYRGRELRFNLTANQHLLAPGFVSETRRRGGLGRAHIRAHTPACHLLGEVQDPELEGGLAAISACDGLKGVFQLSNEDYFIEPLDSAPARPGHAQPHVVYKRQAPERLAQRGDSSAPSTCGVQVYPELESRRERWEQRQQWRRPRLRRLHQRSVSKEKWVETLVVADAKMVEYHGQPQVESYVLTIMNMVAGLFHDPSIGNPIHITIVRLVLLEDEEEDLKITHHADNTLKSFCKWQKSINMKGDAHPLHHDTAILLTRKDLCAAMNRPCETLGLSHVAGMCQPHRSCSINEDTGLPLAFTVAHELGHSFGIQHDGSGNDCEPVGKRPFIMSPQLLYDAAPLTWSRCSRQYITRFLDRGWGLCLDDPPAKDIIDFPSVPPGVLYDVSHQCRLQYGAYSAFCEDMDNVCHTLWCSVGTTCHSKLDAAVDGTRCGENKWCLSGECVPVGFRPEAVDGGWSGWSAWSICSRSCGMGVQSAERQCTQPTPKYKGRYCVGERKRFRLCNLQACPAGRPSFRHVQCSHFDAMLYKGQLHTWVPVVNDVNPCELHCRPANEYFAEKLRDAVVDGTPCYQVRASRDLCINGICKNVGCDFEIDSGAMEDRCGVCHGNGSTCHTVSGTFEEAEGLGYVDVGLIPAGAREIRIQEVAEAANFLALRSEDPEKYFLNGGWTIQWNGDYQVAGTTFTYARRGNWENLTSPGPTKEPVWIQLLFQESNPGVHYEYTIHREAGGHDEVPPPVFSWHYGPWTKCTVTCGRGVQRQNVYCLERQAGPVDEEHCDPLGRPDDQQRKCSEQPCPARWWAGEWQLCSSSCGPGGLSRRAVLCIRSVGLDEQSALEPPACEHLPRPPTETPCNRHVPCPATWAVGNWSQCSVTCGEGTQRRNVLCTNDTGVPCDEAQQPASEVTCSLPLCRWPLGTLGPEGSGSGSSSHELFNEADFIPHHLAPRPSPASSPKPGTMGNAIEEEAPELDLPGPVFVDDFYYDYNFINFHEDLSYGPSEEPDLDLAGTGDRTPPPHSHPAAPSTGSPVPATEPPAAKEEGVLGPWSPSPWPSQAGRSPPPPSEQTPGNPLINFLPEEDTPIGAPDLGLPSLSWPRVSTDGLQTPATPESQNDFPVGKDSQSQLPPPWRDRTNEVFKDDEEPKGRGAPHLPPRPSSTLPPLSPVGSTHSSPSPDVAELWTGGTVAWEPALEGGLGPVDSELWPTVGVASLLPPPIAPLPEMKVRDSSLEPGTPSFPTPGPGSWDLQTVAVWGTFLPTTLTGLGHMPEPALNPGPKGQPESLSPEVPLSSRLLSTPAWDSPANSHRVPETQPLAPSLAEAGPPADPLVVRNAGWQAGNWSECSTTCGLGAVWRPVRCSSGRDEDCAPAGRPQPARRCHLRPCATWHSGNWSKCSRSCGGGSSVRDVQCVDTRDLRPLRPFHCQPGPAKPPAHRPCGAQPCLSWYTSSWRECSEACGGGEQQRLVTCPEPGLCEEALRPNTTRPCNTHPCTQWVVGPWGQCSGPCGGGVQRRLVKCVNTQTGLPEEDSDQCGHEAWPESSRPCGTEDCEPVEPPRCERDRLSFGFCETLRLLGRCQLPTIRTQCCRSCSPPSHGAPSRGHQRVARR

SEQ ID NO: 5398 - protein, 889 aa, unidentified
MLPAPAAPRWPPLLLLLLLLLPLARGAPARPAAGGQASELVVPTRLPGSAGELALHLSAFGKGFVLRLAPDDSFLAPEFKIERLGGSGRATGGERGLRGCFFSGTVNGEPESLAAVSLCRGLSGSFLLDGEEFTIQPQGAGGSLAQPHRLQRWGPAGARPLPRGPEWEVETGEGQRQERGDHQEDSEEESQEEEAEGASEPPPPLGATSRTKRFVSEARFVETLLVADASMAAFYGADLQNHILTLMSVAARIYKHPSIKNSINLMVVKVLIVEDEKWGPEVSDNGGLTLRNFCNWQRRFNQPSDRHPEHYDTAILLTRQNFCGQEGLCDTLGVADIGTICDPNKSCSVIEDEGLQAAHTLAHELGHVLSMPHDDSKPCTRLFGPMGKHHVMAPLFVHLNQTLPWSPCSAMYLTELLDGGHGDCLLDAPAAALPLPTGLPGRMALYQLDQQCRQIFGPDFRHCPNTSAQDVCAQLWCHTDGAEPLCHTKNGSLPWADGTPCGPGHLCSEGSCLPEEEVERPKPVADGGWAPWGPWGECSRTCGGGVQFSHRECKDPEPQNGGRYCLGRRAKYQSCHTEECPPDGKSFREQQCEKYNAYNYTDMDGNLLQWVPKYAGVSPRDRCKLFCRARGRSEFKVFEAKVIDGTLCGPETLAICVRGQCVKAGCDHVVDSPRKLDKCGVCGGKGNSCRKVSGSLTPTNYGYNDIVTIPAGATNIDVKQRSHPGVQNDGNYLALKTADGQYLLNGNLAISAIEQDILVKGTILKYSGSIATLERLQSFRPLPEPLTVQLLTVPGEVFPPKVKYTFFVPNDVDFSMQSSKERATTNIIQPLLHAQWVLGDWSECSSTCGAGWQRRTVECRDPSGQASATCNKALKPEDAKPCESQLCPL

SEQ ID NO: 5399 - protein, 1935 aa, unidentified
MQFVSWATLLTLLVRDLAEMGSPDAAAAVRKDRLHPRQVKLLETLSEYEIVSPIRVNALGEPFPTNVHFKRTRRSINSATDPWPAFASSSSSSTSSQAHYRLSAFGQQFLFNLTANAGFIAPLFTVTLLGTPGVNQTKFYSEEEAELKHCFYKGYVNTNSEHTAVISLCSGMLGTFRSHDGDYFIEPLQSMDEQEDEEEQNKPHIIYRRSAPQREPSTGRHACDTSEHKNRHSKDKKKTRARKWGERINLAGDVAALNSGLATEAFSAYGNKTDNTREKRTHRRTKRFLSYPRFVEVLVVADNRMVSYHGENLQHYILTLMSIVASIYKDPSIGNLINIVIVNLIVIHNEQDGPSISFNAQTTLKNFCQWQHSKNSPGGIHHDTAVLLTRQDICRAHDKCDTLGLAELGTICDPYRSCSISEDSGLSTAFTIAHELGHVFNMPHDDNNKCKEEGVKSPQHVMAPTLNFYTNPWMWSKCSRKYITEFLDTGYGECLLNEPESRPYPLPVQLPGILYNVNKQCELIFGPGSQVCPYMMQCRRLWCNNVNGVHKGCRTQHTPWADGTECEPGKHCKYGFCVPKEMDVPVTDGSWGSWSPFGTCSRTCGGGIKTAIRECNRPEPKNGGKYCVGRRMKFKSCNTEPCLKQKRDFRDEQCAHFDGKHFNINGLLPNVRWVPKYSGILMKDRCKLFCRVAGNTAYYQLRDRVIDGTPCGQDTNDICVQGLCRQAGCDHVLNSKARRDKCGVCGGDNSSCKTVAGTFNTVHYGYNTVVRIPAGATNIDVRQHSFSGETDDDNYLALSSSKGEFLLNGNFVVTMAKREIRIGNAVVEYSGSETAVERINSTDRIEQELLLQVLSVGKLYNPDVRYSFNIPIEDKPQQFYWNSHGPWQACSKPCQGERKRKLVCTRESDQLTVSDQRCDRLPQPGHITEPCGTDCDLRWHVASRSECSAQCGLGYRTLDIYCAKYSRLDGKTEKVDDGFCSSHPKPSNREKCSGECNTGGWRYSAWTECSKSCDGGTQRRRAICVNTRNDVLDDSKCTHQEKVTIQRCSEFPCPQWKSGDWSECLVTCGKGHKHRQVWCQFGEDRLNDRMCDPETKPTSMQTCQQPECASWQAGPWGQCSVTCGQGYQLRAVKCIIGTYMSVVDDNDCNAATRPTDTQDCELPSCHPPPAAPETRRSTYSAPRTQWRFGSWTPCSATCGKGTRMRYVSCRDENGSVADESACATLPRPVAKEECSVTPCGQWKALDWSSCSVTCGQGRATRQVMCVNYSDHVIDRSECDQDYIPETDQDCSMSPCPQRTPDSGLAQHPFQNEDYRPRSASPSRTHVLGGNQWRTGPWGACSSTCAGGSQRRVVVCQDENGYTANDCVERIKPDEQRACESGPCPQWAYGNWGECTKLCGGGIRTRLVVCQRSNGERFPDLSCEILDKPPDREQCNTHACPHDAAWSTGPWSSCSVSCGRGHKQRNVYCMAKDGSHLESDYCKHLAKPHGHRKCRGGRCPKWKAGAWSQCSVSCGRGVQQRHVGCQIGTHKIARETECNPYTRPESERDCQGPRCPLYTWRAEEWQECTKTCGEGSRYRKVVCVDDNKNEVHGARCDVSKRPVDRESCSLQPCEYVWITGEWSECSVTCGKGYKQRLVSCSEIYTGKENYEYSYQTTINCPGTQPPSVHPCYLRDCPVSATWRVGNWGSCSVSCGVGVMQRSVQCLTNEDQPSHLCHTDLKPEERKTCRNVYNCELPQNCKEVKRLKGASEDGEYFLMIRGKLLKIFCAGMHSDHPKEYVTLVHGDSENFSEVYGHRLHNPTECPYNGSRRDDCQCRKDYTAAGFSSFQKIRIDLTSMQIITTDLQFARTSEGHPVPFATAGDCYSAAKCPQGRFSINLYGTGLSLTESARWISQGNYAVSDIKKSPDGTRVVGKCGGYCGKCTPSSGTGLEVRVL

SEQ ID NO: 5400 - protein, 1762 aa, unidentified
MECCRRATPGTLLLFLAFLLLSSRTARSEEDRDGLWDAWGPWSECSRTCGGGASYSLRRCLSSKSCEGRNIRYRTCSNVDCPPEAGDFRAQQCSAHNDVKHHGQFYEWLPVSNDPDNPCSLKCQAKGTTLVVELAPKVLDGTRCYTESLDMCISGLCQIVGCDHQLGSTVKEDNCGVCNGDGSTCRLVRGQYKSQLSATKSDDTVVAIPYGSRHIRLVLKGPDHLYLETKTLQGTKGENSLSSTGTFLVDNSSVDFQKFPDKEILRMAGPLTADFIVKIRNSGSADSTVQFIFYQPIIHRWRETDFFPCSATCGGGYQLTSAECYDLRSNRVVADQYCHYYPENIKPKPKLQECNLDPCPASDGYKQIMPYDLYHPLPRWEATPWTACSSSCGGGIQSRAVSCVEEDIQGHVTSVEEWKCMYTPKMPIAQPCNIFDCPKWLAQEWSPCTVTCGQGLRYRVVLCIDHRGMHTGGCSPKTKPHIKEECIVPTPCYKPKEKLPVEAKLPWFKQAQELEEGAAVSEEPSFIPEAWSACTVTCGVGTQVRIVRCQVLLSFSQSVADLPIDECEGPKPASQRACYAGPCSGEIPEFNPDETDGLFGGLQDFDELYDWEYEGFTKCSESCGGGVQEAVVSCLNKQTREPAEENLCVTSRRPPQLLKSCNLDPCPARWEIGKWSPCSLTCGVGLQTRDVFCSHLLSREMNETVILADELCRQPKPSTVQACNRFNCPPAWYPAQWQPCSRTCGGGVQKREVLCKQRMADGSFLELPETFCSASKPACQQACKKDDCPSEWLLSDWTECSTSCGEGTQTRSAICRKMLKTGLSTVVNSTLCPPLPFSSSIRPCMLATCARPGRPSTKHSPHIAAARKVYIQTRRQRKLHFVVGGFAYLLPKTAVVLRCPARRVRKPLITWEKDGQHLISSTHVTVAPFGYLKIHRLKPSDAGVYTCSAGPAREHFVIKLIGGNRKLVARPLSPRSEEEVLAGRKGGPKEALQTHKHQNGIFSNGSKAEKRGLAANPGSRYDDLVSRLLEQGGWPGELLASWEAQDSAERNTTSEEDPGAEQVLLHLPFTMVTEQRRLDDILGNLSQQPEELRDLYSKHLVAQLAQEIFRSHLEHQDTLLKPSERRTSPVTLSPHKHVSGFSSSLRTSSTGDAGGGSRRPHRKPTILRKISAAQQLSASEVVTHLGQTVALASGTLSVLLHCEAIGHPRPTISWARNGEEVQFSDRILLQPDDSLQILAPVEADVGFYTCNATNALGYDSVSIAVTLAGKPLVKTSRMTVINTEKPAVTVDIGSTIKTVQGVNVTINCQVAGVPEAEVTWFRNKSKLGSPHHLHEGSLLLTNVSSSDQGLYSCRAANLHGELTESTQLLILDPPQVPTQLEDIRALLAATGPNLPSVLTSPLGTQLVLDPGNSALLGCPIKGHPVPNITWFHGGQPIVTATGLTHHILAAGQILQVANLSGGSQGEFSCLAQNEAGVLMQKASLVIQDYWWSVDRLATCSASCGNRGVQQPRLRCLLNSTEVNPAHCAGKVRPAVQPIACNRRDCPSRWMVTSWSACTRSCGGGVQTRRVTCQKLKASGISTPVSNDMCTQVAKRPVDTQACNQQLCVEWAFSSWGQCNGPCIGPHLAVQHRQVFCQTRDGITLPSEQCSALPRPVSTQNCWSEACSVHWRVSLWTLCTATCGNYGFQSRRVECVHARTNKAVPEHLCSWGPRPANWQRCNITPCENMECRDTTRYCEKVKQLKLCQLSQFKSRCCGTCGKA

SEQ ID NO: 5401 - protein, 951 aa, unidentified
MDGRWQCSCWAWFLLVLAVVAGDTVSTGSTDNSPTSNSLEGGTDATAFWWGEWTKWTACSRSCGGGVTSQERHCLQQRRKSVPGPGNRTCTGTSKRYQLCRVQECPPDGRSFREEQCVSFNSHVYNGRTHQWKPLYPDDYVHISSKPCDLHCTTVDGQRQLMVPARDGTSCKLTDLRGVCVSGKCEPIGCDGVLFSTHTLDKCGICQGDGSSCTHVTGNYRKGNAHLGYSLVTHIPAGARDIQIVERKKSADVLALADEAGYYFFNGNYKVDSPKNFNIAGTVVKYRRPMDVYETGIEYIVAQGPTNQGLNVMVWNQNGKSPSITFEYTLLQPPHESRPQPIYYGFSESAESQGLDGAGLMGFVPHNGSLYGQASSERLGLDNRLFGHPGLDMELGPSQGQETNEVCEQAGGGACEGPPRGKGFRDRNVTGTPLTGDKDDEEVDTHFASQEFFSANAISDQLLGAGSDLKDFTLNETVNSIFAQGAPRSSLAESFFVDYEENEGAGPYLLNGSYLELSSDRVANSSSEAPFPNVSTSLLTSAGNRTHKARTRPKARKQGVSPADMYRWKLSSHEPCSATCTTGVMSAYAMCVRYDGVEVDDSYCDALTRPEPVHEFCAGRECQPRWETSSWSECSRTCGEGYQFRVVRCWKMLSPGFDSSVYSDLCEAAEAVRPEERKTCRNPACGPQWEMSEWSECTAKCGERSVVTRDIRCSEDEKLCDPNTRPVGEKNCTGPPCDRQWTVSDWGPCSGSCGQGRTIRHVYCKTSDGRVVPESQCQMETKPLAIHPCGDKNCPAHWLAQDWERCNTTCGRGVKKRLVLCMELANGKPQTRSGPECGLAKKPPEESTCFERPCFKWYTSPWSECTKTCGVGVRMRDVKCYQGTDIVRGCDPLVKPVGRQACDLQPCPTEPPDDSCQDQPGTNCALAIKVNLCGHWYYSKACCRSCRPPHS

SEQ ID NO: 5402 - protein, 1691 aa, unidentified
MASWTSPWWVLIGMVFMHSPLPQTTAEKSPGAYFLPEFALSPQGSFLEDTTGEQFLTYRYDDQTSRNTRSDEDKDGNWDAWGDWSDCSRTCGGGASYSLRRCLTGRNCEGQNIRYKTCSNHDCPPDAEDFRAQQCSAYNDVQYQGHYYEWLPRYNDPAAPCALKCHAQGQNLVVELAPKVLDGTRCNTDSLDMCISGICQAVGCDRQLGSNAKEDNCGVCAGDGSTCRLVRGQSKSHVSPEKREENVIAVPLGSRSVRITVKGPAHLFIESKTLQGSKGEHSFNSPGVFLVENTTVEFQRGSERQTFKIPGPLMADFIFKTRYTAAKDSVVQFFFYQPISHQWRQTDFFPCTVTCGGGYQLNSAECVDIRLKRVVPDHYCHYYPENVKPKPKLKECSMDPCPSSDGFKEIMPYDHFQPLPRWEHNPWTACSVSCGGGIQRRSFVCVEESMHGEILQVEEWKCMYAPKPKVMQTCNLFDCPKWIAMEWSQCTVTCGRGLRYRVVLCINHRGEHVGGCNPQLKLHIKEECVIPIPCYKPKEKSPVEAKLPWLKQAQELEETRIATEEPTFIPEPWSACSTTCGPGVQVREVKCRVLLTFTQTETELPEEECEGPKLPTERPCLLEACDESPASRELDIPLPEDSETTYDWEYAGFTPCTATCVGGHQEAIAVCLHIQTQQTVNDSLCDMVHRPPAMSQACNTEPCPPRWHVGSWGPCSATCGVGIQTRDVYCLHPGETPAPPEECRDEKPHALQACNQFDCPPGWHIEEWQQCSRTCGGGTQNRRVTCRQLLTDGSFLNLSDELCQGPKASSHKSCARTDCPPHLAVGDWSKCSVSCGVGIQRRKQVCQRLAAKGRRIPLSEMMCRDLPGLPLVRSCQMPECSKIKSEMKTKLGEQGPQILSVQRVYIQTREEKRINLTIGSRAYLLPNTSVIIKCPVRRFQKSLIQWEKDGRCLQNSKRLGITKSGSLKIHGLAAPDIGVYRCIAGSAQETVVLKLIGTDNRLIARPALREPMREYPGMDHSEANSLGVTWHKMRQMWNNKNDLYLDDDHISNQPFLRALLGHCSNSAGSTNSWELKNKQFEAAVKQGAYSMDTAQFDELIRNMSQLMETGEVSDDLASQLIYQLVAELAKAQPTHMQWRGIQEETPPAAQLRGETGSVSQSSHAKNSGKLTFKPKGPVLMRQSQPPSISFNKTINSRIGNTVYITKRTEVINILCDLITPSEATYTWTKDGTLLQPSVKIILDGTGKIQIQNPTRKEQGIYECSVANHLGSDVESSSVLYAEAPVILSVERNITKPEHNHLSVVVGGIVEAALGANVTIRCPVKGVPQPNITWLKRGGSLSGNVSLLFNGSLLLQNVSLENEGTYVCIATNALGKAVATSVLHLLERRWPESRIVFLQGHKKYILQATNTRTNSNDPTGEPPPQEPFWEPGNWSHCSATCGHLGARIQRPQCVMANGQEVSEALCDHLQKPLAGFEPCNIRDCPARWFTSVWSQCSVSCGEGYHSRQVTCKRTKANGTVQVVSPRACAPKDRPLGRKPCFGHPCVQWEPGNRCPGRCMGRAVRMQQRHTACQHNSSDSNCDDRKRPTLRRNCTSGACDVCWHTGPWKPCTAACGRGFQSRKVDCIHTRSCKPVAKRHCVQKKKPISWRHCLGPSCDRDCTDTTHYCMFVKHLNLCSLDRYKQRCCQSCQEG

SEQ ID NO: 5403 - protein, 1074 aa, unidentified
MENWTGRPWLYLLLLLSLPQLCLDQEVLSGHSLQTPTEEGQGPEGVWGPWVQWASCSQPCGVGVQRRSRTCQLPTVQLHPSLPLPPRPPRHPEALLPRGQGPRPQTSPETLPLYRTQSRGRGGPLRGPASHLGREETQEIRAARRSRLRDPIKPGMFGYGRVPFALPLHRNRRHPRSPPRSELSLISSRGEEAIPSPTPRAEPFSANGSPQTELPPTELSVHTPSPQAEPLSPETAQTEVAPRTRPAPLRHHPRAQASGTEPPSPTHSLGEGGFFRASPQPRRPSSQGWASPQVAGRRPDPFPSVPRGRGQQGQGPWGTGGTPHGPRLEPDPQHPGAWLPLLSNGPHASSLWSLFAPSSPIPRCSGESEQLRACSQAPCPPEQPDPRALQCAAFNSQEFMGQLYQWEPFTEVQGSQRCELNCRPRGFRFYVRHTEKVQDGTLCQPGAPDICVAGRCLSPGCDGILGSGRRPDGCGVCGGDDSTCRLVSGNLTDRGGPLGYQKILWIPAGALRLQIAQLRPSSNYLALRGPGGRSIINGNWAVDPPGSYRAGGTVFRYNRPPREEGKGESLSAEGPTTQPVDVYMIFQEENPGVFYQYVISSPPPILENPTPEPPVPQLQPEILRVEPPLAPAPRPARTPGTLQRQVRIPQMPAPPHPRTPLGSPAAYWKRVGHSACSASCGKGVWRPIFLCISRESGEELDERSCAAGARPPASPEPCHGTPCPPYWEAGEWTSCSRSCGPGTQHRQLQCRQEFGGGGSSVPPERCGHLPRPNITQSCQLRLCGHWEVGSPWSQCSVRCGRGQRSRQVRCVGNNGDEVSEQECASGPPQPPSREACDMGPCTTAWFHSDWSSKCSAECGTGIQRRSVVCLGSGAALGPGQGEAGAGTGQSCPTGSRPPDMRACSLGPCERTWRWYTGPWGECSSECGSGTQRRDIICVSKLGTEFNVTSPSNCSHLPRPPALQPCQGQACQDRWFSTPWSPCSRSCQGGTQTREVQCLSTNQTLSTRCPPQLRPSRKRPCNSQPCSQRPDDQCKDSSPHCPLVVQARLCVYPYYTATCCRSCAHVLERSPQDPS

SEQ ID NO: 5404 - protein, 481 aa, unidentified
MGKLRPGRVEWLASGHTERPHLFQNLLLFLWALLNCGLGVSAQGPGEWTPWVSWTRCSSSCGRGVSVRSRRCLRLPGEEPCWGDSHEYRLCQLPDCPPGAVPFRDLQCALYNGRPVLGTQKTYQWVPFHGAPNQCDLNCLAEGHAFYHSFGRVLDGTACSPGAQGVCVAGRCLSAGCDGLLGSGALEDRCGRCGGANDSCLFVQRVFRDAGAFAGYWNVTLIPEGARHIRVEHRSRNHLALMGGDGRYVLNGHWVVSPPGTYEAAGTHVVYTRDTGPQETLQAAGPTSHDLLLQVLLQEPNPGIEFEFWLPRERYSPFQARVQALGWPLRQPQPRGVEPQPPAAPAVTPAQTPTLAPDPCPPCPDTRGRAHRLLHYCGSDFVFQARVLGHHHQAQETRYEVRIQLVYKNRSPLRAREYVWAPGHCPCPMLAPHRDYLMAVQRLVSPDGTQDQLLLPHAGYARPWSPAEDSRIRLTARRCPG

SEQ ID NO: 5405 - protein, 530 aa, unidentified
MARKALKLASWTSMALAASGIYFYSNKYLDPNDFGAVRVGRAVATTAVISYDYLTSLKSVPYGSEEYLQLRSKSWPVFLQVHLRSARRLCELCCANRGTFIKVGQHLGALDYLLPEEYTSTLKVLHSQAPQSSMQEIRQVIREDLGKEIHDLFQSFDDTPLGTASLAQVHKAVLHDGRTVAVKVQHPKVRAQSSKDILLMEVLVLAVKQLFPEFEFMWLVDEAKKNLPLELDFLNEGRNAEKVSQMLRHFDFLKVPRIHWDLSTERVLLMEFVDGGQVNDRDYMERNKIDVNEISRHLGKMYSEMIFVNGFVHCDPHPGNVLVRKHPGTGKAEIVLLDHGLYQMLTEEFRLNYCHLWQSLIWTDMKRVKEYSQRLGAGDLYPLFACMLTARSWDSVNRGISQAPVTATEDLEIRNNAANYLPQISHLLNHVPRQMLLILKTNDLLRGIEAALGTRASASSFLNMSRCCIRALAEHKKKNTCSFFRRTQISFSEAFNLWQINLHELILRVKGLKLADRVLALICWLFPAPL

SEQ ID NO: 5406 - protein, 176 aa, unidentified
MTMCSGARLALLVYGIIMHSSVYSSPAAAGLRFPGIRPEEEAYGEDGNPLPDFDGSEPPGAGSPASAPRAAAAWYRPAGRRDVAHGILNEAYRKVLDQLSAGKHLQSLVARGVGGSLGGGAGDDAEPLSKRHSDGIFTDSYSRYRKQMAVKKYLAAVLGKRYKQRVKNKGRRIAYL

SEQ ID NO: 5407 - protein, 468 aa, unidentified; identical to SEQ ID NO: 295

SEQ ID NO: 5408 - protein, 1321 aa, unidentified; identical to SEQ ID NO: 298

SEQ ID NO: 5409 - protein, 1585 aa, unidentified; identical to SEQ ID NO: 300

SEQ ID NO: 5410 - protein, 874 aa, unidentified; identical to SEQ ID NO: 302

SEQ ID NO: 5411 - protein, 652 aa, unidentified; identical to SEQ ID NO: 305

SEQ ID NO: 5412 - protein, 835 aa, unidentified; identical to SEQ ID NO: 306

SEQ ID NO: 5413 - protein, 910 aa, unidentified; identical to SEQ ID NO: 307

SEQ ID NO: 5414 - protein, 693 aa, unidentified; identical to SEQ ID NO: 312

SEQ ID NO: 5415 - protein, 528 aa, unidentified; identical to SEQ ID NO: 316

SEQ ID NO: 5416 - protein, 1221 aa, unidentified; identical to SEQ ID NO: 317

SEQ ID NO: 5417 - protein, 6306 aa, unidentified; identical to SEQ ID NO: 323

SEQ ID NO: 5418 - protein, 179 aa, unidentified
MVQAWYMDDAPGDPRQPHRPDPGRPVGLEQLRRLGVLYWKLDADKYENDPELEKIRRERNYSWMDIITICKDKLPNYEEKIKMFYEEHLHLDDEIRYILDGSGYFDVRDKEDQWIRIFMEKGDMVTLPAGIYHRFTVDEKNYTKAMRLFVGEPVWTAYNRPADHFEARGQYVKFLAQTA

SEQ ID NO: 5419 - protein, 80 aa, unidentified; identical to SEQ ID NO: 324

SEQ ID NO: 5420 - protein, 244 aa, unidentified
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLFTYDQYQENNVDQASGSVLLHLEVGDQVWLQVYGEGERNGLYADNDNDSTFTGFLLYHDTN

SEQ ID NO: 5421 - protein, 185 aa, unidentified
MKLVSVALMYLGSLAFLGADTARLDVASEFRKKWNKWALSRGKRELRMSSSYPTGLADVKAGPAQTLIRPQDMKGASRSPEDSSPDAARIRVKRYRQSMNNFQGLRSFGCRFGTCTVQKLAHQIYQFTDKDKDNVAPRSKISPQGYGRRRRRSLPEAGPGRTLVSSKPQAHGAPAPPSGSAPHFL

SEQ ID NO: 5422 - protein, 148 aa, unidentified
MARIPTAALGCISLLCLQLPGSLSRSLGGDPRPVKPREPPARSPSSSLQPRHPAPRPVVWKLHRALQAQRGAGLAPVMGQPLRDGGRQHSGPRRHSGPRRTQAQLLRVGCVLGTCQVQNLSHRLWQLMGPAGRQDSAPVDPSSPHSYG

SEQ ID NO: 5423 - protein, 153 aa, unidentified
MTIHILILLLLLAFSAQGDLDTAARRGQHQVPQHRGHVCYLGVCRTHRLAEIIYWIRCLHQGALGEGQPRAPGPLQLWAPPVARGGSPARFPGFRPAARGLAQCPARWVTSGTARPLLGFSLPICMLELLLHISSPLTPAPETVFPSPSPGCD

SEQ ID NO: 5424 - protein, 497 aa, unidentified
MALWRGSAYAGFLALAVGCVFLLEPELPGSALRSLWSSLCLGPAPAPPGPVSPEGRLAAAWDALIVRPVRRWRRVAVGVNACVDVVLSGVKLLQALGLSPGNGKDHSILHSRNDLEEAFIHFMGKGAAAERFFSDKETFHDIAQVASEFPGAQHYVGGNAALIGQKFAANSDLKVLLCGPVGPKLHELLDDNVFVPPESLQEVDEFHLILEYQAGEEWGQLKAPHANRFIFSHDLSNGAMNMLEVFVSSLEEFQPDLVVLSGLHMMEGQSKELQRKRLLEVVTSISDIPTGIPVHLELASMTNRELMSSIVHQQVFPAVTSLGLNEQELLFLTQSASGPHSSLSSWNGVPDVGMVSDILFWILKEHGRSKSRASDLTRIHFHTLVYHILATVDGHWANQLAAVAAGARVAGTQACATETIDTSRVSLRAPQEFMTSHSEAGSRIVLNPNKPVVEWHREGISFHFTPVLVCKDPIRTVGLGDAISAEGLFYSEVHPHY

SEQ ID NO: 5425 - protein, 363 aa, unidentified
MAAAAMAAAAGGGAGAARSLSRFRGCLAGALLGDCVGSFYEAHDTVDLTSVLRHVQSLEPDPGTPGSERTEALYYTDDTAMARALVQSLLAKEAFDEVDMAHRFAQEYKKDPDRGYGAGVVTVFKKLLNPKCRDVFEPARAQFNGKGSYGNGGAMRVAGISLAYSSVQDVQKFARLSAQLTHASSLGYNGAILQALAVHLALQGESSSEHFLKQLLGHMEDLEGDAQSVLDARELGMEERPYSSRLKKIGELLDQASVTREEVVSELGNGIAAFESVPTAIYCFLRCMEPDPEIPSAFNSLQRTLIYSISLGGDTDTIATMAGAIAGAYYGMDQVPESWQQSCEGYEETDILAQSLHRVFQKS

SEQ ID NO: 5426 - protein, 1158 aa, unidentified
MAAVRGAPLLSCLLALLALCPGGRPQTVLTDDEIEEFLEGFLSELEPEPREDDVEAPPPPEPTPRVRKAQAGGKPGKRPGTAAEVPPEKTKDKGKKGKKDKGPKVPKESLEGSPRPPKKGKEKPPKATKKPKEKPPKATKKPKEKPPKATKKPKEKPPKATKKPPSGKRPPILAPSETLEWPLPPPPSPGPEELPQEGGAPLSNNWQNPGEETHVEAREHQPEPEEETEQPTLDYNDQIEREDYEDFEYIRRQKQPRPPPSRRRRPERVWPEPPEEKAPAPAPEERIEPPVKPLLPPLPPDYGDGYVIPNYDDMDYYFGPPPPQKPDAERQTDEEKEELKKPKKEDSSPKEETDKWAVEKGKDHKEPRKGEELEEEWTPTEKVKCPPIGMESHRIEDNQIRASSMLRHGLGAQRGRLNMQTGATEDDYYDGAWCAEDDARTQWIEVDTRRTTRFTGVITQGRDSSIHDDFVTTFFVGFSNDSQTWVMYTNGYEEMTFHGNVDKDTPVLSELPEPVVARFIRIYPLTWNGSLCMRLEVLGCSVAPVYSYYAQNEVVATDDLDFRHHSYKDMRQLMKVVNEECPTITRTYSLGKSSRGLKIYAMEISDNPGEHELGEPEFRYTAGIHGNEVLGRELLLLLMQYLCREYRDGNPRVRSLVQDTRIHLVPSLNPDGYEVAAQMGSEFGNWALGLWTEEGFDIFEDFPDLNSVLWGAEERKWVPYRVPNNNLPIPERYLSPDATVSTEVRAIIAWMEKNPFVLGANLNGGERLVSYPYDMARTPTQEQLLAAAMAAARGEDEDEVSEAQETPDHAIFRWLAISFASAHLTLTEPYRGGCQAQDYTGGMGIVNGAKWNPRTGTINDFSYLHTNCLELSFYLGCDKFPHESELPREWENNKEALLTFMEQVHRGIKGVVTDEQGIPIANATISVSGINHGVKTASGGDYWRILNPGEYRVTAHAEGYTPSAKTCNVDYDIGATQCNFILARSNWKRIREIMAMNGNRPIPHIDPSRPMTPQQRRLQQRRLQHRLRLRAQMRLRRLNATTTLGPHTVPPTLPPAPATTLSTTIEPWGLIPPTTAGWEESETETYTEVVTEFGTEVEPEFGTKVEPEFETQLEPEFETQLEPEFEEEEEEEKEEEIATGQAFPFTTVETYTVNFGDF

SEQ ID NO: 5427 - protein, 599 aa, unidentified
MKLLKLTGFIFFLFFLTESLTLPTQPRDIENFNSTQKFIEDNIEYITIIAFAQYVQEATFEEMEKLVKDMVEYKDRCMADKTLPECSKLPNNVLQEKICAMEGLPQKHNFSHCCSKVDAQRRLCFFYNKKSDVGFLPPFPTLDPEEKCQAYESNRESLLNHFLYEVARRNPFVFAPTLLTVAVHFEEVAKSCCEEQNKVNCLQTRAIPVTQYLKAFSSYQKHVCGALLKFGTKVVHFIYIAILSQKFPKIEFKELISLVEDVSSNYDGCCEGDVVQCIRDTSKVMNHICSKQDSISSKIKECCEKKIPERGQCIINSNKDDRPKDLSLREGKFTDSENVCQERDADPDTFFAKFTFEYSRRHPDLSIPELLRIVQIYKDLLRNCCNTENPPGCYRYAEDKFNETTEKSLKMVQQECKHFQNLGKDGLKYHYLIRLTKIAPQLSTEELVSLGEKMVTAFTTCCTLSEEFACVDNLADLVFGELCGVNENRTINPAVDHCCKTNFAFRRPCFESLKADKTYVPPPFSQDLFTFHADMCQSQNEELQRKTDRFLVNLVKLKHELTDEELQSLFTNFANVVDKCCKAESPEVCFNEESPKIGN

SEQ ID NO: 5428 - protein, 609 aa, unidentified
MKWVESIFLIFLLNFTESRTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITVTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 5429 - protein, 346 aa, unidentified
MARKSNLPVLLVPFLLCQALVRCSSPLPLVVNTWPFKNATEAAWRALASGGSALDAVESGCAMCEREQCDGSVGFGGSPDELGETTLDAMIMDGTTMDVGAVGDLRRIKNAIGVARKVLEHTTHTLLVGESATTFAQSMGFINEDLSTTASQALHSDWLARNCQPNYWRNVIPDPSKYCGPYKPPGILKQDIPIHKETEDDRGHDTIGMVVIHKTGHIAAGTSTNGIKFKIHGRVGDSPIPGAGAYADDTAGAAAATGNGDILMRFLPSYQAVEYMRRGEDPTIACQKVISRIQKHFPEFFGAVICANVTGSYGAACNKLSTFTQFSFMVYNSEKNQPTEEKVDCI

SEQ ID NO: 5430 - protein, 404 aa, unidentified; identical to SEQ ID NO: 341

SEQ ID NO: 5431 - protein, 422 aa, unidentified
MTVFFKTLRNHWKKTTAGLCLLTWGGHWLYGKHCDNLLRRAACQEAQVFGNQLIPPNAQVKKATVFLNPAACKGKARTLFEKNAAPILHLSGMDVTIVKTDYEGQAKKLLELMENTDVIIVAGGDGTLQEVVTGVLRRTDEATFSKIPIGFIPLGETSSLSHTLFAESGNKVQHITDATLAIVKGETVPLDVLQIKGEKEQPVFAMTGLRWGSFRDAGVKVSKYWYLGPLKIKAAHFFSTLKEWPQTHQASISYTGPTERPPNEPEETPVQRPSLYRRILRRLASYWAQPQDALSQEVSPEVWKDVQLSTIELSITTRNNQLDPTSKEDFLNICIEPDTISKGDFITIGSRKVRNPKLHVEGTECLQASQCTLLIPEGAGGSFSIDSEEYEAMPVEVKLLPRKLQFFCDPRKREQMLTSPTQ

SEQ ID NO: 5432 - protein, 658 aa, unidentified
MAEAAAAAGGTGLGAGASYGSAADRDRDPDPDRAGRRLRVLSGHLLGRPREALSTNECKARRAASAATAAPTATPAAQESGTIPKKRQEVMKWNGWGYNDSKFIFNKKGQIELTGKRYPLSGMGLPTFKEWIQNTLGVNVEHKTTSKASLNPSDTPPSVVNEDFLHDLKETNISYSQEADDRVFRAHGHCLHEIFLLREGMFERIPDIVLWPTCHDDVVKIVNLACKYNLCIIPIGGGTSVSYGLMCPADETRTIISLDTSQMNRILWVDENNLTAHVEAGITGQELERQLKESGYCTGHEPDSLEFSTVGGWVSTRASGMKKNIYGNIEDLVVHIKMVTPRGIIEKSCQGPRMSTGPDIHHFIMGSEGTLGVITEATIKIRPVPEYQKYGSVAFPNFEQGVACLREIAKQRCAPASIRLMDNKQFQFGHALKPQVSSIFTSFLDGLKKFYITKFKGFDPNQLSVATLLFEGDREKVLQHEKQVYDIAAKFGGLAAGEDNGQRGYLLTYVIAYIRDLALEYYVLGESFETSAPWDRVVDLCRNVKERITRECKEKGVQFAPFSTCRVTQTYDAGACIYFYFAFNYRGISDPLTVFEQTEAAAREEILANGGSLSHHHGVGKLRKQWLKESISDVGFGMLKSVKEYVDPNNIFGNRNLL

SEQ ID NO: 5433 - protein, 175 aa, unidentified
MEKIPVSAFLLLVALSYTLARDTTVKPGAKKDTKDSRPKLPQTLSRGWGDQLIWTQTYEEALYKSKTSNKPLMIIHHLDECPHSQALKKVFAENKEIQKLAEQFVLLNLVYETTDKHLSPDGQYVPRIMFVDPSLTVRADITGRYSNRLYAYEPADTALLLDNMKKALKLLKTEL

SEQ ID NO: 5434 - protein, 166 aa, unidentified
MMLHSALGLCLLLVTVSSNLAIAIKKEKRPPQTLSRGWGDDITWVQTYEEGLFYAQKSKKPLMVIHHLEDCQYSQALKKVFAQNEEIQEMAQNKFIMLNLMHETTDKNLSPDGQYVPRIMFVDPSLTVRADIAGRYSNRLYTYEPRDLPLLIENMKKALRLIQSEL

SEQ ID NO: 5435 - protein, 2068 aa, unidentified; identical to SEQ ID NO: 349

SEQ ID NO: 5436 - protein, 132 aa, unidentified
MLTAAVLSCALLLALPATRGAQMGLAPMEGIRRPDQALLPELPGLGLRAPLKKTTAEQAEEDLLQEAQALAEVLDLQDREPRSSRRCVRLHESCLGQQVPCCDPCATCYCRFFNAFCYCRKLGTAMNPCSRT

SEQ ID NO: 5437 - protein, 485 aa, unidentified
MRKRAPQSEMAPAGVSLRATILCLLAWAGLAAGDRVYIHPFHLVIHNESTCEQLAKANAGKPKDPTFIPAPIQAKTSPVDEKALQDQLVLVAAKLDTEDKLRAAMVGMLANFLGFRIYGMHSELWGVVHGATVLSPTAVFGTLASLYLGALDHTADRLQAILGVPWKDKNCTSRLDAHKVLSALQAVQGLLVAQGRADSQAQLLLSTVVGVFTAPGLHLKQPFVQGLALYTPVVLPRSLDFTELDVAAEKIDRFMQAVTGWKTGCSLMGASVDSTLAFNTYVHFQGKMKGFSLLAEPQEFWVDNSTSVSVPMLSGMGTFQHWSDIQDNFSVTQVPFTESACLLLIQPHYASDLDKVEGLTFQQNSLNWMKKLSPRTIHLTMPQLVLQGSYDLQDLLAQAELPAILHTELNLQKLSNDRIRVGEVLNSIFFELEADEREPTESTQQLNKPEVLEVTLNRPFLFAVYDQSATALHFLGRVANPLSTA

SEQ ID NO: 5438 - protein, 1226 aa, unidentified
MSKLKVIPEKSLTNNSRIVGLLAQLEKINAEPSESDTARYVTSKILHLAQSQEKTRREMTAKGSTGMEILLSTLENTKDLQTTLNILSILVELVSAGGGRRVSFLVTKGGSQILLQLLMNASKESPPHEDLMVQIHSILAKIGPKDKKFGVKARINGALNITLNLVKQNLQNHRLVLPCLQLLRVYSANSVNSVSLGKNGVVELMFKIIGPFSKKNSSLIKVALDTLAALLKSKTNARRAVDRGYVQVLLTIYVDWHRHDNRHRNMLIRKGILQSLKSVTNIKLGRKAFIDANGMKILYNTSQECLAVRTLDPLVNTSSLIMRKCFPKNRLPLPTIKSSFHFQLPVIPVTGPVAQLYSLPPEVDDVVDESDDNDDIDVEAENETENEDDLDQNFKNDDIETDINKLKPQQEPGRTIEDLKMYEHLFPELVDDFQDYDLISKEPKPFVFEGKVRGPIVVPTAGEETSGNSGNLRKVVMKENISSKGDEGEKKSTFMDLAKEDIKDNDRTLQQQPGDQNRTISSVHGLNNDIVKALDRITLQNIPSQTAPGFTAEMKKDCSLPLTVLTCAKACPHMATCGNVLFEGRTVQLGKLCCTGVETEDDEDTESNSSVEQASVEVPDGPTLHDPDLYIEIVKNTKSVPEYSEVAYPDYFGHIPPPFKEPILERPYGVQRTKIAQDIERLIHQSDIIDRVVYDLDNPNYTIPEEGDILKFNSKFESGNLRKVIQIRKNEYDLILNSDINSNHYHQWFYFEVSGMRPGVAYRFNIINCEKSNSQFNYGMQPLMYSVQEALNARPWWIRMGTDICYYKNHFSRSSVAAGGQKGKSYYTITFTVNFPHKDDVCYFAYHYPYTYSTLQMHLQKLESAHNPQQIYFRKDVLCETLSGNSCPLVTITAMPESNYYEHICHFRNRPYVFLSARVHPGETNASWVMKGTLEYLMSNNPTAQSLRESYIFKIVPMLNPDGVINGNHRCSLSGEDLNRQWQSPSPDLHPTIYHAKGLLQYLAAVKRLPLVYCDYHGHSRKKNVFMYGCSIKETVWHTNDNATSCDVVEDTGYRTLPKILSHIAPAFCMSSCSFVVEKSKESTARVVVWREIGVQRSYTMESTLCGCDQGKYKGLQIGTRELEEMGAKFCVGLLRLKRLTSPLEYNLPSSLLDFENDLIESSCKVTSPTTYVLDEDEPRFLEEVDYSAESNDELDIELAENVGDYEPSAQEEVLSDSELSRTYLP

SEQ ID NO: 5439 - protein, 159 aa, unidentified; identical to SEQ ID NO: 352

SEQ ID NO: 5440 - protein, 611 aa, unidentified
MSVQVVSAAAAAKVPEVELKDLSPSEAESQLGLSTAAVGAMAPPAGGGDPEAPAPAAERPPVPGPGSGPAAALSPAAGKVPQASAMKRSDPHHQHQRHRDGGEALVSPDGTVTEAPRTVKKQIQFADQKQEFNKRPTKIGRRSLSRSISQSSTDSYSSAASYTDSSDDETSPRDKQQKNSKGSSDFCVKNIKQAEFGRREIEIAEQEMPALMALRKRAQGEKPLAGAKIVGCTHITAQTAVLMETLGALGAQCRWAACNIYSTLNEVAAALAESGFPVFAWKGESEDDFWWCIDRCVNVEGWQPNMILDDGGDLTHWIYKKYPNMFKKIKGIVEESVTGVHRLYQLSKAGKLCVPAMNVNDSVTKQKFDNLYCCRESILDGLKRTTDMMFGGKQVVVCGYGEVGKGCCAALKAMGSIVYVTEIDPICALQACMDGFRLVKLNEVIRQVDIVITCTGNKNVVTREHLDRMKNSCIVCNMGHSNTEIDVASLRTPELTWERVRSQVDHVIWPDGKRIVLLAEGRLLNLSCSTVPTFVLSITATTQALALIELYNAPEGRYKQDVYLLPKKMDEYVASLHLPTFDAHLTELTDEQAKYLGLNKNGPFKPNYYRY

SEQ ID NO: 5441 - protein, 367 aa, unidentified
MKSLVLLLCLAQLWGCHSAPHGPGLIYRQPNCDDPETEEAALVAIDYINQNLPWGYKHTLNQIDEVKVWPQQPSGELFEIEIDTLETTCHVLDPTPVARCSVRQLKEHAVEGDCDFQLLKLDGKFSVVYAKCDSSPDSAEDVRKVCQDCPLLAPLNDTRVVHAAKAALAAFNAQNNGSNFQLEEISRAQLVPLPPSTYVEFTVSGTDCVAKEATEAAKCNLLAEKQYGFCKATLSEKLGGAEVAVTCMVFQTQPVSSQPQPEGANEAVPTPVVDPDAPPSPPLGAPGLPPAGSPPDSHVLLAAPPGHQLHRAHYDLRHTFMGVVSLGSPSGEVSHPRKTRTVVQPSVGAAAGPVVPPCPGRIRHFKV

SEQ ID NO: 5442 - protein, 245 aa, unidentified; identical to SEQ ID NO: 354

SEQ ID NO: 5443 - protein, 223 aa, unidentified
MASKLLRAVILGPPGSGKGTVCQRIAQNFGLQHLSSGHFLRENIKASTEVGEMAKQYIEKSLLVPDHVITRLMMSELENRRGQHWLLDGFPRTLGQAEALDKICEVDLVISLNIPFETLKDRLSRRWIHPPSGRVYNLDFNPPHVHGIDDVTGEPLVQQEDDKPEAVAARLRQYKDVAKPVIELYKSRGVLHQFSGTETNKIWPYVYTLFSNKITPIQSKEAY

SEQ ID NO: 5444 - protein, 662 aa, unidentified
MRGAGPSPRQSPRTLRPDPGPAMSFFRRKVKGKEQEKTSDVKSIKASISVHSPQKSTKNHALLEAAGPSHVAINAISANMDSFSSSRTATLKKQPSHMEAAHFGDLGRSCLDYQTQETKSSLSKTLEQVLHDTIVLPYFIQFMELRRMEHLVKFWLEAESFHSTTWSRIRAHSLNTVKQSSLAEPVSPSKKHETTASFLTDSLDKRLEDSGSAQLFMTHSEGIDLNNRTNSTQNHLLLSQECDSAHSLRLEMARAGTHQVSMETQESSSTLTVASRNSPASPLKELSGKLMKSIEQDAVNTFTKYISPDAAKPIPITEAMRNDIIARICGEDGQVDPNCFVLAQSIVFSAMEQEHFSEFLRSHHFCKYQIEVLTSGTVYLADILFCESALFYFSEYMEKEDAVNILQFWLAADNFQSQLAAKKGQYDGQEAQNDAMILYDKYFSLQATHPLGFDDVVRLEIESNICREGGPLPNCFTTPLRQAWTTMEKVFLPGFLSSNLYYKYLNDLIHSVRGDEFLGGNVSLTAPGSVGPPDESHPGSSDSSASQSSVKKASIKILKNFDEAIIVDAASLDPESLYQRTYAGKMTFGRVSDLGQFIRESEPEPDVRKSKGSMFSQAMKKWVQGNTDEAQEELAWKIAKMIVSDIMQQAQYDQPLEKSTKL

SEQ ID NO: 5445 - protein, 323 aa, unidentified
MDSKYQCVKLNDGHFMPVLGFGTYAPAEVPKSKALEATKLAIEAGFRHIDSAHLYNNEEQVGLAIRSKIADGSVKREDIFYTSKLWCNSHRPELVRPALERSLKNLQLDYVDLYLIHFPVSVKPGEEVIPKDENGKILFDTVDLCATWEAVEKCKDAGLAKSIGVSNFNRRQLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEY

SEQ ID NO: 5446 - protein, 587 aa, unidentified
MVTAAMLLQCCPVLARGPTSLLGKVVKTHQFLFGIGRCPILATQGPNCSQIHLKATKAGGDSPSWAKGHCPFMLSELQDGKSKIVQKAAPEVQEDVKAFKTDLPSSLVSVSLRKPFSGPQEQEQISGKVTHLIQNNMPGNYVFSYDQFFRDKIMEKKQDHTYRVFKTVNRWADAYPFAQHFSEASVASKDVSVWCSNDYLGMSRHPQVLQATQETLQRHGAGAGGTRNISGTSKFHVELEQELAELHQKDSALLFSSCFVANDSTLFTLAKILPGCEIYSDAGNHASMIQGIRNSGAAKFVFRHNDPDHLKKLLEKSNPKIPKIVAFETVHSMDGAICPLEELCDVSHQYGALTFVDEVHAVGLYGSRGAGIGERDGIMHKIDIISGTLGKAFGCVGGYIASTRDLVDMVRSYAAGFIFTTSLPPMVLSGALESVRLLKGEEGQALRRAHQRNVKHMRQLLMDRGLPVIPCPSHIIPIRVGNAALNSKLCDLLLSKHGIYVQAINYPTVPRGEELLRLAPSPHHSPQMMEDFVEKLLLAWTAVGLPLQDVSVAACNFCRRPVHFELMSEWERSYFGNMGPQYVTTYA

SEQ ID NO: 5447 - protein, 609 aa, unidentified [sequence omitted]

SEQ ID NO: 5448 - protein, 494 aa, unidentified
MSTGTFVVSQPLNYRGGARVEPADASGTEKAFEPATGRVIATFTCSGEKEVNLAVQNAKAAFKIWSQKSGMERCRILLEAARIIREREDEIATMECINNGKSIFEARLDIDISWQCLEYYAGLAASMAGEHIQLPGGSFGYTRREPLGVCVGIGAWNYPFQIASWKSAPALACGNAMVFKPSPFTPVSALLLAEIYSEAGVPPGLFNVVQGGAATGQFLCQHPDVAKVSFTGSVPTGMKIMEMSAKGIKPVTLELGGKSPLIIFSDCDMNNAVKGALMANFLTQGQVCCNGTRVFVQKEILDKFTEEVVKQTQRIKIGDPLLEDTRMGPLINRPHLERVLGFVKVAKEQGAKVLCGGDIYVPEDPKLKDGYYMRPCVLTNCRDDMTCVKEEIFGPVMSILSFDTEAEVLERANDTTFGLAAGVFTRDIQRAHRVVAELQAGTCFINNYNVSPVELPFGGYKKSGFGRENGRVTIEYYSQLKTVCVEMGDVESAF

SEQ ID NO: 5449 - protein, 364 aa, unidentified; identical to SEQ ID NO: 364

SEQ ID NO: 5450 - protein, 464 aa, unidentified; identical to SEQ ID NO: 365

SEQ ID NO: 5451 - protein, 611 aa, unidentified; identical to SEQ ID NO: 376

SEQ ID NO: 5452 - protein, 129 aa, unidentified
MRPLKPGAPLPALFLLALALSPHGAHGRPRGRRGARVTDKEPKPLLFLPAAGAGRTPSGSRSAEIFPRDSNLKDKFIKHFTGPVTFSPECSKHFHRLYYNTRECSTPAYYKRCARLLTRLAVSPLCSQT

SEQ ID NO: 5453 - protein, 152 aa, unidentified
MRGPGHPLLLGLLLVLGAAGRGRGGAEPREPADGQALLRLVVELVQELRKHHSAEHKGLQLLGRDCALGRAEAAGLGPSPEQRVEIVPRDLRMKDKFLKHLTGPLYFSPKCSKHFHRLYHNTRDCTIPAYYKRCARLLTRLAVSPVCMEDKQ

SEQ ID NO: 5454 - protein, 389 aa, unidentified
MGKMAAAVGSVATLATEPGEDAFRKLFRFYRQSRPGTADLEGVIDFSAAHAARGKGPGAQKVIKSQLNVSSVSEQNAYRAGLQPVSKWQAYGLKGYPGFIFIPNPFLPGYQWHWVKQCLKLYSQKPNVCNLDKHMSKEETQDLWEQSKEFLRYKEATKRRPRSLLEKLRWVTVGYHYNWDSKKYSADHYTPFPSDLGFLSEQVAAACGFEDFRAEAGILNYYRLDSTLGIHVDRSELDHSKPLLSFSFGQSAIFLLGGLQRDEAPTAMFMHSGDIMIMSGFSRLLNHAVPRVLPNPEGEGLPHCLEAPLPAVLPRDSMVEPCSMEDWQVCASYLKTARVNMTVRQVLATDQNFPLEPIEDEKRDISTEGFCHLDDQNSEVKRARINPDS

SEQ ID NO: 5455 - protein, 394 aa, unidentified
MAAASGYTDLREKLKSMTSRDNYKAGSREAAAAAAAAVAAAAAAAAAAEPYPVSGAKRKYQEDSDPERSDYEEQQLQKEEEARKVKSGIRQMRLFSQDECAKIEARIDEVVSRAEKGLYNEHTVDRAPLRNKYFFGEGYTYGAQLQKRGPGQERLYPPGDVDEIPEWVHQLVIQKLVEHRVIPEGFVNSAVINDYQPGGCIVSHVDPIHIFERPIVSVSFFSDSALCFGCKFQFKPIRVSEPVLSLPVRRGSVTVLSGYAADEITHCIRPQDIKERRAVIILRKTRLDAPRLETKSLSSSVLPPSYASDRLSGNNRDPALKPKRSHRKADPDAAHRPRILEMDKEENRRSVLLPTHRRRGSFSSENYWRKSYESSEDCSEAAGSPARKVKMRRH

SEQ ID NO: 5456 - protein, 528 aa, unidentified
MQGPWVLLLLGLRLQLSLGVIPAEEENPAFWNRQAAEALDAAKKLQPIQKVAKNLILFLGDGLGVPTVTATRILKGQKNGKLGPETPLAMDRFPYLALSKTYNVDRQVPDSAATATAYLCGVKANFQTIGLSAAARFNQCNTTRGNEVISVMNRAKQAGKSVGVVTTTRVQHASPAGTYAHTVNRNWYSDADMPASARQEGCQDIATQLISNMDIDVILGGGRKYMFPMGTPDPEYPADASQNGIRLDGKNLVQEWLAKHQGAWYVWNRTELMQASLDQSVTHLMGLFEPGDTKYEIHRDPTLDPSLMEMTEAALRLLSRNPRGFYLFVEGGRIDHGHHEGVAYQALTEAVMFDDAIERAGQLTSEEDTLTLVTADHSHVFSFGGYTLRGSSIFGLAPSKAQDSKAYTSILYGNGPGYVFNSGVRPDVNESESGSPDYQQQAAVPLSSETHGGEDVAVFARGPQAHLVHGVQEQSFVAHVMAFAACLEPYTACDLAPPACTTDAAHPVAASLPLLAGTLLLLGASAAP

SEQ ID NO: 5457 - protein, 524 aa, unidentified; identical to SEQ ID NO: 380

SEQ ID NO: 5458 - protein, 535 aa, unidentified
MLGPCMLLLLLLLGLRLQLSLGIIPVEEENPDFWNREAAEALGAAKKLQPAQTAAKNLIIFLGDGMGVSTVTAARILKGQKKDKLGPEIPLAMDRFPYVALSKTYNVDKHVPDSGATATAYLCGVKGNFQTIGLSAAARFNQCNTTRGNEVISVMNRAKKAGKSVGVVTTTRVQHASPAGTYAHTVNRNWYSDADVPASARQEGCQDIATQLISNMDIDVILGGGRKYMFRMGTPDPEYPDDYSQGGTRLDGKNLVQEWLAKRQGARYVWNRTELMQASLDPSVTHLMGLFEPGDMKYEIHRDSTLDPSLMEMTEAALRLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDEETHAGEDVAVFARGPQAHLVHGVQEQTFIAHVMAFAACLEPYTACDLAPPAGTTDAAHPGRSVVPALLPLLAGTLLLLETATAP

SEQ ID NO: 5459 - protein, 532 aa, unidentified
MQGPWVLLLLGLRLQLSLGIIPVEEENPDFWNRQAAEALGAAKKLQPAQTAAKNLIIFLGDGMGVSTVTAARILKGQKKDKLGPETFLAMDRFPYVALSKTYSVDKHVPDSGATATAYLCGVKGNFQTIGLSAAARFNQCNTTRGNEVISVMNRAKKAGKSVGVVTTTRVQHASPAGAYAHTVNRNWYSDADVPASARQEGCQDIATQLISNMDIDVILGGGRKYMFPMGTPDPEYPDDYSQGGTRLDGKNLVQEWLAKHQGARYVWNRTELLQASLDPSVTHLMGLFEPGDMKYEIHRDSTLDPSLMEMTEAALLLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDGETHAGEDVAVFARGPQAHLVHGVQEQTFIAHVMAFAACLEPYTACDLAPRAGTTDAAHPGPSVVPALLPLLAGTLLLLGTATAP

SEQ ID NO: 5460 - protein, 447 aa, unidentified
MSASKIPLFKMKDLILILCLLEMSFAVPFFPQQSGTPGMASLSLETMRQLGSLQRLNTLSQYSRYGFGKSFNSLWMHGLLPPHSSLPWMRPREHETQQYEYSLPVHPPPLPSQPSLKPQQPGLKPFLQSAAATTNQATALKEALQPPIHLGHLPLQEGELPLVQQQVAPSDKPPKPELPGVDFADPQGPSLPGMDFPDPQGPSLPGLDFADPQGSTIFQIARLISHGPMPQNKQSPLYPGMLYVPFGANQLNAPARLGIMSSEEVAGGREDPMAYGAMFPGFGGMRPGFEGMPHNPAMGGDFTLEFDSPVAATKGPENEEGGAQGSPMPEANPDNLENPAFLTELEPAPHAGLLALPKDDIPGLPRSPSGKMKGLPSVTPAAADPLMTPELADVYRTYDADMTTSVDFQEEATMDTTMAPNSLQTSMPGNKAQEPEMMHDAWHFQEP

SEQ ID NO: 5461 - protein, 352 aa, unidentified
MRSLGALLLLLSACLAVSAGPVPTPPDNIQVQENFNISRIYGKWYNLAIGSTCPWLKKIMDRMTVSTLVLGEGATEAEISMTSTRWRKGVCEETSGAYEKTDTDGKFLYHKSKWNITMESYVVHTNYDEYAIFLTKKFSRHHGPTITAKLYGRAPQLRETLLQDFRVVAQGVGIPEDSIFTMADRGECVPGEQEPEPILIPRVRRAVLPQEEEGSGGGQLVTEVTKKEDSCQLGYSAGPCMGMTSRYFYNGTSMACETFQYGGCMGNGNNFVTEKECLQTCRTVAACNLPIVRGPCRAFIQLWAFDAVKGKCVLFPYGGCQGNGNKFYSEKECREYCGVPGDGDEELLRFSN

SEQ ID NO: 5462 - protein, 191 aa, unidentified
MGTWILFACLLGAAFAMPLPPHPGHPGYINFSYEVLTPLKWYQSIRPPYPSYGYEPMGGWLHHQIIPVLSQQHPPTHTLQPHHHIPVVPAQQPVIPQQPMMPVPGQHSMTPIQHHQPNLPPPAQQPYQPQPVQPQPHQPMQPQPPVHPMQPLPPQPPLPPMFPMQPLPPMLPDLTLEAWPSTDKTKREEVD

SEQ ID NO: 5463 - protein, 206 aa, unidentified
MGTWILFACLVGAAFAMPLPPHPGHPGYINFSYENSHSQAINVDRIALVLTPLKWYQSMIRPPYSSYGYEPMGGWLHHQIIPVVSQQHPLTHTLQSHHHIPVVPAQQPRVRQQALMPVPGQQSMTPTQHHQPNLPLPAQQPFQPQPVQPQPHQPMQPQPPVQPMQPLLPQPPLPPMFPLRPLPPILPDLHLEAWPATDKTKQEEVD

SEQ ID NO: 5464 - protein, 560 aa, unidentified
MRDLPLTSLALVLSALGALLGTEALRAEEPAVGTSGLIFREDLDWPPGSPQEPLCLVALGGDSNGSSSPLRVVGALSAYEQAFLGAVQRARWGPRDLATFGVCNTGDRQAALPSLRRLGAWLRDPGGQRLVVLHLEEVTWEPTPSLRFQEPPPGGAGPPELALLVLYPGPGPEVTVTRAGLPGAQSLCPSRDTRYLVLAVDRPAGAWRGSGLALTLQPRGEDSRLSTARLQALLFGDDHRCFTRMTPALLLLPRSEPAPLPAHGQLDTVPFPPPRPSAELEESPPSADPFLETLTRLVRALRVPPARASAPRLALDPDALAGFPQGLVNLSDPAALERLLDGEEPLLLLLRPTAATTGDPAPLHDPTSAPWATALARRVAAELQAAAAELRSLPGLPPATAPLLARLLALCPGGPGGLGDPLRALLLLKALQGLRVEWRGRDPRGPGRAQRSAGATAADGPCALRELSVDLRAERSVLIPETYQANNCQGVCGWPQSDRNPRYGNHVVLLLKMQVRGAALARPPCCVPTAYAGKLLISLSEERISAHHVPNMVATECGCR

SEQ ID NO: 5465 - protein, 780 aa, unidentified
MNVRIFYSVSQSPHSLLSLLFYCAILESRISATMPLFKLPAEEKQIDDAMRNFAEKVFASEVKDEGGRQEISPFDVDEICPISHHEMQAHIFHLETLSTSTEARRKKRFQGRKTVNLSIPLSETSSTKLSHIDEYISSSPTYQTVPDFQRVQITGDYASGVTVEDFEIVCKGLYRALCIREKYMQKSFQRFPKTPSKYLRNIDGEAWVANESFYPVFTPPVKKGEDPFRTDNLPENLGYHLKMKDGVVYVYPNEAAVSKDEPKPLPYPNLDTFLDDMNFLLALIAQGPVKTYTHRRLKFLSSKFQVHQMLNEMDELKELKNNPHRDFYNCRKVDTHIHAAACMNQKHLLRFIKKSYQIDADRVVYSTKEKNLTLKELFAKLKMHPYDLTVDSLDVHAGRQTFQRFDKFNDKYNPVGASELRDLYLKTDNYINGEYFATIIKEVGADLVEAKYQHAEPRLSIYGRSPDEWSKLSSWFVCNRIHCPNMTWMIQVPRIYDVFRSKNFLPHFGKMLENIFMPVFEATINPQADPELSVFLKHITGFDSVDDESKHSGHMFSSKSPKPQEWTLEKNPSYTYYAYYMYANIMVLNSLRKERGMNTFLFRPHCGEAGALTHLMTAFMIADDISHGLNLKKSPVLQYLFFLAQIPIAMSPLSNNSLFLEYAKNPFLDFLQKGLMISLSTDDPMQFHFTKEPLMEEYAIAAQVFKLSTCDMCEVARNSVLQCGISHEEKVKFLGDNYLEEGPAGNDIRRTNVAQIRMAYRYETWCYELNLIAEGLKSTE

SEQ ID NO: 5466 - protein, 209 aa, unidentified
MRSTILLFCLLGSTRSLPQLKPALGLPPTKLAPDQGTLPNQQQSNQVFPSLSLIPLTQMLTLGPDLHLLNPAAGMTPGTQTHPLTLGGLNVQQQLHPHVLPIFVTQLGAQGTILSSEELPQIFTSLIIHSLFPGGILPTSQAGANPDVQDGSLPAGGAGVNPATQGTPAGRLPTPSGTDDDFAVTTPAGIQRSTHAIEEATTESANGIQ

SEQ ID NO: 5467 - protein, 511 aa, unidentified
MKLFWLLFTIGFCWAQYSSNTQQGRTSIVHLFEWRWVDIALECERYLAPKGFGGVQVSPPNENVAIHNPFRPWWERYQPVSYKLCTRSGNEDEFRNMVTRCNNVGVRIYVDAVINHMCGNAVSAGTSSTCGSYFNPGSRDFPAVPYSGWDFNDGKCKTGSGDIENYNDATQVRDCRLSGLLDLALGKDYVRSKIAEYMNHLIDIGVAGFRIDASKHMWPGDIKAILDKLHNLNSNWFPEGSKPFIYQEVIDLGGEPIKSSDYFGNGRVTEFKYGAKLGTVIRKWNGEKMSYLKNWGEGWGFMPSDRALVFVDNHDNQRGHGAGGASILTFWDARLYKMAVGFMLAHPYGFTRVMSSYRWPRYFENGKDVNDWVGPPNDNGVTKEVTINPDTTCGNDWVCEHRWRQIRNMVNFRNVVDGQPFTNWYDNGSNQVAFGRGNRGFIVFNNDDWTFSLTLQTGLPAGTYCDVISGDKINGNCTGIKIYVSDDGKAHFSISNSAEDPFIAIHAESKL

SEQ ID NO: 5468 - protein, 511 aa, unidentified; identical to SEQ ID NO: 5467

SEQ ID NO: 5469 - protein, 511 aa, unidentified; identical to SEQ ID NO: 5467

SEQ ID NO: 5470 - protein, 511 aa, unidentified
MKFFLLLFTIGFCWAQYSPNTQQGRTSIVHLFEWRWVDIALECERYLAPKGFGGVQVSPPNENVAIYNPFRPWWERYQPVSYKLCTRSGNEDEFRNMVTRCNNVGVRIYVDAVINHMCGNAVSAGTSSTCGSYFNPGSRDFPAVPYSGWDFNDGKCKTGSGDIENYNDATQVRDCRLTGLLDLALEKDYVRSKIAEYMNHLIDIGVAGFRLDASKHMWPGDIKAILDKLHNLNSNWFPAGSKPFIYQEVIDLGGEPIKSSDYFGNGRVTEFKYGAKLGTVIRKWNGEKMSYLKNWGEGWGFVPSDRALVFVDNHDNQRGHGAGGASILTFWDARLYKMAVGFMLAHPYGFTRVMSSYRWPRQFQNGNDVNDWVGPPNNNGVIKEVTINPDTTCGNDWVCEHRWRQIRNMVIFRNVVDGQPFTNWYDNGSNQVAFGRGNRGFIVFNNDDWSFSLTLQTGLPAGTYCDVISGDKINGNCTGIKIYVSDDGKAHFSISNSAEDPFIAIHAESKL

SEQ ID NO: 5471 - protein, 511 aa, unidentified
MKFFLLLFTIGFCWAQYSPNTQQGRTSIVHLFEWRWVDIALECERYLAPKGFGGVQVSPPNENVAIHNPFRPWWERYQPVSYKLCTRSGNEDEFRNMVTRCNNVGVRIYVDAVINHMSGNAVSAGTSSTCGSYFNPGSRDFPAVPYSGWDFNDGKCKTGSGDIENYNDATQVRDCRLVGLLDLALEKDYVRSKIAEYMNHLIDIGVAGFRLDASKHMWPGDIKAILDKLHNLNSNWFPAGSKPFIYQEVIDLGGEPIKSSDYFGNGRVTEFKYGAKLGTVIRKWNGEKMSYLKNWGEGWGFMPSDRALVFVDNHDNQRGHGAGGASILTFWDARLYKMAVGFMLAHPYGFTRVMSSYRWPRQFQNGNDVNDWVGPPNNNGVIKEVTINPDTTCGNDWVCEHRWRQIRNMVNFRNVVDGQPFTNWYDNGSNQVAFGRGNRGFIVFNNDDWTFSLTLQTGLPAGTYCDVISGDKINGNCTGIKIYVSDDGKAHFSISNSAEDPFIAIHAESKL

SEQ ID NO: 5472 - protein, 147 aa, unidentified
MVMGLGVLLLVFVLGLGLTPPTLAQDNSRYTHFLTQHYDAKPQGRDDRYCESIMRRRGLTSPCKDINTFIHGNKRSIKAICENKNGNPHRENLRISKSSFQVTTCKLHGGSPWPPCQYRATAGFRNVVVACENGLPVHLDQSIFRRP

SEQ ID NO: 5473 - protein, 670 aa, unidentified
MIASCLCYLLLPATRLFRALSDAFFTCRKNVLLANSSSPQVEGDFAMAPRGPEQEECEGLLQQWREEGLSQVLSTASEGPLIDKGLAQSSLALLMDNPGEENAASEDRWSSRQLSDLRAAENLDEPFPEMLGEEPLLEVEGVEGSMWAAIPMQSEPQYADCAALPVGALATEQWEEDPAVLAWSIAPEPVPQEEASIWPFEGLGQLQPPAVEIPYHEILWREWEDFSTQPDAQGLKAGDGPQFQFTLMSYNILAQDLMQQSSELYLHCHPDILNWNYRFVNLMQEFQHWDPDILCLQEVQEDHYWEQLEPSLRMMGFTCFYKRRTGCKTDGCAVCYKPTRFRLLCASPVEYFRPGLELLNRDNVGLVLLLQPLVPEGLGQVSVAPLCVANTHILYNPRRGDVKLAQMAILLAEVDKVARLSDGSHCPIILCGDLNSVPDSPLYNFIRDGELQYHGMPAWKVSGQEDFSHQLYQRKLQAPLWPSSLGITDCCQYVTSCHPKRSERRKYGRDFLLRFRFCSIACQRPVGLVLMEGVTDTKPERPAGWAESVLEEDASELEPAFSRTVGTIQHCLHLTSVYTHFLPQRGRPEVTTMPLGLGMTVDYIFFSAESCENGNRTDHRLYRDGTLKLLGRLSLLSEEILWAANGLPNPFCSSDHLCLLASFGMEVTAP

SEQ ID NO: 5474 - protein, 498 aa, unidentified
MTVFLSFAFLAAILTHIGCSNQRRSPENSGRRYNRIQHGQCAYTFILPEHDGNCRESTTDQYNTNALQRDAPHVEPDFSSQKLQHLEHVMENYTQWLQKLENYIVENMKSEMAQIQQNAVQNHTATMLEIGTSLLSQTAEQTRKLTDVETQVLNQTSRLEIQLLENSLSTYKLEKQLLQQTNEILKIHEKNSLLEHKILEMEGKHKEELDTLKEEKENLQGLVTRQTYIIQELEKQLNRATTNNSVLQKQQLELMDTVHNLVNLCTKEGVLLKGGKREEEKPFRDCADVYQAGFNKSGIYTIYINNMPEPKKVFCNMDVNGGGWTVIQHREDGSLDFQRGWKEYKMGFGNPSGEYWLGNEFIFAITSQRQYMLRIELMDWEGNRAYSQYDRFHIGNEKQNYRLYLKGHTGTAGKQSSLILHGADFSTKDADNDNCMCKCALMLTGGWWFDACGPSNLNGMFYTAGQNHGKLNGIKWHYFKGPSYSLRSTTMMIRPLDF

SEQ ID NO: 5475 - protein, 496 aa, unidentified
MWQIVFFTLSCDLVLAAAYNNFRKSMDSIGKKQYQVQHGSCSYTFLLPEMDNCRSSSSPYVSNAVQRDAPLEYDDSVQRLQVLENIMENNTQWLMKLENYIQDNMKKEMVEIQQNAVQNQTAVMIEIGTNLLNQTAEQTRKLTDVEAQVLNQTTRLELQLLEHSLSTNKLEKQILDQTSEINKLQDKNSFLEKKVLAMEDKHIIQLQSIKEEKDQLQVLVSKQNSIIEELEKKIVTATVNNSVLQKQQHDLMETVNNLLTMMSTSNSAKDPTVAKEEQISFRDCAEVFKSGHTTNGIYTLTFPNSTEEIKAYCDMEAGGGGWTIIQRREDGSVDFQRTWKEYKVGFGNPSGEYWLGNEFVSQLTNQQRYVLKIHLKDWEGNEAYSLYEHFYLSSEELNYRIHLKGLTGTAGKISSISQPGNDFSTKDGDNDKCICKCSQMLTGGWWFDACGPSNLNGMYYPQRQNTNKFNGIKWYYWKGSGYSLKATTMMIRPADF

SEQ ID NO: 5476 - protein, 503 aa, unidentified
MLSQLAMLQGSLLLVVATMSVAQQTRQEADRGCETLVVQHGHCSYTFLLPKSEPCPPGPEVSRDSNTLQRESLANPLHLGKLPTQQVKQLEQALQNNTQWLKKLERAIKTILRSKLEQVQQQMAQNQTAPMLELGTSLLNQTTAQIRKLTDMEAQLLNQTSRMDAQMPETFLSTNKLENQLLLQRQKLQQLQGQNSALEKRLQALETKQQEELASILSKKAKLLNTLSRQSAALTNIERGLRGVRHNSSLLQDQQHSLRQLLVLLRHLVQERANASAPAFIMAGEQVFQDCAEIQRSGASASGVYTIQVSNATKPRKVFCDLQSSGGRWTLIQRRENGTVNFQRNWKDYKQGFGDPAGEHWLGNEVVHQLTRRAAYSLRVELQDWEGHEAYAQYEHFHLGSENQLYRLSVVGYSGSAGRQSSLVLQNTSFSTLDSDNDHCLCKCAQVMSGGWWFDACGLSNLNGVYYHAPDNKYKMDGIRWHYFKGPSYSLRASRMMIRPLDI

SEQ ID NO: 5477 - protein, 491 aa, unidentified
MKTFTWTLGVLFFLLVDTGHCRGGQFKIKKINQRRYPRATDGKEEAKKCAYTFLVPEQRITGPICVNTKGQDASTIKDMITRMDLENLKDVLSRQKREIDVLQLVVDVDGNIVNEVKLLRKESRNMNSRVTQLYMQLLHEIIRKRDNSLELSQLENKILNVTTEMLKMATRYRELEVKYASLTDLVNNQSVMITLLEEQCLRIFSRQDTHVSPPLVQVVPQHIPNSQQYTPGLLGGNEIQRDPGYPRDLMPPPDLATSPTKSPFKIPPVTFINEGPFKDCQQAKEAGHSVSGIYMIKPENSNGPMQLWCENSLDPGGWTVIQKRTDGSVNFFRNWENYKKGFGNIDGEYWLGLENIYMLSNQDNYKLLIELEDWSDKKVYAEYSSFRLEPESEFYRLRLGTYQGNAGDSMMWHNGKQFTTLDRDKDMYAGNCAHFHKGGWWYNACAHSNLNGVWYRGGHYRSKHQDGIFWAEYRGGSYSLRAVQMMIKPID

SEQ ID NO: 5478 - protein, 493 aa, unidentified
MRPLCVTCWWLGLLAAMGAVAGQEDGFEGTEEGSPREFIYLNRYKRAGESQDKCTYTFIVPQQRVTGAICVNSKEPEVLLENRVHKQELELLNNELLKQKRQIETLQQLVEVDGGIVSEVKLLRKESRNMNSRVTQLYMQLLHEIIRKRDNALELSQLENRILNQTADMLQLASKYKDLEHKYQHLATLAHNQSEIIAQLEEHCQRVPSARPVPQPPPAAPPRVYQPPTYNRIINQISTNEIQSDQNLKVLPPPLPTMPTLTSLPSSTDKPSGPWRDCLQALEDGHDTSSIYLVKPENTNRLMQVWCDQRHDPGGWTVIQRRLDGSVNFFRNWETYKQGFGNIDGEYWLGLENIYWLTNQGNYKLLVTMEDWSGRKVFAEYASFRLEPESEYYKLRLGRYHGNAGDSFTWHNGKQFTTLDRDHDVYTGNCAHYQKGGWWYNACAHSNLNGVWYRGGHYRSRYQDGVYWAEFRGGSYSLKKVVMMIRPNPNTFH

SEQ ID NO: 5479 - protein, 460 aa, unidentified
MFTIKLLLFIVPLVISSRIDQDNSSFDSLSPEPKSRFAMLDDVKILANGLLQLGHGLKDFVHKTKGQINDIFQKLNIFDQSFYDLSLQTSEIKEEEKELRRTTYKLQVKNEEVKNMSLELNSKLESLLEEKILLQQKVKYLEEQLTNLIQNQPETPEHPEVTSLKTFVEKQDNSIKDLLQTVEDQYKQLNQQHSQIKEIENQLRRTSIQEPTEISLSSKPRAPRTTPFLQLNEIRNVKHDGIPAECTTIYNRGEHTSGMYAIRPSNSQVFHVYCDVISGSPWTLIQHRIDGSQNFNETWENYKYGFGRLDGEFWLGLEKIYSIVKQSNYVLRIELEDWKDNKHYIEYSFYLGNHETNYTLHLVAITGNVPNAIPENKDLVFSTWDHKAKGHFNCPEGYSGGWWWHDECGENNLNGKYNKPRAKSKPERRRGLSWKSQNGRLYSIKSTKMLIHPTDSESFE

SEQ ID NO: 5480 - protein, 406 aa, unidentified
MSGAPTAGAALMLCAATAVLLSAQGGPVQSKSPRFASWDEMNVLAHGLLQLGQGLREHAERTRSQLSALERRLSACGSACQGTEGSTDLPLAPESRVDPEVLHSLQTQLKAQNSRIQQLFHKVAQQQRHLEKQHLRIQHLQSQFGLLDHKHLDHEVAKPARRKRLPEMAQPVDPAHNVSRLHRLPRDCQELFQVGERQSGLFEIQPQGSPPFLVNCKMTSDGGWTVIQRRHDGSVDFNRPWEAYKAGFGDPHGEFWLGLEKVHSITGDRNSRLAVQLRDWDGNAELLQFSVHLGGEDTAYSLQLTAPVAGQLGATTVPPSGLSVPFSTWDQDHDLRRDKNCAKSLSGGWWFGTCSHSNLNGQYFRSIPQQRQKLKKGIFWKTWRGRYYPLQATTMLIQPMAAEAAS

SEQ ID NO: 5481 - protein, 388 aa, unidentified
MMSPSQASLLFLNVCIFICGEAVQGNCVHHSTDSSVVNIVEDGSNAKDESKSNDTVCKEDCEESCDVKTKITREEKHFMCRNLQNSIVSYTRSTKKLLRNMMDEQQASLDYLSNQVNELMNRVLLLTTEVFRKQLDPFPHRPVQSHGLDCTDIKDTIGSVTKTPSGLYIIHPEGSSYPFEVMCDMDYRGGGRTVIQKRIDGIIDFQRLWCDYLDGFGDLLGEFWLGLKKIFYIVNQKNTSFMLYVALESEDDTLAYASYDNFWLEDETRFFKMHLGRYSGNAGDAFRGLKKEDNQNAMPFSTSDVDNDGCRPACLVNGQSVKSCSHLHNKTGWWFNECGLANLNGIHHFSGKLLATGIQWGTWTKNNSPVKIKSVSMKIRRMYNPYFK

SEQ ID NO: 5482 - protein, 470 aa, unidentified
MGKPWLRALQLLLLLGASWARAGAPRCTYTFVLPPQKFTGAVCWSGPASTRATPEAANASELAALRMRVGRHEELLRELQRLAAADGAVAGEVRALRKESRGLSARLGQLRAQLQHEAGPGAGPGADLGAEPAAALALLGERVLNASAEAQRAAARFHQLDVKFRELAQLVTQQSSLIARLERLCPGGAGGQQQVLPPPPLVPVVPVRLVGSTSDTSRMLDPAPEPQRDQTQRQQEPMASPMPAGHPAVPTKPVGPWQDCAEARQAGHEQSGVYELRVGRHVVSVWCEQQLEGGGWTVIQRRQDGSVNFFTTWQHYKAGFGRPDGEYWLGLEPVYQLTSRGDHELLVLLEDWGGRGARAHYDGFSLEPESDHYRLRLGQYHGDAGDSLSWHNDKPFSTVDRDRDSYSGNCALYQRGGWWYHACAHSNLNGVWHHGGHYRSRYQDGVYWAEFRGGAYSLRKAAMLIRPLKL

SEQ ID NO: 5483 - protein, 346 aa, unidentified
MLKKPLSAVTWLCIFIVAFVSHPAWLQKLSKHKTPAQPQLKAANCCEEVKELKAQVANLSSLLSELNKKQERDWVSVVMQVMELESNSKRMESRLTDAESKYSEMNNQIDIMQLQAAQTVTQTSADAIYDCSSLYQKNYRISGVYKLPPDDFLGSPELEVFCDMETSGGGWTIIQRRKSGLVSFYRDWKQYKQGFGSIRGDFWLGNEHIHRLSRQPTRLRVEMEDWEGNLRYAEYSHFVLGNELNSYRLFLGNYTGNVGNDALQYHNNTAFSTKDKDNDNCLDKCAQLRKGGYWYNCCTDSNLNGVYYRLGEHNKHLDGITWYGWHGSTYSLKRVEMKIRPEDFKP

SEQ ID NO: 5484 - protein, 198 aa, unidentified
MPVPALCLLWALAMVTRPASAAPMGGPELAQHEELTLLFHGTLQLGQALNGVYRTTEGRLTKARNSLGLYGRTIELLGQEVSRGRDAAQELRASLLETQMEEDILQLQAEATAEVLGEVAQAQKVLRDSVQRLEVQLRSAWLGPAYREFEVLKAHADKQSHILWALTGHVQRQRREMVAQQHRLRQIQERLHTAALPA

SEQ ID NO: 5485 - protein, 1881 aa, unidentified
MPYSVGFREADAATSFLRAARSGNLDKALDHLRNGVDINTCNQNGLNGLHLASKEGHVKMVVELLHKEIILETTTKKGNTALHIAALAGQDEVVRELVNYGANVNAQSQKGFTPLYMAAQENHLEVVKFLLENGANQNVATEDGFTPLAVALQQGHENVVAHLINYGTKGKVRLPALHIAARNDDTRTAAVLLQNDPNPDVLSKTGFTPLHIAAHYENLNVAQLLLNRGASVNFTPQNGITPLHIASRRGNVIMVRLLLDRGAQIETKTKDELTPLHCAARNGHVRISEILLDHGAPIQAKTKNGLSPIHMAAQGDHLDCVRLLLQYDAEIDDITLDHLTPLHVAAHCGHHRVAKVLLDKGAKPNSRALNGFTPLHIACKKNHVRVMELLLKTGASIDAVTESGLTPLHVASFMGHLPIVKNLLQRGASPNVSNVKVETPLHMAARAGHTEVAKYLLQNKAKVNAKAKDDQTPLHCAARIGHTNMVKLLLENNANPNLATTAGHTPLHIAAREGHVETVLALLEKEASQACMTKKGFTPLHVAAKYGKVRVAELLLERDAHPNAAGKNGLTPLHVAVHHNNLDIVKLLLPRGGSPHSPAWNGYTPLHIAAKQNQVEVARSLLQYGGSANAESVQGVTPLHLAAQEGHAEMVALLLSKQANGNLGNKSGLTPLHLVAQEGHVPVADVLIKHGVMVDATTRMGYTPLHVASHYGNIKLVKFLLQHQADVNAKTKLGYSPLHQAAQQGHTDIVTLLLKNGASPNEVSSDGTTPLAIAKRLGYISVTDVLKVVTDETSFVLVSDKHRMSFPETVDEILDVSEDEGEELISFKAERRDSRDVDEEKELLDFVPKLDQVVESPAIPRIPCAMPETVVIRSEEQEQASKEYDEDSLIPSSPATETSDNISPVASPVHTGFLVSFMVDARGGSMRGSRHNGLRVVIPPRTCAAPTRITCRLVKPQKLSTPPPLAEEEGLASRIIALGPTGAQFLSPVIVEIPHFASHGRGDRELVVLRSENGSVWKEHRSRYGESYLDQILNGMDEELGSLEELEKKRVCRIITTDFPLYFVIMSRLCQDYDTIGPEGGSLKSKLVPLVQATFPENAVTKRVKLALQAQPVPDELVTKLLGNQATFSPIVTVEPRRRKFHRPIGLRIPLPPSWTDNPRDSGEGDTTSLRLLCSVIGGTDQAQWEDITGTTKLVYANECANFTTNVSARFWLSDCPRTAEAVNFATLLYKELTAVPYMAKFVIFAKMNDPREGRLRCYCMTDDKVDKTLEQHENFVEVARSRDIEVLEGMSLFAELSGNLVPVKKAAQQRSFHFQSFRENRLAMPVKVRDSSREPGGSLSFLRKAMKYEDTQHILCHLNITMPPCAKGSGAEDRRRTPTPLALRYSILSESTPGSLSGTEQAEMKMAVISEHLGLSWAELARELQFSVEDINRIRVENPNSLLEQSVALLNLWVIREGQNANMENLYTALQSIDRGEIVNMLEGSGRQSRNLKPDRRHTDRDYSLSPSQMNGYSSLQDELLSPASLGCALSSPLRADQYWNEVAVLDAIPLAATEHDTMLEMSDMQVWSAGLTPSLVTAEDSSLECSKAEDSDATGHEWKLEGALSEEPRGPELGSLELVEDDTVDSDATNGLIDLLEQEEGQRSEEKLPGSKRQDDATGAGQDSENEVSLVSGHQRGQARITHSPTVSQVTERSQDRLQDWDADGSIVSYLQDAAQGSWQEEVTQGPHSFQGTSTMTEGLEPGGSQEYEKVLVSVSEHTWTEQPEAESSQADRDRRQQGQEEQVQEAKNTFTQVVQGNEFQNIPGEQVTEEQFTDEQGNIVTKKIIRKVVRQIDLSSADAAQEHEEVTVEGPLEDPSELEVDIDYFMKHSKDHTSTPNP

SEQ ID NO: 5486 - protein, 522 aa, unidentified
MQEELAWETDGLLPLERQLHEAARQNNVGRMQELIGRRVNTRARNHVGRVALHWAAGAGHEQAVRLLLEHEAAVDEEDAVGALTEARLCFGMNALLLSAWFGHLRILQILVNSGAKIHCESKDGLTLLHCAAQKGHVPVLAFIMEDLEDVALDHVDKLGRTAFHRAAEHGQLDALDFLVGSGCDHNVKDKEGNTALHLAAGRGHMAVLQRLVDIGLDLEEQNAEGLTALHSAAGGSHPDCVQLLLRAGSTVNALTQKNLSCLHYAALSGSEDVSRVLIHAGGCANVVDHQGASPLHLAVRHNFPALVRLLINSDSDVNAVDNRQQTPLHLAAEHAWQDIADMLLIAGVDLNLRDKQGKTALAVAVRSNHVSLVDMIIKADRFYRWEKDHPSDPSGKSLSFKQDHRQETQQLRSVLWRLASRYLQPREWKKLAYSWEFTEAHVDAIEQQWTGTRSYQEHGHRMLLIWLHGVATAGENPSKALFEGLVAIGRRDLAGWSTMARSQLTATSASRVQMILVPQPPE

SEQ ID NO: 5487 - protein, 300 aa, unidentified
MAAAAGDADDEPRSGHSSSEGECAVAPEPLTDAEGLFSFADFGSALGGGGAGLSGRASGGAQSPLRYLHVLWQQDAEPRDELRCKIPAGRLRRAARPHRRLGPTGKEVHALKRLRDSANANDVETVQQLLEDGADPCAADDKGRTALHFASCNGNDQIVQLLLDHGADPNQRDGLGNTPLHLAACTNHVPVITTLLRGGARVDALDRAGRTPLHLAKSKLNILQEGHAQCLEAVRLEVKQIIHMLREYLERLGQHEQRERLDDLCTRLQMTSTKEQVDEVTDLLASFTSLSLQMQSMEKR

SEQ ID NO: 5488 - protein, 933 aa, unidentified; identical to SEQ ID NO: 400

SEQ ID NO: 5489 - protein, 680 aa, unidentified
MVPGVPGAVLTLCLWLAASSGCLAAGPGAAAARRLDESLSAGSVQRARCASRCLSLQITRISAFFQHFQNNGSLVWCQNHKQCSKCLEPCKESGDLRKHQCQSFCEPLFPKKSYECLTSCEFLKYILLVKQGDCPAPEKASGFAAACVESCEVDNECSGVKKCCSNGCGHTCQVPKTLYKGVPLKPRKELRFTELQSGQLEVKWSSKFNISIEPVIYVVQRRWNYGIHPSEDDATHWQTVAQTTDERVQLTDIRPSRWYQFRVAAVNVHGTRGFTAPSKHFRSSKDPSAPPAPANLRLANSTVNSDGSVTVTIVWDLPEEPDIPVHHYKVFWSWMVSSKSLVPTKKKRRKTTDGFQNSVILEKLQPDCDYVVELQAITYWGQTRLKSAKVSLHFTSTHATNNKEQLVKTRKGGIQTQLPFQRRRPTRPLEVGAPFYQDGQLQVKVYWKKTEDPTVNRYHVRWFPEACAHNRTTGSEASSGMTHENYIILQDLSFSCKYKVTVQPIRPKSHSKAEAVFFTTPPCSALKGKSHKPVGCLGEAGHVLSKVLAKPENLSASFIVQDVNITGHFSWKMAKANLYQPMTGFQVTWAEVTTESRQNSLPNSIISQSQILPSDHYVLTVPNLRPSTLYRLEVQVLTPGGEGPATIKTFRTPELPPSSAHRSHLKHRHPHHYKPSPERY

SEQ ID NO: 5490 - protein, 564 aa, unidentified; identical to SEQ ID NO: 404

SEQ ID NO: 5491 - protein, 575 aa, unidentified
MQSPWKILTVAPLFLLLSLQSSASPANDDQSRPSLSNGHTCVGCVLVVSVIEQLAQVHNSTVQASMERLCSYLPEKLFLKTTCYLVIDKFGSDIIKLLSADMNADVVCHTLEFCKQNTGQPLCHLYPLPKETWKFTLQKARQIVKKSPILKYSRSGSDICSLPVLAKICQKIKLAMEQSVPFKDVDSDKYSVFPTLRGYHWRGRDCNDSDESVYPGRRPNNWDVHQDSNCNGIWGVDPKDGVPYEKKFCEGSQPRGIILLGDSAGAHFHISPEWITASQMSLNSFINLPTALTNELDWPQLSGATGFLDSTVGIKEKSIYLRLWKRNHCNHRDYQNISRNGASSRNLKKFIESLSRNKVLDYPAIVIYAMIGNDVCSGKSDPVPAMTTPEKLYSNVMQTLKHLNSHLPNGSHVILYGLPDGTFLWDNLHNRYHPLGQLNKDMTYAQLYSFLNCLQVSPCHGWMSSNKTLRTLTSERAEQLSNTLKKIAASEKFTNFNLFYMDFAFHEIIQEWQKRGGQPWQLIEPVDGFHPNEVALLLLADHFWKKVQLQWPQILGKENPFNPQIKQVFGDQGGH

SEQ ID NO: 5492 - protein, 751 aa, unidentified
MPALGWAVAAILMLQTAMAEPSPGTLPRKAGVFSDLSNQELKAVHSFLWSKKELRLQPSSTTTMAKNTVFLIEMLLPKKYHVLRFLDKGERHPVREARAVIFFGDQEHPNVTEFAVGPLPGPCYMRALSPRPGYQSSWASRPISTAEYALLYHTLQEATKPLHQFFLNTTGFSFQDCHDRCLAFTDVAPRGVASGQRRSWLIIQRYVEGYFLHPTGLELLVDHGSTDAGHWAVEQVWYNGKFYGSPEELARKYADGEVDVVVLEDPLPGGKGHDSTEEPPLFSSHKPRGDFPSPIHVSGPRLVQPHGPRFRLEGNAVLYGGWSFAFRLRSSSGLQVLNVHFGGERIAYEVSVQEAVALYGGHTPAGMQTKYLDVGWGLGSVTHELAPGIDCPETATFLDTFHYYDADDPVHYPRALCLFEMPTGVPLRRHFNSNFKGGFNFYAGLKGQVLVLRTTSTVYNYDYIWDFIFYPNGVMEAKMHATGYVHATFYTPEGLRHGTRLHTHLIGNIHTHLVHYRVDLDVAGTKNSFQTLQMKLENITNPWSPRHRVVQPTLEQTQYSWERQAAFRFKRKLPKYLLFTSPQENPWGHKRTYRLQIHSMADQVLPPGWQEEQAITWARYPLAVTKYRESELCSSSIYHQNDPWHPPVVFEQFLHNNENIENEDLVAWVTVGFLHIPHSEDIPNTATPGNSVGFLLRPFNFFPEDPSLASRDTVIVWPRDNGPNYVQRWIPEDRDCSMPPPFSYNGTYRPV

SEQ ID NO: 5493 - protein, 756 aa, unidentified
MHLKIVLAFLALSLITIFALAYVLLTSPGGSSQPPHCPSVSHRAQPWPHPGQSQLFADLSREELTAVMRFLTQRLGPGLVDAAQAQPSDNCIFSVELQLPPKAAALAHLDRGSPPPAREALAIVLFGGQPQPNVSELVVGPLPHPSYMRDVTVERHGGPLPYHRRPVLRAEFTQMWRHLKEVELPKAPIFLSSTFNYNGSTLAAVHATPRGLRSGDRATWMALYHNISGVGLFLHPVGLELLLDHRALDPAHWTVQQVFYLGHYYADLGQLEREFKSGRLEVVRVPLPPPNGASSLRSRNSPGPLPPLQFSPQGSQYSVQGNLVVSSLWSFTFGHGVFSGLRIFDVRFQGERIAYEVSVQECVSIYGADSPKTMLTRYLDSSFGLGRNSRGLVRGVDCPYQATMVDIHILVGKGAVQLLPGAVCVFEEAQGLPLRRHHNYLQNHFYGGLASSALVVRSVSSVGNYDYIWDFVLYPNGALEGRVHATGYINTAFLKGGEEGLLFGNRVGERVLGTVHTHAFHFKLDLDVAGLKNWVVAEDVVFKPVAAPWNPEHWLQRPQLTRQVLGKEDLTAFSLGSPLPRYLYLASNQTNAWGHQRGYRIQIHSPLGIHIPLESDMERALSWGRYQLVVTQRKEEESQSSSIYHQNDIWTPTVTFADFINNETLLGEDLVAWVTASFLHIPHAEDIPNTVTLGNRVGFLLRPYNFFDEDPSIFSPGSVYFEKGQDAGLCSINPVACLPDLAACVPDLPPFSYHGF

SEQ ID NO: 5494 - protein, 763 aa, unidentified
MNQKTILVLLILAVITIFALVCVLLVGRGGDGGEPSQLPHCPSVSPSAQPWTHPGQSQLFADLSREELTAVMRFLTQRLGPGLVDAAQARPSDNCVFSVELQLPPKAAALAHLDRGSPPPAREALAIVFFGRQPQPNVSELVVGPLPHPSYMRDVTVERHGGPLPYHRRPVLFQEYLDIDQMIFNRELPQASGLLHHCCFYKHRGRNLVTMTTAPRGLQSGDRATWFGLYYNISGAGFFLHHVGLELLVNHKALDPARWTIQKVFYQGRYYDSLAQLEAQFEAGLVNVVLIPDNGTGGSWSLKSPVPPGPAPPLQFYPQGPRFSVQGSRVASSLWTFSFGLGAFSGPRIFDVRFQGERLVYEISLQEALAIYGGNSPAAMTTRYVDGGFGMGKYTTPLTRGVDCPYLATYVDWHFLLESQAPKTIRDAFCVFEQNQGLPLRRHHSDLYSHYFGGLAETVLVVRSMSTLLNYDYVWDTVFHPSGAIEIRFYATGYISSAFLFGATGKYGNQVSEHTLGTVHTHSAHFKVDLDVAGLENWVWAEDMVFVPMAVPWSPEHQLQRLQVTRKLLEMEEQAAFLVGSATPRYLYLASNHSNKWGHPRGYRIQMLSFAGEPLPQNSSMARGFSWERYQLAVTQRKEEEPSSSSVFNQNDPWAPTVDFSDFINNETIAGKDLVAWVTAGFLHIPHAEDIPNTVTVGNGVGFFLRPYNFFDEDPSFYSADSIYFRGDQDAGACEVNPLACLPQAAACAPDLPAFSHGGFSHN

SEQ ID NO: 5495 - protein, 710 aa, unidentified
MSVPSSLSQSAINANSHGGPALSLPLPLHAAHNQLLNAKLQATAVGPKDLRSAMGEGGGPEPGPANAKWLKEGQNQLRRAATAHRDQNRNVTLTLAEEASQEPEMAPLGPKGLIHLYSELELSAHNAANRGLRGPGLIISTQEQGPDEGEEKAAGEAEEEEEDDDDEEEEEDLSSPPGLPEPLESVEAPPRPQALTDGPREHSKSASLLFGMRNSAASDEDSSWATLSQGSPSYGSPEDTDSFWNPNAFETDSDLPAGWMRVQDTSGTYYWHIPTGTTQWEPPGRASPSQGSSPQEESQLTWTGFAHGEGFEDGEFWKDEPSDEAPMELGLKEPEEGTLTFPAQSLSPEPLPQEEEKLPPRNTNPGIKCFAVRSLGWVEMTEEELAPGRSSVAVNNCIRQLSYHKNNLHDPMSGGWGEGKDLLLQLEDETLKLVEPQSQALLHAQPIISIRVWGVGRDSGRERDFAYVARDKLTQMLKCHVFRCEAPAKNIATSLHEICSKIMAERRNARCLVNGLSLDHSKLVDVPFQVEFPAPKNELVQKFQVYYLGNVPVAKPVGVDVINGALESVLSSSSREQWTPSHVSVAPATLTILHQQTEAVLGECRVRFLSFLAVGRDVHTFAFIMAAGPASFCCHMFWCEPNAASLSEAVQAACMLRYQKCLDARSQASTSCLPAPPAESVARRVGWTVRRGVQSLWGSLKPKRLGAHTP

SEQ ID NO: 5496 - protein, 514 aa, unidentified; identical to SEQ ID NO: 407

SEQ ID NO: 5497 - protein, 223 aa, unidentified
MNKPLLWISVLTSLLEAFAHTDLSGKVFVFPRESVTDHVNLITPLEKPLQNFTLCFRAYSDLSRAYSLFSYNTQGRDNELLVYKERVGEYSLYIGRHKVTSKVIEKFPAPVHICVSWESSSGIAEFWINGTPLVKKGLRQGYFVEAQPKIVLGQEQDSYGGKFDRSQSFVGEIGDLYMWDSVLPPENILSAYQGTPLPANILDWQALNYEIRGYVIIKPLVWV

SEQ ID NO: 5498 - protein, 77 aa, unidentified
MNLRLCVQALLLLWLSLTAVCGGSLMPLPDGNGLEDGNVRHLVQPRGSRNGPGPWQGGRRKFRRQRPRLSHKGPMPF

SEQ ID NO: 5499 - protein, 763 aa, unidentified; identical to SEQ ID NO: 414

SEQ ID NO: 5500 - protein, 267 aa, unidentified
MKAAVLTLAVLFLTGSQARHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 5501 - protein, 100 aa, unidentified
MKLLAATVLLLTICSLEGALVRRQAKEPCVESLVSQYFQTVTDYGKDLMEKVKSPELQAEAKSYFEKSKEQLTPLIKKAGTELVNFLSYFVELGTQPATQ

SEQ ID NO: 5502 - protein, 366 aa, unidentified
MASMAAVLTWALALLSAFSATQARKGFWDYFSQTSGDKGRVEQIHQQKMAREPATLKDSLEQDLNNMNKFLEKLRPLSGSEAPRLPQDPVGMRRQLQEELEEVKARLQPYMAEAHELVGWNLEGLRQQLKPYTMDLMEQVALRVQELQEQLRVVGEDTKAQLLGGVDEAWALLQGLQSRVVHHTGRFKELFHPYAESLVSGIGRHVQELHRSVAPHAPASPARLSRCVQVLSRKLTLKAKALHARIQQNLDQLREELSRAFAGTGTEEGAGPDPQMLSEEVRQRLQAFRQDTYLQIAAFTRAIDQETEEVQQQLAPPPPGHSAFAPEFQQTDSGKVLSKLQARLDDLWEDITHSLHDQGHSHLGDP

SEQ ID NO: 5503 - protein, 4563 aa, unidentified
MDPPRPALLALLALPALLLLLLAGARAEEEMLENVSLVCPKDATRFKHLRKYTYNYEAESSSGVPGTADSRSATRINCKVELEVPQLCSFILKTSQCTLKEVYGFNPEGKALLKKTKNSEEFAAAMSRYELKLAIPEGKQVFLYPEKDEPTYILNIKRGIISALLVPPETEEAKQVLFLDTVYGNCSTHFTVKTRKGNVATEISTERDLGQCDRFKPIRTGISPLALIKGMTRPLSTLISSSQSCQYTLDAKRKHVAEAICKEQHLFLPFSYKNKYGMVAQVTQTLKLEDTPKINSRFFGEGTKKMGLAFESTKSTSPPKQAEAVLKTLQELKKLTISEQNIQRANLFNKLVTELRGLSDEAVTSLLPQLIEVSSPITLQALVQCGQPQCSTHILQWLKRVHANPLLIDVVTYLVALIPEPSAQQLREIFNMARDQRSRATLYALSHAVNNYHKTNPTGTQELLDIANYLMEQIQDDCTGDEDYTYLILRVIGNMGQTMEQLTPELKSSILKCVQSTKPSLMIQKAAIQALRKMEPKDKDQEVLLQTFLDDASPGDKRLAAYLMLMRSPSQADINKIVQILPWEQNEQVKNFVASHIANILNSEELDIQDLKKLVKEALKESQLPTVMDFRKFSRNYQLYKSVSLPSLDPASAKIEGNLIFDPNNYLPKESMLKTTLTAFGFASADLIEIGLEGKGFEPTLEALFGKQGFFPDSVNKALYWVNGQVPDGVSKVLVDHFGYTKDDKHEQDMVNGIMLSVEKLIKDLKSKEVPEARAYLRILGEELGFASLHDLQLLGKLLLMGARTLQGIPQMIGEVIRKGSKNDFFLHYIFMENAFELPTGAGLQLQISSSGVIAPGAKAGVKLEVANMQAELVAKPSVSVEFVTNMGIIIPDFARSGVQMNTNFFHESGLEAHVALKAGKLKFIIPSPKRPVKLLSGGNTLHLVSTTKTEVIPPLIENRQSWSVCKQVFPGLNYCTSGAYSNASSTDSASYYPLTGDTRLELELRPTGEIEQYSVSATYELQREDRALVDTLKFVTQAEGAKQTEATMTFKYNRQSMTLSSEVQIPDFDVDLGTILRVNDESTEGKTSYRLTLDIQNKKITEVALMGHLSCDTKEERKIKGVISIPRLQAEARSEILAHWSPAKLLLQMDSSATAYGSTVSKRVAWHYDEEKIEFEWNTGTNVDTKKMTSNFPVDLSDYPKSLHMYANRLLDHRVPQTDMTFRHVGSKLIVAMSSWLQKASGSLPYTQTLQDHLNSLKEFNLQNMGLPDFHIPENLFLKSDGRVKYTLNKNSLKIEIPLPFGGKSSRDLKMLETVRTPALHFKSVGFHLPSREFQVPTFTIPKLYQLQVPLLGVLDLSTNVYSNLYNWSASYSGGNTSTDHFSLRARYHMKADSVVDLLSYNVQGSGETTYDHKNTFTLSYDGSLRHKFLDSNIKFSHVEKLGNNPVSKGLLIFDASSSWGPQMSASVHLDSKKKQHLFVKEVKIDGQFRVSSFYAKGTYGLSCQRDPNTGRLNGESNLRFNSSYLQGTNQITGRYEDGTLSLTSTSDLQSGIIKNTASLKYENYELTLKSDTNGKYKNFATSNKMDMTFSKQNALLRSEYQADYESLRFFSLLSGSLNSHGLELNADILGTDKINSGAHKATLRIGQDGISTSATTNLKCSLLVLENELNAELGLSGASMKLTTNGRFREHNAKFSLDGKAALTELSLGSAYQAMILGVDSKNIFNFKVSQEGLKLSNDMMGSYAEMKFDHTNSLNIAGLSLDFSSKLDNIYSSDKFYKQTVNLQLQPYSLVTTLNSDLKYNALDLTNNGKLRLEPLKLHVAGNLKGAYQNNEIKHIYAISSAALSASYKADTVAKVQGVEFSHRLNTDIAGLASAIDMSTNYNSDSLHFSNVFRSVMAPFTMTIDAHTNGNGKLALWGEHTGQLYSKFLLKAEPLAFTFSHDYKGSTSHHLVSRKSISAALEHKVSALLTPAEQTGTWKLKTQFNNNEYSQDLDAYNTKDKIGVELTGRTLADLTLLDSPIKVPLLLSEPINIIDALEMRDAVEKPQEFTIVAFVKYDKNQDVHSINLPFFETLQEYFERNRQTIIVVLENVQRNLKHINIDQFVRKYRAALGKLPQQANDYLNSFNWERQVSHAKEKLTALTKKYRITENDIQIALDDAKINFNEKLSQLQTYMIQFDQYIKDSYDLHDLKIAIANIIDEIIEKLKSLDEHYHIRVNLVKTIHDLHLFIENIDFNKSGSSTASWIQNVDTKYQIRIQIQEKLQQLKRHIQNIDIQHLAGKLKQHIEAIDVRVLLDQLGTTISFERINDILEHVKHFVINLIGDFEVAEKINAFRAKVHELIERYEVDQQIQVLMDKLVELAHQYKLKETIQKLSNVLQQVKIKDYFEKLVGFIDDAVKKLNELSFKTFIEDVNKFLDMLIKKLKSFDYHQFVDETNDKIREVTQRLNGEIQALELPQKAEALKLFLEETKATVAVYLESLQDTKITLIINWLQEALSSASLAHMKAKFRETLEDTRDRMYQMDIQQELQRYLSLVGQVYSTLVTYISDWWTLAAKNLTDFAEQYSIQDWAKRMKALVEQGFTVPEIKTILGTMPAFEVSLQALQKATFQTPDFIVPLTDLRIPSVQINFKDLKNIKIPSRFSTPEFTILNTFHIPSFTIDFVEMKVKIIRTIDQMLNSELQWPVPDIYLRDLKVEDIPLARITLPDFRLPEIAIPEFIIPTLNLNDFQVPDLHIPEFQLPHISHTIEVPTFGKLYSILKIQSPLFTLDANADIGNGTTSANEAGIAASITAKGESKLEVLNFDFQANAQLSNPKINPLALKESVKFSSKYLRTEHGSEMLFFGNAIEGKSNTVASLHTEKNTLELSNGVIVKINNQLTLDSNTKYFHKLNIPKLDFSSQADLRNEIKTLLKAGHIAWTSSGKGSWKWACPRFSDEGTHESQISFTIEGPLTSFGLSNKINSKHLRVNQNLVYESGSLNFSKLEIQSQVDSQHVGHSVLTAKGMALFGEGKAEFTGRHDAHLNGKVIGTLKNSLFFSAQPFEITASTNNEGNLKVRFPLRLTGKIDFLNNYALFLSPSAQQASWQVSARFNQYKYNQNFSAGNNENIMEAHVGINGEANLDFLNIPLTIPEMRLPYTIITTPPLKDFSLWEKTGLKEFLKTTKQSFDLSVKAQYKKNKHRHSITNPLAVLCEFISQSIKSFDRHFEKNRNNALDFVTKSYNETKIKFDKYKAEKSHDELPRTFQIPGYTVPVVNVEVSPFTIEMSAFGYVFPKAVSMPSFSILGSDVRVPSYTLILPSLELPVLHVPRNLKLSLPDFKELCTISHIFIPAMGNITYDFSFKSSVITLNTNAELFNQSDIVAHLLSSSSSVIDALQYKLEGTTRLTRKRGLKLATALSLSNKFVEGSHNSTVSLTTKNMEVSVATTTKAQIPILRMNFKQELNGNTKSKPTVSSSMEFKYDFNSSMLYSTAKGAVDHKLSLESLTSYFSIESSTKGDVKGSVLSREYSGTIASEANTYLNSKSTRSSVKLQGTSKIDDIWNLEVKENFAGEATLQRIYSLWEHSTKNHLQLEGLFFTNGEHTSKATLELSPWQMSALVQVHASQPSSFHDFPDLGQEVALNANTKNQKIRWKNEVRIHSGSFQSQVELSNDQEKAHLDIAGSLEGHLRFLKNIILPVYDKSLWDFLKLDVTTSIGRRQHLRVSTAFVYTKNPNGYSFSIPVKVLADKFIIPGLKLNDLNSVLVMPTFHVPFTDLQVPSCKLDFREIQIYKKLRTSSFALNLPTLPEVKFPEVDVLTKYSQPEDSLIPFFEITVPESQLTVSQFTLPKSVSDGIAALDLNAVANKIADFELPTIIVPEQTIEIPSIKFSVPAGIVIPSFQALTARFEVDSPVYNATWSASLKNKADYVETVLDSTCSSTVQFLEYELNVLGTHKIEDGTLASKTKGTFAHRDFSAEYEEDGKYEGLQEWEGKAHLNIKSPAFTDLHLRYQKDKKGISTSAASPAVGTVGMDMDEDDDFSKWNFYYSPQSSPDKKLTIFKTELRVRESDEETQIKVNWEEEAASGLLTSLKDNVPKATGVLYDYVNKYHWEHTGLTLREVSSKLRRNLQNNAEWVYQGAIRQIDDIDVRFQKAASGTTGTYQEWKDKAQNLYQELLTQEGQASFQGLKDNVFDGLVRVTQEFHMKVKHLIDSLIDFLNFPRFQFPGKPGIYTREELCTMFIREVGTVLSQVYSKVHNGSEILFSYFQDLVITLPFELRKHKLIDVISMYRELLKDLSKEAQEVFKAIQSLKTTEVLRNLQDLLQFIFQLIEDNIKQLKEMKFTYLINYIQDEINTIFSDYIPYVFKLLKENLCLNLHKFNEFIQNELQEASQELQQIHQYIMALREEYFDPSIVGWTVKYYELEEKIVSLIKNLLVALKDFHSEYIVSASNFTSQLSSQVEQFLHRNIQEYLSILTDPDGKGKEKIAELSATAQEIIKSQAIATKKIISDYHQQFRYKLQDFSDQLSDYYEKFIAESKRLIDLSIQNYHTFLIYITELLKKLQSTTVMNPYMKLAPGELTIIL

SEQ ID NO: 5504 - protein, 83 aa, unidentified
MRLFLSLPVLVVVLSIVLEGPAPAQGTPDVSSALDKLKEFGNTLEDKARELISRIKQSELSAKMREWFSETFQKVKEKLKIDS

SEQ ID NO: 5505 - protein, 101 aa, unidentified
MGTRLLPALFLVLLVLGFEVQGTQQPQQDEMPSPTFLTQVKESLSSYWESAKTAAQNLYEKTYLPAVDEKLRDLYSKSTAAMSTYTGIFTDQVLSVLKGEE

SEQ ID NO: 5506 - protein, 99 aa, unidentified
MQPRVLLVVALLALLASARASEAEDASLLSFMQGYMKHATKTAKDALSSVQESQVAQQARGWVTDGFSSLKDYWSTVKDKFSEFWDLDPEVRPTSAVAA

SEQ ID NO: 5507 - protein, 127 aa, unidentified
MSLLRNRLQALPALCLCVLVLACIGACQPEAQEGTLSPPPKLKMSRWSLVRGRMKELLETVVNRTRDGWQWFWSPSTFRGFMQTYYDDHLRDLGPLTKAWFLESKDSLLKKTHSLCPRLVCGDKDQG

SEQ ID NO: 5508 - protein, 189 aa, unidentified
MVMLLLLLSALAGLFGAAEGQAFHLGKCPNPPVQENFDVNKYLGRWYEIEKIPTTFENGRCIQANYSLMENGKIKVLNQELRADGTVNQIEGEATPVNLTEPAKLEVKFSWFMPSAPYWILATDYENYALVYSCTCIIQLFHVDFAWILARNPNLPPETVDSLKNILTSNNIDVKKMTVTDQVNCPKLS

SEQ ID NO: 5509 - protein, 317 aa, unidentified [sequence omitted]

SEQ ID NO: 5510 - protein, 326 aa, unidentified
MTGLCGYSAPDMRGLRLIMIPVELLLCYLLLHPVDATSYGKQTNVLMHFPLSLESQTPSSDPLSCQFLHPKSLPGFSHMAPLPKFLVSLALRNALEEAGCQADVWALQLQLYRQGGVNATQVLIQHLRGLQKGRSTERNVSVEALASALQLLAREQQSTGRVGRSLPTEDCENEKEQAVHNVVQLLPGVGTFYNLGTALYYATQNCLGKARERGRDGAIDLGYDLLMTMAGMSGGPMGLAISAALKPALRSGVQQLIQYYQDQKDANISQPETTKEGLRAISDVSDLEETTTLASFISEVVSSAPYWGWAIIKSYDLDPGAGSLEI

SEQ ID NO: 5511 - protein, 345 aa, unidentified
MISPVLILFSSFLCHVAIAGRTCPKPDDLPFSTVVPLKTFYEPGEEITYSCKPGYVSRGGMRKFICPLTGLWPINTLKCTPRVCPFAGILENGAVRYTTFEYPNTISFSCNTGFYLNGADSAKCTEEGKWSPELPVCAPIICPPPSIPTFATLRVYKPSAGNNSLYRDTAVFECLPQHAMFGNDTITCTTHGNWTKLPECREVKCPFPSRPDNGFVNYPAKPTLYYKDKATFGCHDGYSLDGPEEIECTKLGNWSAMPSCKASCKVPVKKATVVYQGERVKIQEKFKNGMLHGDKVSFFCKNKEKKCSYTEDAQCIDGTIEVPKCFKEHSSLAFWKTDASDVKPC

SEQ ID NO: 5512 - protein, 398 aa, unidentified; identical to SEQ ID NO: 416

SEQ ID NO: 5513 - protein, 402 aa, unidentified
MGLGQGWGWEASCFACLIRSCCQVVTFTFPFGFQGISQSLENVSGYYADARLEVGSTQLRTAGSCSHSFKRSFLEKKRFTEEATKYFRERVSPVHLQILLTNNEAWKRFVTAAELPRDEADALYEALKKLRTYAAIEDEYVQQKDEQFREWFLKEFPQVKRKIQESIEKLRALANGIEEVHRGCTISNVVSSSTGAASGIMSLAGLVLAPFTAGTSLALTAAGVGLGAASAVTGITTSIVEHSYTSSAEAEASRLTATSIDRLKVFKEVMRDITPNLLSLLNNYYEATQTIGSEIRAIRQARARARLPVTTWRISAGSGGQAERTIAGTTRAVSRGARILSATTSGIFLALDVVNLVYESKHLHEGAKSASAEELRRQAQELEENLMELTQIYQRLNPCHTH

SEQ ID NO: 5514 - protein, 188 aa, unidentified
MFHQIWAALLYFYGIILNSIYQCPEHSQLTTLGVDGKEFPEVHLGQWYFIAGAAPTKEELATFDPVDNIVFNMAAGSAPMQLHLRATIRMKDGLCVPRKWIYHLTEGSTDLRTEGRPDMKTELFSSSCPGGIMLNETGQGYQRFLLYNRSPHPPEKCVEEFKSLTSCLDSKAFLLTPRNQEACELSNN

SEQ ID NO: 5515 - protein, 268 aa, unidentified
MAAIRMGKLTTMPAGLIYASVSVHAAKQEESKKQLVKPEQLPIYTAPPLQSKYVEEQPGHLQMGFASIRTATGCYIGWCKGVYVFVKNGIMDTVQFGKDAYVYLKNPPRDFLPKMGVITVSGLAGLVSARKGSKFKKITYPLGLATLGATVCYPVQSVIIAKVTAKKVYATSQQIFGAVKSLWTKSSKEESLPKPKEKTKLGSSSEIEVPAKTTHVLKHSVPLPTELSSEAKTKSESTSGATQFMPDPKLMDHGQSHPEDIDMYSTRS

SEQ ID NO: 5516 - protein, 511 aa, unidentified
MVLLAAAVCTKAGKAIVSRQFVEMTRTRIEGLLAAFPKLMNTGKQHTFVETESVRYVYQPMEKLYMVLITTKNSNILEDLETLRLFSRVIPEYCRALEENEISEHCFDLIFAFDEIVALGYRENVNLAQIRTFTEMDSHEEKVFRAVRETQEREAKAEMRRKAKELQQARRDAERQGKKAPGFGGFGSSAVSGGSTAAMITETIIETDKPKVAPAPARPSGPSKALKLGAKGKEVDNFVDKLKSEGETIMSSSMGKRTSEATKMHAPPINMESVHMKIEEKITLTCGRDGGLQNMELHGMIMLRISDDKYGRIRLHVENEDKKGVQLQTHPNVDKKLFTAESLIGLKNPEKSFPVNSDVGVLKWRLQTTEESFIPLTINCWPSESGNGCDVNIEYELQEDNLELNDVVITIPLPSGVGAPVIGEIDGEYRHDSRRNTLEWCLPVIDAKNKSGSLEFSIAGQPNDFFPVQVSFVSKKNYCNIQVTKVTQVDGNSPVRFSTETTFLVDKYEIL

SEQ ID NO: 5517 - protein, 341 aa, unidentified
MTDGILGKAATMEIPIHGNGEARQLPEDDGLEQDLQQVMVSGPNLNETSIVSGGYGGSGDGLIPTGSGRHPSHSTTPSGPGDEVARGIAGEKFDIVKKWGINTYKCTKQLLSERFGRGSRTVDLELELQIELLRETKRKYESVLQLGRALTAHLYSLLQTQHALGDAFADLSQKSPELQEEFGYNAETQKLLCKNGETLLGAVNFFVSSINTLVTKTMEDTLMTVKQYEAARLEYDAYRTDLEELSLGPRDAGTRGRLESAQATFQAHRDKYEKLRGDVAIKLKFLEENKIKVMHKQLLLFHNAVSAYFAGNQKQLEQTLQQFNIKLRPPGAEKPSWLEEQ

SEQ ID NO: 5518 - protein, 547 aa, unidentified
MGGCIPFLKAARALCPRIMPPLLLLSAFIFLVSVLGGAPGHNPDRRTKMVSIHSLSELERLKLQETAYHELVARHFLSEFKPDRALPIDRPNTLDKWFLILRGQQRAVSHKTFGISLEEVLVNEFTRRKHLELTATMQVEEATGQAAGRRRGNVVRRVFGRIRRFFSRRRNEPTLPREFTRRGRRGAVSVDSLAELEDGALLLQTLQLSKISFPIGQRLLGSKRKMSLNPIAKQIPQVVEACCQFIEKHGLSAVGIFTLEYSVQRVRQLREEFDQGLDVVLDDNQNVHDVAALLKEFFRDMKDSLLPDDLYMSFLLTATLKPQDQLSALQLLVYLMPPCHSDTLERLLKALHKITENCEDSIGIDGQLVPGNRMTSTNLALVFGSALLKKGKFGKRESRKTKLGIDHYVASVNVVRAMIDNWDVLFQVPPHIQRQVAKRVWKSSPEALDFIRRRNLRKIQSARIKMEEDALLSDPVETSAEARAAVLAQSKPSDEGSSEEPAVPSGTARSHDDEEGAGNPPIPEQDRPLLRVPREKEAKTGVSYFFP

SEQ ID NO: 5519 - protein, 1136 aa, unidentified
MFSRKKRELMKTPSISKKNRAGSPSPQPSGELPRKDGADAVFPGPSLEPPAGSSGVKATGTLKRPTSLSRHASAAGFPLSGAASWTLGRSHRSPLTAASPGELPTEGAGPDVVEDISHLLADVARFAEGLEKLKECVLRDDLLEARRPRAHECLGEALRVMHQIISKYPLLNTVETLTAAGTLIAKVKAFHYESNNDLEKQEFEKALETIAVAFSSTVSEFLMGEVDSSTLLAVPPGDSSQSMESLYGPGSEGTPPSLEDCDAGCLPAEEVDVLLQRCEGGVDAALLYAKNMAKYMKDLISYLEKRTTLEMEFAKGLQKIAHNCRQSVMQEPHMPLLSIYSLALEQDLEFGHSMVQAVGTLQTQTFMQPLTLRRLEHEKRRKEIKEAWHRAQRKLQEAESNLRKAKQGYVQRCEDHDKARFLVAKAEEEQAGSAPGAGSTATKTLDKRRRLEEEAKNKAEEAMATYRTCVADAKTQKQELEDTKVTALRQIQEVIRQSDQTIKSATISYYQMMHMQTAPLPVHFQMLCESSKLYDPGQQYASHVRQLQRDQEPDVHYDFEPHVSANAWSPVMRARKSSFNVSDVARPEAAGSPPEEGGCTEGTPAKDHRAGRGHQVHKSWPLSISDSDSGLDPGPGAGDFKKFERTSSSGTMSSTEELVDPDGGAGASAFEQADLNGMTPELPVAVPSGPFRHEGLSKAARTHRLRKLRTPAKCRECNSYVYFQGAECEECCLACHKKCLETLAIQCGHKKLQGRLQLFGQDFSHAARSAPDGVPFIVKKCVCEIERRALRTKGIYRVNGVKTRVEKLCQAFENGKELVELSQASPHDISNVLKLYLRQLPEPLISFRLYHELVGLAKDSLKAEAEAKAASRGRQDGSESEAVAVALAGRLRELLRDLPPENRASLQYLLRHLRRIVEVEQDNKMTPGNLGIVFGPTLLRPRPTEATVSLSSLVDYPHQARVIETLIVHYGLVFEEEPEETPGGQDESSNQRAEVVVQVPYLEAGEAVVYPLQEAAADGCRESRVVSNDSDSDLEEASELLSSSEASALGHLSFLEQQQSEASLEVASGSHSGSEEQLEATAREDGDGDEDGPAQQLSGFNTNQSNNVLQAPLPPMRLRGGRMTLGSCRERQPEFV

SEQ ID NO: 5520 - protein, 974 aa, unidentified
MSAQSLLHSVFSCSSPASSSAASAKGFSKRKLRQTRSLDPALIGGCGSDEAGAEGSARGATAGRLYSPSLPAESLGPRLASSSRGPPPRATRLPPPGPLCSSFSTPSTPQEKSPSGSFHFDYEVPLGRGGLKKSMAWDLPSVLAGPASSRSASSILCSSGGGPNGIFASPRRWLQQRKFQSPPDSRGHPYVVWKSEGDFTWNSMSGRSVRLRSVPIQSLSELERARLQEVAFYQLQQDCDLSCQITIPKDGQKRKKSLRKKLDSLGKEKNKDKEFIPQAFGMPLSQVIANDRAYKLKQDLQRDEQKDASDFVASLLPFGNKRQNKELSSSNSSLSSTSETPNESTSPNTPEPAPRARRRGAMSVDSITDLDDNQSRLLEALQLSLPAEAQSKKEKARDKKLSLNPIYRQVPRLVDSCCQHLEKHGLQTVGIFRVGSSKKRVRQLREEFDRGIDVSLEEEHSVHDVAALLKEFLRDMPDPLLTRELYTAFINTLLLEPEEQLGTLQLLIYLLPPCNCDTLHRLLQFLSIVARHADDNISKDGQEVTGNKMTSLNLATIFGPNLLHKQKSSDKEFSVQSSARAEESTAIIAVVQKMIENYEALFMVPPDLQNEVLISLLETDPDVVDYLLRRKASQSSSPDMLQSEVSFSVGGRHSSTDSNKASSGDISPYDNNSPVLSERSLLAMQEDAAPGGSEKLYRVPGQFMLVGHLSSSKSRESSPGPRLGKDLSEEPFDIWGTWHSTLKSGSKDPGMTGSSGDIFESSSLRAGPCSLSQGNLSPNWPRWQGSPAELDSDTQGARRTQAAAPATEGRAHPAVSRACSTPHVQVAGKAERPTARSEQYLTLSGAHDLSESELDVAGLQSRATPQCQRPHGSGRDDKRPPPPYPGPGKPAAAAAWIQGPPEGVETPTDQGGQAAEREQQVTQKKLSSANSLPAGEQDSPRLGDAGWLDWQRERWQIWELLSTDNPDALPETLV

SEQ ID NO: 5521 - protein, 197 aa, unidentified
MRVAGGRALSRGAELRVPGGAKHGMCLLLGATGVGKTLLVKRLQEVSSRDGKGDLGEPPPTRPTVGTNLTDIVAQRKITIRELGGCMGPIWSSYYGNCRSLLFVMDASDPTQLSASCVQLLGLLSAEQLAEASVLILFNKIDLPCYMSTEEMKSLIRLPDIIACAKQNITTAEISAREGTGLAGVLAWLQATHRAND

SEQ ID NO: 5522 - protein, 935 aa, unidentified
MAAAKPTLTDSLSFCLAQLAAAAGEALGGEKDPATNETPLSRALLALRTRHIKAAGGIERFRARGGLRPLLALLRRAAAAGSAPSQAGPGSAPSSAASGASSPAPASGPAPSAVSSSSPTPPVRLRKTLDLALSILADCCTEGACRTEVRRLGGILPLVTILQCMKTDSIQNRTARALGNLAMEPESCGDIHCAGAVPLLVESLTACQDSQCLQSVVRALRNLADSPQHRLALAQQGAVRPLAELLATAPDAALTLALVRALLELSRGCSRACAEQLSLGGGLGPLVSLASHPKRAVREGTILILANLCAQGLIRPALGNAGGVEVLVDELRQRRDPNGASPTSQQPLVRAVCLLCREAINRARLRDAGGLDLLMGLLRDPRASAWHPRIVAALVGFLYDTGALGRLQALGLVPLLAGQLCGEAGEEEEEGREAASWDFPEERTPERAQGGSFRSLRSWLISEGYATGPDDISPDWSPEQCPPEPMEPASPAPTPTSLRAPRTQRTPGRSPAAAIEEPWGREGPALLLLSRFSQAPDPSGALVTGPALYGLLTYVTGAPGPPSPRALRILSRLTCNPACLEAFVRSYGAALLRAWLVLGVAPDDWPAPRARPTLHSRHRELGERLLQNLTVQAESPFGVGALTHLLLSGSPEDRVACALTLPFICRKPSLWRRLLLEQGGLRLLLAALTRPAPHPLFLFFAADSLSCLQDLVSPTVSPAVPQAVPMDLDSPSPCLYEPLLGPAPVPAPDLHFLLDSGLQLPAQRAASATASPFFRALLSGSFAEAQMDLVPLRGLSPGAAWPVLHHLHGCRGCGAALGPVPPPGQPLLGSEAEEALEAAGRFLLPGLEEELEEAVGRIHLGPQGGPESVGEVFRLGRPRLAAHCARWTLGSEQCPRKRGLALVGLVEAAGEEAGPLTEALLAVVMGIELGARVPA

SEQ ID NO: 5523 - protein, 626 aa, unidentified
MADQRMDISSTISDFMSPGPTDLLSSSLGTSGVDCNRKRKGSSTDYQESMDTDKDDPHGRLEYTEHQGRIKNAREAHSQIEKRRRDKMNSFIDELASLVPTCNAMSRKLDKLTVLRMAVQHMKTLRGATNPYTEANYKPTFLSDDELKHLILRAADGFLFVVGCDRGKILFVSESVFKILNYSQNDLIGQSLFDYLHPKDIAKVKEQLSSSDTAPRERLIDAKTGLPVKTDITPGPSRLCSGARRSFFCRMKCNRPSVKVEDKDFPSTCSKKKADRKSFCTIHSTGYLKSWPPTKMGLDEDNEPDNEGCNLSCLVAIGRLHSHVVPQPVNGEIRVKSMEYVSRHAIDGKFVFVDQRATAILAYLPQELLGTSCYEYFHQDDIGHLAECHRQVLQTREKITTNCYKFKIKDGSFITLRSRWFSFMNPWTKEVEYIVSTNTVVLANVLEGGDPTFPQLTASPHSMDSMLPSGEGGPKRTHPTVPGIPGGTRAGAGKIGRMIAEEIMEIHRIRGSSPSSCGSSPLNITSTPPPDASSPGGKKILNGGTPDIPSSGLLSGQAQENPGYPYSDSSSILGENPHIGIDMIDNDQGSSSPSNDEAAMAVIMSLLEADAGLGGPVDFSDLPWPL

SEQ ID NO: 5524 - protein, 507 aa, unidentified
MGAPRSLLLALAAGLAVARPPNIVLIFADDLGYGDLGCYGHPSSTTPNLDQLAAGGLRFTDFYVPVSLCTPSRAALLTGRLPVRMGMYPGVLVPSSRGGLPLEEVTVAEVLAARGYLTGMAGKWHLGVGPEGAFLPPHQGFHRFLGIPYSHDQGPCQNLTCFPPATPCDGGCDQGLVPIPLLANLSVEAQPPWLPGLEARYMAFAHDLMADAQRQDRPFFLYYASHHTHYPQFSGQSFAERSGRGPFGDSLMELDAAVGTLMTAIGDLGLLEETLVIFTADNGPETMRMSRGGCSGLLRCGKGTTYEGGVREPALAFWPGHIAPGVTHELASSLDLLPTLAALAGAPLPNVTLDGFDLSPLLLGTGKSPRQSLFFYPSYPDEVRGVFAVRTGKYKAHFFTQGSAHSDTTADPACHASSSLTAHEPPLLYDLSKDPGENYNLLGGVAGATPEVLQALKQLQLLKAQLDAAVTFGPSQVARGEDPALQICCHPGCTPRPACCHCPDPHA

SEQ ID NO: 5525 - protein, 533 aa, unidentified
MGPRGAASLPRGPGPRRLLLPVVLPLLLLLLLAPPGSGAGASRPPHLVFLLADDLGWNDVGFHGSRIRTPHLDALAAGGVLLDNYYTQPLCTPSRSQLLTGRYQIRTGLQHQIIWPCQPSCVPLDEKLLPQLLKEAGYTTHMVGKWHLGMYRKECLPTRRGFDTYFGYLLGSEDYYSHERCTLIDALNVTRCALDFRDGEEVATGYKNMYSTNIFTKRAIALITNHPPEKPLFLYLALQSVHEPLQVPEEYLKPYDFIQDKNRHHYAGMVSLMDEAVGNVTAALKSSGLWNNTVFIFSTDNGGQTLAGGNNWPLRGRKWSLWEGGVRGVGFVASPLLKQKGVKNRELIHISDWLPTLVKLARGHTNGTKPLDGFDVWKTISEGSPSPRIELLHNIDPNFVDSSPCPRNSMAPAKDDSSLPEYSAFNTSVHAAIRHGNWKLLTGYPGCGYWFPPPSQYNVSEIPSSDPPTKTLWLFDIDRDPEERHDLSREYPHIVTKLLSRLQFYHKHSVPVYFPAQDPRCDPKATGVWGPWM

SEQ ID NO: 5526 - protein, 589 aa, unidentified; identical to SEQ ID NO: 452

SEQ ID NO: 5527 - protein, 525 aa, unidentified
MGWLFLKVLLAGVSFSGFLYPLVDFCISGKTRGQKPNFVIILADDMGWGDLGANWAETKDTANLDKMASEGMRFVDFHAAASTCSPSRASLLTGRLGLRNGVTRNFAVTSVGGLPLNETTLAEVLQQAGYVTGIIGKWHLGHHGSYHPNFRGFDYYFGIPYSHDMGCTDTPGYNHPPCPACPQGDGPSRNLQRDCYTDVALPLYENLNIVEQPVNLSSLAQKYAEKATQFIQRASTSGRPFLLYVALAHMHVPLPVTQLPAAPRGRSLYGAGLWEMDSLVGQIKDKVDHTVKENTFLWFTGDNGPWAQKCELAGSVGPFTGFWQTRQGGSPAKQTTWEGGHRVPALAYWPGRVPVNVTSTALLSVLDIFPTVVALAQASLPQGRRFDGVDVSEVLFGRSQPGHRVLFHPNSGAAGEFGALQTVRLERYKAFYITGGARACDGSTGPELQHKFPLIFNLEDDTAEAVPLERGGAEYQAVLPEVRKVLADVLQDIANDNISSADYTQDPSVTPCCNPYQIACRCQAA

SEQ ID NO: 5528 - protein, 569 aa, unidentified
MHTLTGFSLVSLLSFGYLSWDWAKPSFVADGPGEAGEQPSAAPPQPPHIIFILTDDQGYHDVGYHGSDIETPTLDRLAAKGVKLENYYIQPICTPSRSQLLTGRYQIHTGLQHSIIRPQQPNCLPLDQVTLPQKLQEAGYSTHMVGKWHLGFYRKECLPTRRGFDTFLGSLTGNVDYYTYDNCDGPGVCGFDLHEGENVAWGLSGQYSTMLYAQRASHILASHSPQRPLFLYVAFQAVHTPLQSPREYLYRYRTMGNVARRKYAAMVTCMDEAVRNITWALKRYGFYNNSVIIFSSDNGGQTFSGGSNWPLRGRKGTYWEGGVRGLGFVHSPLLKRKQRTSRALMHITDWYPTLVGLAGGTTSAADGLDGYDVWPAISEGRASPRTEILHNIDPLYNHAQHGSLEGGFGIWNTAVQAAIRVGEWKLLTGDPGYGDWIPPQTLATFPGSWWNLERMASVRQAVWLFNISADPYEREDLAGQRPDVVRTLLARLAEYNRTAIPVRYPAENPRAHPDFNGGAWGPWASDEEEEEEEGRARSFSRGRRKKKCKICKLRSFFRKLNTRLMSQRI

SEQ ID NO: 5529 - protein, 536 aa, unidentified
MLLLWVSVVAALALAVLAPGAGEQRRRAAKAPNVVLVVSDSFDGRLTFHPGSQVVKLPFINFMKTRGTSFLNAYTNSPICCPSRAAMWSGLFTHLTESWNNFKGLDPNYTTWMDVMERHGYRTQKFGKLDYTSGHHSISNRVEAWTRDVAFLLRQEGRPMVNLIRNRTKVRVMERDWQNTDKAVNWLRKEAINYTEPFVIYLGLNLPHPYPSPSSGENFGSSTFHTSLYWLEKVSHDAIKIPKWSPLSEMHPVDYYSSYTKNCTGRFTKKEIKNIRAFYYAMCAETDAMLGEIILALHQLDLLQKTIVIYSSDHGELAMEHRQFYKMSMYEASAHVPLLMMGPGIKAGLQVSNVVSLVDIYPTMLDIAGIPLPQNLSGYSLLPLSSETFKNEHKVKNLHPPWILSEFHGCNVNASTYMLRTNHWKYIAYSDGASILPQLFDLSSDPDELTNVAVKFPEITYSLDQKLHSIINYPKVSASVHQYNKEQFIKWKQSIGQNYSNVIANLRWHQDWQKEPRKYENAIDQWLKTHMNPRAV

SEQ ID NO: 5530 - protein, 389 aa, unidentified; identical to SEQ ID NO: 456

SEQ ID NO: 5531 - protein, 314 aa, unidentified; identical to SEQ ID NO: 457

SEQ ID NO: 5532 - protein, 291 aa, unidentified
MALAALMIALGSLGLHTWQAQAVPILPLGLAPDTFDDTYVGCAEEMEEKAAPLLKEEMAHHALLRESWEAAQETWEDKRRGLTLPPGFKAQNGIAIMVYTNSSNTLYWELNQAVRTGGGSRELYMRHFPFKALHFYLIRALQLLRGSGGCSRGPGEVVFRGVGSLRFEPKRLGDSVRLGQFASSSLDKAVAHRFGNATLFSLTTCFGAPIQAFSVFPKEREVLIPPHEVFLVTRFSQDGAQSLVTLWSYNQTCSHFNCAYLGGEKRRGCVSAPGALGTGDLHMTKRHLQQP

SEQ ID NO: 5533 - protein, 220 aa, unidentified
MELGLGGLSTLSHCPWPRQQPALWPTLAALALLSSVAEASLGSAPRSPAPREGPPPVLASPAGHLPGGRTARWCSGRARRPPPQPSRPAPPPPAPPSALPRGGRAARAGGPGSRARAAGARGCRLRSQLVPVRALGLGHRSDELVRFRFCSGSCRRARSPHDLSLASLLGAGALRPPPGSRPVSQPCCRPTRYEAVSFMDVNSTWRTVDRLSATACGCLG

SEQ ID NO: 5534 - protein, 395 aa, unidentified
MPGRSCVALVLLAAAVSCAVAQHAPPWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 5535 - protein, 780 aa, unidentified
MAKRTFSNLETFLIFLLVMMSAITVALLSLLFITSGTIENHKDLGGHFFSTTQSPPATQGSTAAQRSTATQHSTATQSSTATQTSPVPLTPESPLFQNFSGYHIGVGRADCTGQVADINLMGYGKSGQNAQGILTRLYSRAFIMAEPDGSNRTVFVSIDIGMVSQRLRLEVLNRLQSKYGSLYRRDNVILSGTHTHSGPAGYFQYTVFVIASEGFSNQTFQHMVTGILKSIDIAHTNMKPGKIFINKGNVDGVQINRSPYSYLQNPQSERARYSSNTDKEMIVLKMVDLNGDDLGLISWFAIHPVSMNNSNHLVNSDNVGYASYLLEQEKNKGYLPGQGPFVAAFASSNLGDVSPNILGPRCINTGESCDNANSTCPIGGPSMCIAKGPGQDMFDSTQIIGRAMYQRAKELYASASQEVTGPLASAHQWVDMTDVTVWLNSTHASKTCKPALGYSFAAGTIDGVGGLNFTQGKTEGDPFWDTIRDQILGKPSEEIKECHKPKPILLHTGELSKPHPWHPDIVDVQIITLGSLAITAIPGEFTTMSGRRLREAVQAEFASHGMQNMTVVISGLCNVYTHYITTYEEYQAQRYEAASTIYGPHTLSAYIQLFRNLAKAIATDTVANLSRGPEPPFFKQLIVPLIPSIVDRAPKGRTFGDVLQPAKPEYRVGEVAEVIFVGANPKNSVQNQTHQTFLTVEKYEATSTSWQIVCNDASWETRFYWHKGLLGLSNATVEWHIPDTAQPGIYRIRYFGHNRKQDILKPAVILSFEGTSPAFEVVTI

SEQ ID NO: 5536 - protein, 236 aa, unidentified
MESSAKMESGGAGQQPQPQPQQPFLPPAACFFATAAAAAAAAAAAAAQSAQQQQQQQQQQQQAPQLRPAADGQPSGGGHKSAPKQVKRQRSSSPELMRCKRRLNFSGFGYSLPQQQPAAVARRNERERNRVKLVNLGFATLREHVPNGAANKKMSKVETLRSAVEYIRALQQLLDEHDAVSAAFQAGVLSPTISPNYSNDLNSMAGSPVSSYSSDEGSYDPLSPEEQELLDFTNWF

SEQ ID NO: 5537 - protein, 132 aa, unidentified
MDVTRLLLATLLVFLCFFTANSHLPPEEKLRDDRSLRSNSSVNLLDVPSVSIVALNKKSKQIGRKAAEKKRSSKKEASMKKVVRPRTPLSAPCVATRNSCKPPAPACCDPCASCQCRFFRSACSCRVLSLNC

SEQ ID NO: 5538 - protein, 380 aa, unidentified
MKEYVLLLFLALCSAKPFFSPSHIALKNMMLKDMEDTDDDDDDDDDDDDDDEDNSLFPTREPRSHFFPFDLFPMCPFGCQCYSRVVHCSDLGLTSVPTNIPFDTRMLDLQNNKIKEIKENDFKGLTSLYGLILNNNKLTKIHPKAFLTTKKLRRLYLSHNQLSEIPLNLPKSLAELRIHENKVKKIQKDTFKGMNALHVLEMSANPLDNNGIEPGAFEGVTVFHIRIAEAKLTSVPKGLPPTLLELHLDYNKISTVELEDFKRYKELQRLGLGNNKITDIENGSLANIPRVREIHLENNKLKKIPSGLPELKYLQIIFLHSNSIARVGVNDFCPTVPKMKKSLYSAISLFNNPVKYWEMQPATFRCVLSRMSVQLGNFGM

SEQ ID NO: 5539 - protein, 431 aa, unidentified
MEGVGGLWPWVLGLLSLPGVILGAPLASSCAGACGTSFPDGLTPEGTQASGDKDIPAINQGLILEETPESSFLIEGDIIRPSPFRLLSATSNKWPMGGSGVVEVPFLLSSKYDEPSRQVILEALAEFERSTCIRFVTYQDQRDFISIIPMYGCFSSVGRSGGMQVVSLAPTCLQKGRGIVLHELMHVLGFWHEHTRADRDRYIRVNWNEILPGFEINFIKSQSSNMLTPYDYSSVMHYGRLAFSRRGLPTITPLWAPSVHIGQRWNLSASDITRVLKLYGCSPSGPRPRGRGSHAHSTGRSPAPASLSLQRLLEALSAESRSPDPSGSSAGGQPVPAGPGESPHGWESPALKKLSAEASARQPQTLASSPRSRPGAGAPGVAQEQSWLAGVSTKPTVPSSEAGIQPVPVQGSPALPGGCVPRNHFKGMSED

SEQ ID NO: 5540 - protein, 1844 aa, unidentified
MVGVLAMAAAAAPPPVKDCEIEPCKKRKKDDDTSTCKTITKYLSPLGKTRDRVFAPPKPSNILDYFRKTSPTNEKTQLGKECKIKSPESVPVDSNKDCTTPLEMFSNVEFKKKRKRVNLSHQLNNIKTENEAPIEISSDDSKEDYSLNNDFVESSTSVLRYKKQVEVLAENIQDTKSQPNTMTSLQNSKKVNPKQGTTKNDFKKLRKRKCRDVVDLSESLPLAEELNLLKKDGKDTKQMENTTSHANSRDNVTEAAQLNDSIITVSYEEFLKSHKENKVEEIPDSTMSICVPSETVDEIVKSGYISESENSEISQQVRFKTVTVLAQVHPIPPKKTGKIPRIFLKQKQFEMENSLSDPENEQTVQKRKSNVVIQEEELELAVLEAGSSEAVKPKCTLEERQQFMKAFRQPASDALKNGVKKSSDKQKDLNEKCLYEVGRDDNSKKIMENSGIQMVSKNGNLQLHTDKGSFLKEKNKKLKKKNKKTLDTGAIPGKNREGNTQKKETTFFLKEKQYQNRMSLRQRKTEFFKSSTLFNNESLVYEDIANDDLLKVSSLCNNNKLSRKTSIPVKDIKLTQSKAESEASLLNVSTPKSTRRSGRISSTPTTETIRGIDSDDVQDNSQLKASTQKAANLSEKHSLYTAELITVPFDSESPIRMKFTRISTPKKSKKKSNKRSEKSEATDGGFTSQIRKASNTSKNISKAKQLIEKAKALHISRSKVTEEIAIPLRRSSRHQTLPERKKLSETEDSVIIIDSSPTALKHPEKNQKKLQCLNDVLGKKLNTSTKNVPGKMKVAPLFLVRKAQKAADPVPSFDESSQDTSEKSQDCDVQCKAKRDFLMSGLPDLLKRQIAKKAAALDVYNAVSTSFQRVVHVQQKDDGCCLWHLKPPSCPLLTKFKELNTKVIDLSKCGIALGEFSTLNSKLKSGNSAAVFMRTRKEFTEEVRNLLLEEIRWSNPEFSLKKYFPLLLKKQIEHQVLSSECHSKQELEADVSHKETKRKLVEAENSKSKRKKPNEYSKNLEKTNRKSEELSKRNNSSGIKLDSSKDSGTEDMLWTEKYQPQTASELIGNELAIKKLHSWLKDWKRRAELEERQNLKGKRDEKHEDFSGGIDFKGSSDDEEESRLCNTVLITGPTGVGKTAAVYACAQELGFKIFEVNASSQRSGRQILSQLKEATQSHQVDKQGVNSQKPCFFNSYYIGKSPKKISSPKKVVTSPRKVPPPSPKSSGPKRALPPKTLANYFKVSPKPKNNEEIGMLLENNKGIKNSFEQKQITQTKSTNATNSNVKDVGAEEPSRKNATSLILFEEVDVIFDEDAGFLNAIKTFMATTKRPVILTTSDPTFSLMFDGCFEEIKFSTPSLLNVASYLQMICLTENFRTDVKDFVTLLTANTCDIRKSILYLQFWIRSGGGVLEERPLTLYRGNSRNVQLVCSEHGLDNKIYPKNTKKKRVDLPKCDSGCAETLFGLKNIFSPSEDLFSFLKHKITMKEEWHKFIQLLTEFQMRNVDFLYSNLEFILPLPVDTIPETKNFCGPSVTVDASAATKSMNCLARKHSEREQPLKKSQKKKQKKTLVILDDSDLFDTDLDFPDQSISLSSVSSSSNAEESKTGDEESKARDKGNNPETKKSIPCPPKTTAGKKCSALVSHCLNSLSEFMDNMSFLDALLTDVREQNKYGRNDFSWTNGKVTSGLCDEFSLESNDGWTSQSSGELKAAAEALSFTKCSSAISKALETLNSCKKLGRDPTNDLTFYVSQKRNNVYFSQSAANLDNAWKRISVIKSVFSSRSLLYVGNRQASIIEYLPTLRNICKTEKLKEQGKSKRRFLHYFEGIHLDIPKETVNTLAADFP

SEQ ID NO: 5541 - protein, 421 aa, unidentified
MEFPFDVDALFPERITVLDQHLRPPARRPGTTTPARVDLQQQIMTIIDELGKASAKAQNLSAPITSASRMQSNRHVVYILKDSSARPAGKGAIIGFIKVGYKKLFVLDDREAHNEVEPLCILDFYIHESVQRHGHGRELFQYMLQKERVEPHQLAIDRPSQKLLKFLNKHYNLETTVPQVNNFVIFEGFFAHQHRPPAPSLRATRHSRAAAVDPTPAAPARKLPPKRAEGDIKPYSSSDREFLKVAVEPPWPLNRAPRRATPPAHPPPRSSSLGNSPERGPLRPFVPEQELLRSLRLCPPHPTARLLLAADPGGSPAQRRRTRGTPPGLVAQSCCYSRHGGVNSSSPNTGNQDSKQGEQETKNRSASEEQALSQDGSGEKPMHTAPPQAPAPPAQSWTVGGDILNARFIRNLQERRSTRPW

SEQ ID NO: 5542 - protein, 1938 aa, unidentified
MSRWLWPWSNCVKERVCRYLLHHYLGHFFQEHLSLDQLSLDLYKGSVALRDIHLEIWSVNEVLESMESPLELVEGFVGSIEVAVPWAALLTDHCTVRVSGLQLTLQPRRGPAPGAADSQSWASCMTTSLQLAQECLRDGLPEPSEPPQPLEGLEMFAQTIETVLRRIKVTFLDTVVRVEHSPGDGERGVAVEVRVQRLEYCDEAVRDPSQAPPVDVHQPPAFLHKLLQLAGVRLHYEELPAQEEPPEPPLQIGSCSGYMELMVKLKQNEAFPGPKLEVAGQLGSLHLLLTPRQLQQLQELLSAVSLTDHEGLADKLNKSRPLGAEDLWLIEQDLNQQLQAGAVAEPLSPDPLTNPLLNLDNTDLFFSMAGLTSSVASALSELSLSDVDLASSVRSDMASRRLSAQAHPAGKMAPNPLLDTMRPDSLLKMTLGGVTLTLLQTSAPSSGPPDLATHFFTEFDATKDGPFGSRDFHHLRPRFQRACPCSHVRLTGTAVQLSWELRTGSRGRRTTSMEVHFGQLEVLECLWPRGTSEPEYTEILTFPGTLGSQASARPCAHLRHTQILRRVPKSRPRRSVACHCHSELALDLANFQADVELGALDRLAALLRLATVPAEPPAGLLTEPLPAMEQQTVFRLSAPRATLRLRFPIADLRPEPDPWAGQAVRAEQLRLELSEPQFRSELSSGPGPPVPTHLELTCSDLHGIYEDGGKPPVPCLRVSKALDPKSTGRKYFLPQVVVTVNPQSSSTQWEVAPEKGEELELSVESPCELREPEPSPFSSKRTMYETEEMVIPGDPEEMRTFQSRTLALSRCSLEVILPSVHIFLPSKEVYESIYNRINNDLLMWEPADLLPTPDPAAQPSGFPGPSGFWHDSFKMCKSAFKLANCFDLTPDSDSDDEDAHFFSVGASGGPQAAAPEAPSLHLQSTFSTLVTVLKGRITALCETKDEGGKRLEAVHGELVLDMEHGTLFSVSQYCGQPGLGYFCLEAEKATLYHRAAVDDYPLPSHLDLPSFAPPAQLAPTIYPSEEGVTERGASGRKGQGRGPHMLSTAVRIHLDPHKNVKEFLVTLRLHKATLRHYMALPEQSWHSQLLEFLDVLDDPVLGYLPPTVITILHTHLFSCSVDYRPLYLPVRVLITAETFTLSSNIIMDTSTFLLRFILDDSALYLSDKCEVETLDLRRDYVCVLDVDLLELVIKTWKGSTEGKLSQPLFELRCSNNVVHVHSCADSCALLVNLLQYVMSTGDLHPPPRPPSPTEIAGQKLSESPASLPSCPPVETALINQRDLADALLDTERSLRELAQPSGGHLPQASPISVYLFPGERSGAPPPSPPVGGPAGSLGSCSEEKEDEREEEGDGDTLDSDEFCILDAPGLGIPPRDGEPVVTQLHPGPIVVRDGYFSRPIGSTDLLRAPAHFPVPSTRVVLREVSLVWHLYGGRDFGPHPGHRARTGLSGPRSSPSRCSGPNRPQNSWRTQGGSGRQHHVLMEIQLSKVSFQHEVYPAEPATGPAAPSQELEERPLSRQVFIVQELEVRDRLASSQINKFLYLHTSERMPRRAHSNMLTIKALHVAPTTNLGGPECCLRVSLMPLRLNVDQDALFFLKDFFTSLVAGINPVVPGETSAEARPETRAQPSSPLEGQAEGVETTGSQEAPGGGHSPSPPDQQPIYFREFRFTSEVPIWLDYHGKHVTMDQVGTFAGLLIGLAQLNCSELKLKRLCCRHGLLGVDKVLGYALNEWLQDIRKNQLPGLLGGVGPMHSVVQLFQGFRDLLWLPIEQYRKDGRLMRGLQRGAASFGSSTASAALELSNRLVQAIQATAETVYDILSPAAPVSRSLQDKRSARRLRRGQQPADLREGVAKAYDTVREGILDTAQTICDVASRGHEQKGLTGAVGGVIRQLPPTVVKPLILATEATSSLLGGMRNQIVPDAHKDHALKWRSDSAQD

SEQ ID NO: 5543 - protein, 275 aa, unidentified
MTDDKDVLRDVWFGRIPTCFTLYQDEITEREAEPYYLLLPRVSYLTLVTDKVKKHFQKVMRQEDISEIWFEYEGTPLKWHYPIGLLFDLLASSSALPWNITVHFKSFPEKDLLHCPSKDAIEAHFMSCMKEADALKHKSQVINEMQKKDHKQLWMGLQNDRFDQFWAINRKLMEYPAEENGFRYIPFRIYQTTTERPFIQKLFRPVAADGQLHTLGDLLKEVCPSAIDPEDGEKKNQVMIHGIEPMLETPLQWLSEHLSYPDNFLHISIIPQPTD

SEQ ID NO: 5544 - protein, 823 aa, unidentified
MAASEAAAAAGSAALAAGARAVPAATTGAAAAASGPWVPPGPRLRGSRPRPAGATQQPAVPAPPAGELIQPSVSELSRAVRTNILCTVRGCGKILPNSPALNMHLVKSHRLQDGIVNPTIRKDLKTGPKFYCCPIEGCPRGPERPFSQFSLVKQHFMKMHAEKKHKCSKCSNSYGTEWDLKRHAEDCGKTFRCTCGCPYASRTALQSHIYRTGHEIPAEHRDPPSKKRKMENCAQNQKLSNKTIESLNNQPIPRPDTQELEASEIKLEPSFEDSCGSNTDKQTLTTPPRYPQKLLLPKPKVALVKLPVMQFSVMPVFVPTADSSAQPVVLGVDQGSATGAVHLMPLSVGTLILGLDSEACSLKESLPLFKIANPIAGEPISTGVQVNFGKSPSNPLQELGNTCQKNSISSINVQTDLSYASQNFIPSAQWATADSSVSSCSQTDLSFDSQVSLPISVHTQTFLPSSKVTSSIAAQTDAFMDTCFQSGGVSRETQTSGIESPTDDHVQMDQAGMCGDIFESVHSSYNVATGNIISNSLVAETVTHSLLPQNEPKTLNQDIEKSAPIINFSAQNSMLPSQNMTDNQTQTIDLLSDLENILSSNLPAQTLDHRSLLSDTNPGPDTQLPSGPAQNPGIDFDIEEFFSASNIQTQTEESELSTMTTEPVLESLDIETQTDFLLADTSAQSYGCRGNSNFLGLEMFDTQTQTDLNFFLDSSPHLPLGSILKHSSFSVSTDSSDTETQTEGVSTAKNIPALESKVQLNSTETQTMSSGFETLGSLFFTSNETQTAMDDFLLADLAWNTMESQFSSVETQTSAEPHTVSNF

SEQ ID NO: 5545 - protein, 1204 aa, unidentified; identical to SEQ ID NO: 492

SEQ ID NO: 5546 - protein, 256 aa, unidentified; identical to SEQ ID NO: 516

SEQ ID NO: 5547 - protein, 470 aa, unidentified; identical to SEQ ID NO: 522

SEQ ID NO: 5548 - protein, 350 aa, unidentified; identical to SEQ ID NO: 524

SEQ ID NO: 5549 - protein, 328 aa, unidentified
MAAVVVAAAGGAGPAVLQVAGLYRGLCAVRSRALGLGLVSPAQLRVFPVRPGSGRPEGGADSSGVGAEAELQANPFYDRYRDKIQLLRRSDPAAFESRLEKRSEFRKQPVGHSRQGDFIKCVEQKTDALGKQSVNRGFTKDKTLSSIFNIEMVKEKTAEEIKQIWQQYFAAKDTVYAVIPAEKFDLIWNRAQSCPTFLCALPRREGYEFFVGQWTGTELHFTALINIQTRGEAAASQLILYHYPELKEEKGIVLMTAEMDSTFLNVAEAQCIANQVQLFYATDRKETYGLVETFNLRPNEFKYMSVIAELEQSGLGAELKCAQNQNKT

SEQ ID NO: 5550 - protein, 339 aa, unidentified
MAAAVAAAPGALGSLHAGGARLVAACSAWLCPGLRLPGSLAGRRAGPAIWAQGWVPAAGGPAPKRGYSSEMKTEDELRVRHLEEENRGIVVLGINRAYGKNSLSKNLIKMLSKAVDALKSDKKVRTIIIRSEVPGIFCAGADLKERAKMSSSEVGPFVSKIRAVINDIANLPVPTIAAIDGLALGGGLELALACDIRVAASSAKMGLVETKLAIIPGGGGTQRLPRAIGMSLAKELIFSARVLDGKEAKAVGLISHVLEQNQEGDAAYRKALDLAREFLPQGPVAMRVAKLAINQGMEVDLVTGLAIEEACYAQTIPTKDRLEGLLAFKEKRPPRYKGE

SEQ ID NO: 5551 - protein, 164 aa, unidentified
MPDTMLPACFLGLLAFSSACYFQNCPRGGKRAMSDLELRQCLPCGPGGKGRCFGPSICCADELGCFVGTAEALRCQEENYLPSPCQSGQKACGSGGRCAAFGVCCNDESCVTEPECREGFHRRARASDRSNATQLDGPAGALLLRLVQLAGAPEPFEPAQPDAY

SEQ ID NO: 5552 - protein, 843 aa, unidentified
MSSAMLVTCLPDPSSSFREDAPRPPVPGEEGETPPCQPGVGKGQVTKPMSVSSNTRRNEDGLGEPEGRASPDSPLTRWTKSLHSLLGDQDGAYLFRTFLEREKCVDTLDFWFACNGFRQMNLKDTKTLRVAKAIYKRYIENNSIVSKQLKPATKTYIRDGIKKQQIDSIMFDQAQTEIQSVMEENAYQMFLTSDIYLEYVRSGGENTAYMSNGGLGSLKVVCGYLPTLNEEEEWTCADFKCKLSPTVVGLSSKTLRATASVRSTETVDSGYRSFKRSDPVNPYHIGSGYVFAPATSANDSEISSDALTDDSMSMTDSSVDGIPPYRVGSKKQLQREMHRSVKANGQVSLPHFPRTHRLPKEMTPVEPATFAAELISRLEKLKLELESRHSLEERLQQIREDEEREGSELTLNSREGAPTQHPLSLLPSGSYEEDPQTILDDHLSRVLKTPGCQSPGVGRYSPRSRSPDHHHHHHSQYHSLLPPGGKLPPAAASPGACPLLGGKGFVTKQTTKHVHHHYIHHHAVPKTKEEIEAEATQRVHCFCPGGSEYYCYSKCKSHSKAPETMPSEQFGGSRGSTLPKRNGKGTEPGLALPAREGGAPGGAGALQLPREEGDRSQDVWQWMLESERQSKPKPHSAQSTKKAYPLESARSSPGERASRHHLWGGNSGHPRTTPRAHLFTQDPAMPPLTPPNTLAQLEEACRRLAEVSKPPKQRCCVASQQRDRNHSATVQTGATPFSNPSLAPEDHKEPKKLAGVHALQASELVVTYFFCGEEIPYRRMLKAQSLTLGHFKEQLSKKGNYRYYFKKASDEFACGAVFEEIWEDETVLPMYEGRILGKVERID

SEQ ID NO: 5553 - protein, 298 aa, unidentified
MVRMVPVLLSLLLLLGPAVPQENQDGRYSLTYIYTGLSKHVEDVPAFQALGSLNDLQFFRYNSKDRKSQPMGLWRQVEGMEDWKQDSQLQKAREDIFMETLKDIVEYYNDSNGSHVLQGRFGCEIENNRSSGAFWKYYYDGKDYIEFNKEIPAWVPFDPAAQITKQKWEAEPVYVQRAKAYLEEECPATLRKYLKYSKNILDRQDPPSVVVTSHQAPGEKKKLKCLAYDFYPGKIDVHWTRAGEVQEPELRGDVLHNGNGTYQSWVVVAVPPQDTAPYSCHVQHSSLAQPLVVPWEAS

SEQ ID NO: 5554 - protein, 251 aa, unidentified
MTRLTVLALLAGLLASSRAGSSPLLDIVGGRKARPRQFPFLASIQNQGRHFCGGALIHARFVMTAASCFQSQNPGVSTVVLGAYDLRRRERQSRQTFSISSMSENGYDPQQNLNDLMLLQLDREANLTSSVTILPLPLQNATVEAGTRCQVAGWGSQRSGGRLSRFPRFVNVTVTPEDQCRPNNVCTGVLTRRGGICNGDGGTPLVCEGLAHGVASFSLGPCGRGPDFFTRVALFRDWIDGVLNNPGPGPA

SEQ ID NO: 5555 - protein, 119 aa, unidentified
MSRSVALAVLALLSLSGLEAIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 5556 - protein, 331 aa, unidentified
MASALWTVLPSRMSLRSLKWSLLLLSLLSFFVMWYLSLPHYNVIERVNWMYFYEYEPIYRQDFHFTLREHSNCSHQNPFLVILVTSHPSDVKARQAIRVTWGEKKSWWGYEVLTFFLLGQEAEKEDKMLALSLEDEHLLYGDIIRQDFLDTYNNLTLKTIMAFRWVTEFCPNAKYVMKTDTDVFINTGNLVKYLLNLNHSEKFFTGYPLIDNYSYRGFYQKTHISYQEYPFKVFPPYCSGLGYIMSRDLVPRIYEMMGHVKPIKFEDVYVGICLNLLKVNIHIPEDTNLFFLYRIHLDVCQLRRVIAAHGFSSKEIITFWQVMLRNTTCHY

SEQ ID NO: 5557 - protein, 500 aa, unidentified
MRNWLVLLCPCVLGAALHLWLRLRSPPPACASGAGPADQLALFPQWKSTHYDVVVGVLSARNNHELRNVIRSTWMRHLLQHPTLSQRVLVKFIIGAHGCEVPVEDREDPYSCKLLNITNPVLNQEIEAFSLSEDTSSGLPEDRVVSVSFRVLYPIVITSLGVFYDANDVGFQRNITVKLYQAEQEEALFIARFSPPSCGVQVNKLWYKPVEQFILPESFEGTIVWESQDLHGLVSRNLHKVTVNDGGGVLRVITAGEGALPHEFLEGVEGVAGGFIYTIQEGDALLHNLHSRPQRLIDHIRNLHEEDALLKEESSIYDDIVFVDVVDTYRNVPAKLLNFYRWTVETTSFNLLLKTDDDCYIDLEAVFNRIVQKNLDGPNFWWGNFRLNWAVDRTGKWQELEYPSPAYPAFACGSGYVISKDIVKWLASNSGRLKTYQGEDVSMGIWMAAIGPKRYQDSLWLCEKTCETGMLSSPQYSPWELTELWKLKERCGDPCRCQAR

SEQ ID NO: 5558 - protein, 326 aa, unidentified
MASKVSCLYVLTVVCWASALWYLSITRPTSSYTGSKPFSHLTVARKNFTFGNIRTRPINPHSFEFLINEPNKCEKNIPFLVILISTTHKEFDARQAIRETWGDENNFKGIKIATLFLLGKNADPVLNQMVEQESQIFHDIIVEDFIDSYHNLTLKTLMGMRWVATFCSKAKYVMKTDSDIFVNMDNLIYKLLKPSTKPRRRYFTGYVINGGPIRDVRSKWYMPRDLYPDSNYPPFCSGTGYIFSADVAELIYKTSLHTRLLHLEDVYVGLCLRKLGIHPFQNSGFNHWKMAYSLCRYRRVITVHQISPEEMHRIWNDMSSKKHLRC

SEQ ID NO: 5559 - protein, 378 aa, unidentified
MQLRLFRRLLLAALLLVIVWTLFGPSGLGEELLSLSLASLLPAPASPGPPLALPRLLIPNQEACSGPGAPPFLLILVCTAPENLNQRNAIRASWGGLREARGLRVQTLFLLGEPNAQHPVWGSQGSDLASESAAQGDILQAAFQDSYRNLTLKTLSGLNWAEKHCPMARYVLKTDDDVYVNVPELVSELVLRGGRWGQWERSTEPQREAEQEGGQVLHSEEVPLLYLGRVHWRVNPSRTPGGRHRVSEEQWPHTWGPFPPYASGTGYVLSASAVQLILKVASRAPLLPLEDVFVGVSARRGGLAPTQCVKLAGATHYPLDRCCYGKFLLTSHRLDPWKMQEAWKLVGGSDGERTAPFCSWFQGVLGILRCRAIAWLQS

SEQ ID NO: 5560 - protein, 310 aa, unidentified
MAFPKMRLMYICLLVLGALCLYFSMYSLNPFKEQSFVYKKDGNFLKLPDTDCRQTPPFLVLLVTSSHKQLAERMAIRQTWGKERMVKGKQLKTFFLLGTTSSAAETKEVDQESQRHGDIIQKDFLDVYYNLTLKTMMGIEWVHRFCPQAAFVMKTDSDMFINVDYLTELLLKKNRTTRFFTGFLKLNEFPIRQPFSKWFVSKSEYPWDRYPPFCSGTGYVFSGDVASQVYNVSKSVPYIKLEDVFVGLCLERLNIRLEELHSQPTFFPGGLRFSVCLFRRIVACHFIKPRTLLDYWQALENSRGEDCPPV

SEQ ID NO: 5561 - protein, 329 aa, unidentified
MKLLRRAWRRRAALGLGTLALCGAALLYLARCAAEPGDPRAMSGRSPPPPAPARAAAFLAVLVASAPRAAERRSVIRSTWLARRGAPGDVWARFAVGTAGLGAEERRALEREQARHGDLLLLPALRDAYENLTAKVLAMLAWLDEHVAFEFVLKADDDSFARLDALLAELRAREPARRRRLYWGFFSGRGRVKPGGRWREAAWQLCDYYLPYALGGGYVLSADLVHYLRLSRDYLRAWHSEDVSLGAWLAPVDVQREHDPRFDTEYRSRGCSNQYLVTHKQSLEDMLEKHATLAREGRLCKREVQLRLSYVYDWSAPPSQCCQRREGIP

SEQ ID NO: 5562 - protein, 335 aa, unidentified
MKLKLKNVFLAYFLVSIAGLLYALVQLGQPCDCLPPLRAAAEQLRQKDLRISQLQAELRRPPPAPAQPPEPEALPTIYVVTPTYARLVQKAELVRLSQTLSLVPRLHWLLVEDAEGPTPLVSGLLAASGLLFTHLVVLTPKAQRLREGEPGWVHPRGVEQRNKALDWLRGRGGAVGGEKDPPPPGTQGVVYFADDDNTYSRELFEEMRWTRGVSVWPVGLVGGLRFEGPQVQDGRVVGFHTAWEPSRPFPVDMAGFAVALPLLLDKPNAQFDSTAPRGHLESSLLSHLVDPKDLEPRAANCTRVLVWHTRTEKPKMKQEEQLQRQGRGSDPAIEV

SEQ ID NO: 5563 - protein, 498 aa, unidentified
MRPPACWWLLAPPALLALLTCSLAFGLASEDTKKEVKQSQDLEKSGISRKNDIDLKGIVFVIQSQSNSFHAKRAEQLKKSILKQAADLTQELPSVLLLHQLAKQEGAWTILPLLPHFSVTYSRNSSWIFFCEEETRIQIPKLLETLRRYDPSKEWFLGKALHDEEATIIHHYAFSENPTVFKYPDFAAGWALSIPLVNKLTKRLKSESLKSDFTIDLKHEIALYIWDKGGGPPLTPVPEFCTNDVDFYCATTFHSFLPLCRKPVKKKDIFVAVKTCKKFHGDRIPIVKQTWESQASLIEYYSDYTENSIPTVDLGIPNTDRGHCGKTFAILERFLNRSQDKTAWLVIVDDDTLISISRLQHLLSCYDSGEPVFLGERYGYGLGTGGYSYITGGGGMVFSREAVRRLLASKCRCYSNDAPDDMVLGMCFSGLGIPVTHSPLFHQARPVDYPKDYLSHQVPISFHKHWNIDPVKVYFTWLAPSDEDKARQETQKGFREEL

SEQ ID NO: 5564 - protein, 372 aa, unidentified
MKYLRHRRPNATLILAIGAFTLLLFSLLVSPPTCKVQEQPPAIPEALAWPTPPTRPAPAPCHANTSMVTHPDFATQPQHVQNFLLYRHCRHFPLLQDVPPSKCAQPVFLLLVIKSSPSNYVRRELLRRTWGRERKVRGLQLRLLFLVGTASNPHEARKVNRLLELEAQTHGDILQWDFHDSFFNLTLKQVLFLQWQETRCANASFVLNGDDDVFAHTDNMVFYLQDHDPGRHLFVGQLIQNVGPIRAFWSKYYVPEVVTQNERYPPYCGGGGFLLSRFTAAALRRAAHVLDIFPIDDVFLGMCLELEGLKPASHSGIRTSGVRAPSQRLSSFDPCFYRDLLLVHRFLPYEMLLMWDALNQPNLTCGNQTQIY

SEQ ID NO: 5565 - protein, 378 aa, unidentified
MLPPQPSAAHQGRGGRSGLLPKGPAMLCRLCWLVSYSLAVLLLGCLLFLRKAAKPAGDPTAHQPFWAPPTPRHSRCPPNHTVSSASLSLPSRHRLFLTYRHCRNFSILLEPSGCSKDTFLLLAIKSQPGHVERRAAIRSTWGRVGGWARGRQLKLVFLLGVAGSAPPAQLLAYESREFDDILQWDFTEDFFNLTLKELHLQRWVVAACPQAHFMLKGDDDVFVHVPNVLEFLDGWDPAQDLLVGDVIRQALPNRNTKVKYFIPPSMYRATHYPPYAGGGGYVMSRATVRRLQAIMEDAELFPIDDVFVGMCLRRLGLSPMHHAGFKTFGIRRPLDPLDPCLYRGLLLVHRLSPLEMWTMWALVTDEGLKCAAGPIPQR

SEQ ID NO: 5566 - protein, 384 aa, unidentified
MAFPCRRSLTAKTLACLLVGVSFLALQQWFLQAPRSPREERSPQEETPEGPTDAPAADEPPSELVPGPPCVANASANATADFEQLPARIQDFLRYRHCRHFPLLWDAPAKCAGGRGVFLLLAVKSAPEHYERRELIRRTWGQERSYGGRPVRRLFLLGTPGPEDEARAERLAELVALEAREHGDVLQWAFADTFLNLTLKHLHLLDWLAARCPHARFLLSGDDDVFVHTANVVRFLQAQPPGRHLFSGQLMEGSVPIRDSWSKYFVPPQLFPGSAYPVYCSGGGFLLSGPTARALRAAARHTPLFPIDDAYMGMCLERAGLAPSGHEGIRPFGVQLPGAQQSSFDPCMYRELLLVHRFAPYEMLLMWKALHSPALSCDRGHRVS

SEQ ID NO: 5567 - protein, 401 aa, unidentified
MSLWKKTVYRSLCLALALLVAVTVFQRSLTPGQFLQEPPPPTLEPQKAQKPNGQLVNPNNFWKNPKDVAAPTPMASQGPQAWDVTTTNCSANINLTHQPWFQVLEPQFRQFLFYRHCRYFPMLLNHPEKCRGDVYLLVVVKSVITQHDRREAIRQTWGRERQSAGGGRGAVRTLFLLGTASKQEERTHYQQLLAYEDRLYGDILQWGFLDTFFNLTLKEIHFLKWLDIYCPHVPFIFKGDDDVFVNPTNLLEFLADRQPQENLFVGDVLQHARPIRRKDNKYYIPGALYGKASYPPYAGGGGFLMAGSLARRLHHACDTLELYPIDDVFLGMCLEVLGVQPTAHEGFKTFGISRNRNSRMNKEPCFFRAMLVVHKLLPPELLAMWGLVHSNLTCSRKLQVL

SEQ ID NO: 5568 - protein, 397 aa, unidentified
MRCPKCLLCLSALLTLLGLKVYIEWTSESRLSKAYPSPRGTPPSPTPANPEPTLPANLSTRLGQTIPLPFAYWNQQQWRLGSLPSGDSTETGGCQAWGAAAATEIPDFASYPKDLRRFLLSAACRSFPQWLPGGGGSQVSSCSDTDVPYLLLAVKSEPGRFAERQAVRETWGSPAPGIRLLFLLGSPVGEAGPDLDSLVAWESRRYSDLLLWDFLDVPFNQTLKDLLLLAWLGRHCPTVSFVLRAQDDAFVHTPALLAHLRALPPASARSLYLGEVFTQAMPLRKPGGPFYVPESFFEGGYPAYASGGGYVIAGRLAPWLLRAAARVAPFPFEDVYTGLCIRALGLVPQAHPGFLTAWPADRTADHCAFRNLLLVRPLGPQASIRLWKQLQDPRLQC

SEQ ID NO: 5569 - protein, 402 aa, unidentified
MRRRLRLRRDALLTLLLGASLGLLLYAQRDGAAPTASAPRGRGRAAPRPTPGPRAFQLPDAGAAPPAYEGDTPAPPTPTGPFDFARYLRAKDQRRFPLLINQPHKCRGDGAPGGRPDLLIAVKSVAEDFERRQAVRQTWGAEGRVQGALVRRVFLLGVPRGAGSGGADEVGEGARTHWRALLRAESLAYADILLWAFDDTFFNLTLKEIHFLAWASAFCPDVRFVFKGDADVFVNVGNLLEFLAPRDPAQDLLAGDVIVHARPIRTRASKYYIPEAVYGLPAYPAYAGGGGFVLSGATLHRLAGACAQVELFPIDDVFLGMCLQRLRLTPEPHPAFRTFGIPQPSAAPHLSTFDPCFYRELVVVHGLSAADIWLMWRLLHGPHGPACAHPQPVAAGPFQWDS

SEQ ID NO: 5570 - protein, 533 aa, unidentified
MWLGRRALCALVLLLACASLGLLYASTRDAPGLRLPLAPWAPPQSPRRPELPDLAPEPRYAHIPVRIKEQVVGLLAWNNCSCESSGGGLPLPFQKQVRAIDLTKAFDPAELRAASATREQEFQAFLSRSQSPADQLLIAPANSPLQYPLQGVEVQPLRSILVPGLSLQAASGQEVYQVNLTASLGTWDVAGEVTGVTLTGEGQADLTLVSPGLDQLNRQLQLVTYSSRSYQTNTADTVRFSTEGHEAAFTIRIRHPPNPRLYPPGSLPQGAQYNISALVTIATKTFLRYDRLRALITSIRRFYPTVTVVIADDSDKPERVSGPYVEHYLMPFGKGWFAGRNLAVSQVTTKYVLWVDDDFVFTARTRLERLVDVLERTPLDLVGGAVREISGFATTYRQLLSVEPGAPGLGNCLRQRRGFHHELVGFPGCVVTDGVVNFFLARTDKVREVGFDPRLSRVAHLEFFLDGLGSLRVGSCSDVVVDHASKLKLPWTSRDAGAETYARYRYPGSLDESQMAKHRLLFFKHRLQCMTSQ

SEQ ID NO: 5571 - protein, 998 aa, unidentified [sequence omitted]

SEQ ID NO: 5572 - protein, 1039 aa, unidentified
MPRLPVKKIRKQMKLLLLLLLLSCAAWLTYVHLGLVRQGRALRQRLGYGRDGEKLTSETDGRGVHAAPSTQRAEDSSESREEEQAPEGRDLDMLFPGGAGRLPLNFTHQTPPWREEYKGQVNLHVFEDWCGGAVGHLRRNLHFPLFPHTRTTVKKLAVSPKWKNYGLRIFGFIHPARDGDVQFSVASDDNSEFWLSLDESPAAAQLVAFVGKTGSEWTAPGEFTKFSSQVSKPRRLMASRRYYFELLHKQDDRGSDHVEVGWRAFLPGLKFEVISSAHISLYTDESALKMDHVAHVPQSPASHVGGRPPQEETSADMLRPDPRDTFFLTPRMESSSLENVLEPCAYAPTYVVKDFPIARYQGLQFVYLSFVYPNDYTRLTHMETDNKCFYRESPLYLERFGFYKYMKMDKEEGDEDEEDEVQRRAFLFLNPDDFLDDEDEGELLDSLEPTEAAPPRSGPQSPAPAAPAQPGATLAPPTPPRPRDGGTPRHSRALSWAARAARPLPLFLGRAPPPRPAVEQPPPKVYVTRVRPGQRASPRAPAPRAPWPPFPGVFLHPRPLPRVQLRAPPRPPRPHGRRTGGPQATQPRPPARAQATQGGREGQARTLGPAAPTVDSNLSSEARPVTSFLSLSQVSGPQLPGEGEEEEEGEDDGAPGDEAASEDSEEAAGPALGRWREDAIDWQRTFSVGAVDFELLRSDWNDLRCNVSGNLQLPEAEAVDVTAQYMERLNARHGGRFALLRIVNVEKRRDSARGSRFLLELELQERGGGRLRLSEYVFLRLPGARVGDADGESPEPAPAASVRPDGRPELCRPLRLAWRQDVMVHFIVPVKNQARWVAQFLADMAALHARTGDSRFSVVLVDFESEDMDVERALRAARLPRYQYLRRTGNFERSAGLQAGVDAVEDASSIVFLCDLHIHFPPNILDGIRKHCVEGRLAFAPVVMRLSCGSSPRDPHGYWEVNGFGLFGIYKSDFDRVGGMNTEEFRDQWGGEDWELLDRVLQAGLEVERLRLRNFYHHYHSKRGMWSVRSRKGSRTGAS

SEQ ID NO: 5573 - protein, 344 aa, unidentified
MGFNLTFHLSYKFRLLLLLTLCLTVVGWATSNYFVGAIQEIPKAKEFMANFHKTLILGKGKTLTNEASTKKVELDNCPSVSPYLRGQSKLIFKPDLTLEEVQAENPKVSRGRYRPQECKALQRVAILVPHRNREKHLMYLLEHLHPFLQRQQLDYGIYVIHQAEGKKFNRAKLLNVGYLEALKEENWDCFIFHDVDLVPENDFNLYKCEEHPKHLVVGRNSTGYRLRYSGYFGGVTALSREQFFKVNGFSNNYWGWGGEDDDLRLRVELQRMKISRPLPEVGKYTMVFHTRDKGNEVNAERMKLLHQVSRVWRTDGLSSCSYKLVSVEHNPLYINITVDFWFGA

SEQ ID NO: 5574 - protein, 388 aa, unidentified
MRARRGLLRLPRRSLLAALFFFSLSSSLLYFVYVAPGIVNTYLFMMQAQGILIRDNVRTIGAQVYEQVLRSAYAKRNSSVNDSDYPLDLNHSETFLQTTTFLPEDFTYFANHTCPERLPSMKGPIDINMSEIGMDYIHELFSKDPTIKLGGHWKPSDCMPRWKVAILIPFRNRHEHLPVLFRHLLPMLQRQRLQFAFYVVEQVGTQPFNRAMLFNVGFQEAMKDLDWDCLIFHDVDHIPESDRNYYGCGQMPRHFATKLDKYMYLLPYTEFFGGVSGLTVEQFRKINGFPNAFWGWGGEDDDLWNRVQNAGYSVSRPEGDTGKYKSIPHHHRGEVQFLGRYALLRKSKERQGLDGLNNLNYFANITYDALYKNITVNLTPELAQVNEY

SEQ ID NO: 5575 - protein, 415 aa, unidentified
MQMSYAIRCAFYQLLLAALMLVAMLQLLYLSLLSGLHGQEEQDQYFEFFPPSPRSVDQVKAQLRTALASGGVLDASGDYRVYRGLLKTTMDPNDVILATHASVDNLLHLSGLLERWEGPLSVSVFAATKEEAQLATVLAYALSSHCPDMRARVAMHLVCPSRYEAAVPDPREPGEFALLRSCQEVFDKLARVAQPGINYALGTNVSYPNNLLRNLAREGANYALVIDVDMVPSEGLWRGLREMLDQSNQWGGTALVVPAFEIRRARRMPMNKNELVQLYQVGEVRPFYYGLCTPCQAPTNYSRWVNLPEESLLRPAYVVPWQDPWEPFYVAGGKVPTFDERFRQYGFNRISQACELHVAGFDFEVLNEGFLVHKGFKEALKFHPQKEAENQHNKILYRQFKQELKAKYPNSPRRC

SEQ ID NO: 5576 - protein, 204 aa, unidentified
MATASPSVFLLMVNGQVESAQFPEYDDLYCKYCFVYGQDWAPTAGLEEGISQITSKSQDVRQALVWNFPIDVTFKSTNPYGWPQIVLSVYGPDVFGNDVVRGYGAVHVPFSPGRHKRTIPMFVPESTSKLQKFTSWFMGRRPEYTDPKVVAQGEGREVTRVRSQGFVTLLFNVVTKDMRKLGYDTGPSDTQGVLGPSPPQSFPQ

SEQ ID NO: 5577 - protein, 518 aa, unidentified; identical to SEQ ID NO: 562

SEQ ID NO: 5578 - protein, 628 aa, unidentified; identical to SEQ ID NO: 565

SEQ ID NO: 5579 - protein, 911 aa, unidentified
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGDCVPSPCHNGGTCLEEEEGVRCLCLPGYGGDLCDVGLRFCNPGWDAFQGACYKHFSTRRSWEEAETQCRMYGAHLASISTPEEQDFINNRYREYQWIGLNDRTIEGDFLWSDGVPLLYENWNPGQPDSYFLSGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPARALHPEEDPEGRQGRLLGRWKALLIPPSSPMPGP

SEQ ID NO: 5580 - protein, 241 aa, unidentified; identical to SEQ ID NO: 566

SEQ ID NO: 5581 - protein, 870 aa, unidentified
MNHLNVLAKALYDNVAESPDELSFRKGDIMTVLEQDTQGLDGWWLCSLHGRQGIVPGNRLKILVGMYDKKPAGPGPGPPATPAQPQPGLHAPAPPASQYTPMLPNTYQPQPDSVYLVPTPSKAQQGLYQVPGPSPQFQSPPAKQTSTFSKQTPHHPFPSPATDLYQVPPGPGGPAQDIYQVPPSAGMGHDIYQVPPSMDTRSWEGTKPPAKVVVPTRVGQGYVYEAAQPEQDEYDIPRHLLAPGPQDIYDVPPVRGLLPSQYGQEVYDTPPMAVKGPNGRDPLLEVYDVPPSVEKGLPPSNHHAVYDVPPSVSKDVPDGPLLREETYDVPPAFAKAKPFDPARTPLVLAAPPPDSPPAEDVYDVPPPAPDLYDVPPGLRRPGPGTLYDVPRERVLPPEVADGGVVDSGVYAVPPPAEREAPAEGKRLSASSTGSTRSSQSASSLEVAGPGREPLELEVAVEALARLQQGVSATVAHLLDLAGSAGATGSWRSPSEPQEPLVQDLQAAVAAVQSAVHELLEFARSAVGNAAHTSDRALHAKLSRQLQKMEDVHQTLVAHGQALDAGRGGSGATLEDLDRLVACSRAVPEDAKQLASFLHGNASLLFRRTKATAPGPEGGGTLHPNPTDKTSSIQSRPLPSPPKFTSQDSPDGQYENSEGGWMEDYDYVHLQGKEEFEKTQKELLEKGSITRQGKSQLELQQLKQFERLEQEVSRPIDHDLANWTPAQPLAPGRTGGLGPSDRQLLLFYLEQCEANLTTLTNAVDAFFTAVATNQPPKIFVAHSKFVILSAHKLVFIGDTLSRQAKAADVRSQVTHYSNLLCDLLRGIVATTKAAALQYPSPSAAQDMVERVKELGHSTQQFRRVLGQLAAA

SEQ ID NO: 5582 - protein, 602 aa, unidentified
MHSKVTIICIRFLFWFLLLCMLIGKSHTEDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESAGAASVSLHLLSPGSHSLFTRAILQSGSFNAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTAFLVYGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 5583 - protein, 247 aa, unidentified; identical to SEQ ID NO: 575

SEQ ID NO: 5584 - protein, 100 aa, unidentified
MRALTLLALLALAALCIAGQAGAKPSGAESSKGAAFVSKQEGSEVVKRPRRYLYQWLGAPVPYPDPLEPRREVCELNPDCDELADHIGFQEAYRRFYGPV

SEQ ID NO: 5585 - protein, 368 aa, unidentified
MWPLWRLVSLLALSQALPFEQRGFWDFTLDDGPFMMNDEEASGADTSGVLDPDSVTPTYSAMCPFGCHCHLRVVQCSDLGLKSVPKEISPDTTLLDLQNNDISELRKDDFKGLQHLYALVLVNNKISKIHEKAFSPLRKLQKLYISKNHLVEIPPNLPSSLVELRIHDNRIRKVPKGVFSGLRNMNCIEMGGNPLENSGFEPGAFDGLKLNYLRISEAKLTGIPKDLPETLNELHLDHNKIQAIELEDLLRYSKLYRLGLGHNQIRMIENGSLSFLPTLRELHLDNNKLARVPSGLPDLKLLQVVYLHSNNITKVGVNDFCPMGFGVKRAYYNGISLFNNPVPYWEVQPATFRCVTDRLAIQFGNYKK

SEQ ID NO: 5586 - protein, 206 aa, unidentified
MAVKKIAIFGATGQTGLTTLAQAVQAGYEVTVLVRDSSRLPSEGPRPAHVVVGDVLQAADVDKTVAGQDAVIVLLGTRNDLSPTTVMSEGARNIVAAMKAHGVDKVVACTSAFLLWDPTKVPPRLQAVTDDHIRMHKVLRESGLKYVAVMPPHIGDQPLTGAYTVTLDGRGPSRVISKHDLGHFMLRCLTTDEYDGHSTYPSHQYQ

SEQ ID NO: 5587 - protein, 986 aa, unidentified
MPGVARLPLLLGLLLLPRPGRPLDLADYTYDLAEEDDSEPLNYKDPCKAAAFLGDIALDEEDLRAFQVQQAVDLRRHTARKSSIKAAVPGNTSTPSCQSTNGQPQRGACGRWRGRSRSRRAATSRPERVWPDGVIPFVIGGNFTGSQRAVFRQAMRHWEKHTCVTFLERTDEDSYIVFTYRPCGCCSYVGRRGGGPQAISIGKNCDKFGIVVHELGHVVGFWHEHTRPDRDRHVSIVRENIQPGQEYNFLKMEPQEVESLGETYDFDSIMHYARNTFSRGIFLDTIVPKYEVNGVKPPIGQRTRLSKGDIAQARKLYKCPACGETLQDSTGNFSSPEYPNGYSAHMHCVWRISVTPGEKIILNFTSLDLYRSRLCWYDYVEVRDGFWRKAPLRGRFCGSKLPEPIVSTDSRLWVEFRSSSNWVGKGFFAVYEAICGGDVKKDYGHIQSPNYPDDYRPSKVCIWRIQVSEGFHVGLTFQSFEIERHDSCAYDYLEVRDGHSESSTLIGRYCGYEKPDDIKSTSSRLWLKFVSDGSINKAGFAVNFFKEVDECSRPNRGGCEQRCLNTLGSYKCSCDPGYELAPDKRRCEAACGGFLTKLNGSITSPGWPKEYPPNKNCIWQLVAPTQYRISLQFDFFETEGNDVCKYDFVEVRSGLTADSKLHGKFCGSEKPEVITSQYNNMRVEFKSDNTVSKKGFKAHFFSDKDECSKDNGGCQQDCVNTFGSYECQCRSGFVLHDNKHDCKEAGCDHKVTSTSGTITSPNWPDKYPSKKECTWAISSTPGHRVKLTFMEMDIESQPECAYDHLEVFDGRDAKAPVLGRFCGSKKPEPVLATGSRMFLRFYSDNSVQRKGFQASHATECGGQVRADVKTKDLYSHAQFGDNNYPGGVDCEWVIVAEEGYGVELVFQTFEVEEETDCGYDYMELFDGYDSTAPRLGRYCGSGPPEEVYSAGDSVLVKFHSDDTITKKGFHLRYTSTKFQDTLHSRK

SEQ ID NO: 5588 - protein, 424 aa, unidentified
MGSLVLTLCALFCLAAYLVSGSPIMNLEQSPLEEDMSLFGDVFSEQDGVDFNTLLQSMKDEFLKTLNLSDIPTQDSAKVDPPEYMLELYNKFATDRTSMPSANIIRSFKNEDLFSQPVSFNGLRKYPLLFNVSIPHHEEVIMAELRLYTLVQRDRMIYDGVDRKITIFEVLESKGDNEGERNMLVLVSGEIYGTNSEWETFDVTDAIRRWQKSGSSTHQLEVHIESKHDEAEDASSGRLEIDTSAQNKHNPLLIVFSDDQSSDKERKEELNEMISHEQLPELDNLGLDSFSSGPGEEALLQMRSNIIYDSTARIRRNAKGNYCKRTPLYIDFKEIGWDSWIIAPPGYEAYECRGVCNYPLAEHLTPTKHAIIQALVHLKNSQKASKACCVPTKLEPISILYLDKGVVTYKFKYEGMAVSECGCR

SEQ ID NO: 5589 - protein, 392 aa, unidentified
MVLLSILRILFLCELVLFMEHRAQMAEGGQSSIALLAEAPTLPLIEELLEESPGEQPRKPRLLGHSLRYMLELYRRSADSHGHPRENRTIGATMVRLVKPLTNVARPHRGTWHIQILGFPLRPNRGLYQLVRATVVYRHHLQLTRFNLSCHVEPWVQKNPTNHFPSSEGDSSKPSLMSNAWKEMDITQLVQQRFWNNKGHRILRLRFMCQQQKDSGGLELWHGTSSLDIAFLLLYFNDTHKSIRKAKFLPRGMEEFMERESLLRRTRQADGISAEVTASSSKHSGPENNQCSLHPFQISFRQLGWDHWIIAPPFYTPNYCKGTCLRVLRDGLNSPNHAIIQNLINQLVDQSVPRPSCVPYKYVPISVLMIEANGSILYKEYEGMIAESCTCR

SEQ ID NO: 5590 - protein, 396 aa, unidentified
MVAGTRCLLALLLPQVLLGGAAGLVPELGRRKFAAASSGRPSSQPSDEVLSEFELRLLSMFGLKQRPTPSRDAVVPPYMLDLYRRHSGQPGSPAPDHRLERAASRANTVRSFHHEESLEELPETSGKTTRRFFFNLSSIPTEEFITSAELQVFREQMQDALGNNSSFHHRINIYEIIKPATANSKFPVTRLLDTRLVNQNASRWESFDVTPAVMRWTAQGHANHGFVVEVAHLEEKQGVSKRHVRISRSLHQDEHSWSQIRPLLVTFGHDGKGHPLHKREKRQAKHKQRKRLKSSCKRHPLYVDFSDVGWNDWIVAPPGYHAFYCHGECPFPLADHLNSTNHAIVQTLVNSVNSKIPKACCVPTELSAISMLYLDENEKVVLKNYQDMVVEGCGCR

SEQ ID NO: 5591 - protein, 472 aa, unidentified
MAGASRLLFLWLGCFCVSLAQGERPKPPFPELRKAVPGDRTAGGGPDSELQPQDKVSEHMLRLYDRYSTVQAARTPGSLEGGSQPWRPRLLREGNTVRSFRAAAAETLERKGLYIFNLTSLTKSENILSATLYFCIGELGNISLSCPVSGGCSHHAQRKHIQIDLSAWTLKFSRNQSQLLGHLSVDMAKSHRDIMSWLSKDITQLLRKAKENEEFLIGFNITSKGRQLPKRRLPFPEPYILVYANDAAISEPESVVSSLQGHRNFPTGTVPKWDSHIRAALSIERRKKRSTGVLLPLQNNELPGAEYQYKKDEVWEERKPYKTLQAQAPEKSKNKKKQRKGPHRKSQTLQFDEQTLKKARRKQWIEPRNCARRYLKVDFADIGWSEWIISPKSFDAYYCSGACQFPMPKSLKPSNHATIQSIVRAVGVVPGIPEPCCVPEKMSSLSILFFDENKNVVLKVYPNMTVESCACR

SEQ ID NO: 5592 - protein, 408 aa, unidentified
MIPGNRMLMVVLLCQVLLGGASHASLIPETGKKKVAEIQGHAGGRRSGQSHELLRDFEATLLQMFGLRRRPQPSKSAVIPDYMRDLYRLQSGEEEEEQIHSTGLEYPERPASRANTVRSFHHEEHLENIPGTSENSAFRFLFNLSSIPENEVISSAELRLFREQVDQGPDWERGFHRINIYEVMKPPAEVVPGHLITRLLDTRLVHHNVTRWETFDVSPAVLRWTREKQPNYGLAIEVTHLHQTRTHQGQHVRISRSLPQGSGNWAQLRPLLVTFGHDGRGHALTRRRRAKRSPKHHSQRARKKNKNCRRHSLYVDFSDVGWNDWIVAPPGYQAFYCHGDCPFPLADHLNSTNHAIVQTLVNSVNSSIPKACCVPTELSAISMLYLDEYDKVVLKNYQEMVVEGCGCR

SEQ ID NO: 5593 - protein, 513 aa, unidentified
MPGLGRRAQWLCWWWGLLCSCCGPPPLRPPLPAAAAAAAGGQLLGDGGSPGRTEQPPPSPQSSSGFLYRRLKTQEKREMQKEILSVLGLPHRPRPLHGLQQPQPPALRQQEEQQQQQQLPRGEPPPGRLKSAPLFMLDLYNALSADNDEDGASEGERQQSWPHEAASSSQRRQPPPGAAHPLNRKSLLAPGSGSGGASPLTSAQDSAFLNDADMVMSFVNLVEYDKEFSPRQRHHKEFKFNLSQIPEGEVVTAAEFRIYKDCVMGSFKNQTFLISIYQVLQEHQHRDSDLFLLDTRVVWASEEGWLEFDITATSNLWVVTPQHNMGLQLSVVTRDGVHVHPRAAGLVGRDGPYDKQPFMVAFFKVSEVHVRTTRSASSRRRQQSRNRSTQSQDVARVSSASDYNSSELKTACRKHELYVSFQDLGWQDWIIAPKGYAANYCDGECSFPLNAHMNATNHAIVQTLVHLMNPEYVPKPCCAPTKLNAISVLYFDDNSNVILKKYRNMVVRACGCH

SEQ ID NO: 5594 - protein, 431 aa, unidentified
MHVRSLRAAAPHSFVALWAPLFLLRSALADFSLDNEVHSSFIHRRLRSQERREMQREILSILGLPHRPRPHLQGKHNSAPMFMLDLYNAMAVEEGGGPGGQGFSYPYKAVFSTQGPPLASLQDSHFLTDADMVMSFVNLVEHDKEFFHPRYHHREFRFDLSKIPEGEAVTAAEFRIYKDYIRERFDNETFRISVYQVLQEHLGRESDLFLLDSRTLWASEEGWLVFDITATSNHWVVNPRHNLGLQLSVETLDGQSINPKLAGLIGRHGPQNKQPFMVAFFKATEVHFRSIRSTGSKQRSQNRSKTPKNQEALRMANVAENSSSDQRQACKKHELYVSFRDLGWQDWIIAPEGYAAYYCEGECAFPLNSYMNATNHAIVQTLVHFINPETVPKPCCAPTQLNAISVLYFDDSSNVILKKYRNMVVRACGCH

SEQ ID NO: 5595 - protein, 402 aa, unidentified
MAARPGPLWLLGLTLCALGGGGPGLRPPPGCPQRRLGARERRDVQREILAVLGLPGRPRPRAPPAASRLPASAPLFMLDLYHAMAGDDDEDGAPAEQRLGRADLVMSFVNMVERDRALGHQEPHWKEFRFDLTQIPAGEAVTAAEFRIYKVPSIHLLNRTLHVSMFQVVQEQSNRESDLFFLDLQTLRAGDEGWLVLDVTAASDCWLLKRHKDLGLRLYVETEDGHSVDPGLAGLLGQRAPRSQQPFVVTFFRASPSPIRTPRAVRPLRRRQPKKSNELPQANRLPGIFDDVRGSHGRQVCRRHELYVSFQDLGWLDWVIAPQGYSAYYCEGECSFPLDSCMNATNHAILQSLVHLMKPNAVPKACCAPTKLSATSVLYYDSSNNVILRKHRNMVVKACGCH

SEQ ID NO: 5596 - protein, 402 aa, unidentified
MTALPGPLWLLGLALCALGGGGPGLRPPPGCPQRRLGARERRDVQREILAVLGLPGRPRPRAPPAASRLPASAPLFMLDLYHAMAGDDDEDGAPAERRLGRADLVMSFVNMVERDRALGHQEPHWKEFRFDLTQIPAGEAVTAAEFRIYKVPSIHLLNRTLHVSMFQVVQEQSNRESDLFFLDLQTLRAGDEGWLVLDVTAASDCWLLKRHKDLGLRLYVETEDGHSVDPGLAGLLGQRAPRSQQPFVVTFFRASPSPIRTPRAVRPLRRRQPKKSNELPQANRLPGIFDDVHGSHGRQVCRRHELYVSFQDLGWLDWVIAPQGYSAYYCEGECSFPLDSCMNATNHAILQSLVHLMMPDAVPKACCAPTKLSATSVLYYDSSNNVILRKHRNMVVKACGCH

SEQ ID NO: 5597 - protein, 685 aa, unidentified
MLWFSGVGALAERYCRRSPGITCCVLLLLNCSGVPMSLASSFLTGSVAKCENEGEVLQIPFITDNPCIMCVCLNKEVTCKREKCPVLSRDCALAIKQRGACCEQCKGCTYEGNTYNSSFKWQSPAEPCVLRQCQEGVVTESGVRCVVHCKNPLEHLGMCCPTCPGCVFEGVQYQEGEEFQPEGSKCTKCSCTGGRTQCVREVCPILSCPQHLSHIPPGQCCPKCLGQRKVFDLPFGSCLFRSDVYDNGSSFLYDNCTACTCRDSTVVCKRKCSHPGGCDQGQEGCCEECLLRVPPEDIKVCKFGNKIFQDGEMWSSINCTICACVKGRTECRNKQCIPISSCPQGKILNRKGCCPICTEKPGVCTVFGDPHYNTFDGRTFNFQGTCQYVLTKDCSSPASPFQVLVKNDARRTRSFSWTKSVELVLGESRVSLQQHLTVRWNGSRIALPCRAPHFHIDLDGYLLKVTTKAGLEISWDGDSFVEVMAAPHLKGKLCGLCGNYNGHKRDDLIGGDGNFKFDVDDFAESWRVESNEFCNRPQRKPVPELCQGTVKVKLRAHRECQKLKSWEFQTCHSTVDYATFYRSCVTDMCECPVHKNCYCESFLAYTRACQREGIKVHWEPQQNCAATQCKHGAVYDTCGPGCIKTCDNWNEIGPCNKPCVAGCHCPANLVLHKGRCIKPVLCPQR

SEQ ID NO: 5598 - protein, 994 aa, unidentified
MRRRPPSRGGRGAARARETRRQPRHRSGRRMAEAISCTLNCSCQSFKPGKINHRQCDQCKHGWVAHALSKLRIPPMYPTSQVEIVQSNVVFDISSLMLYGTQAIPVRLKILLDRLFSVLKQDEVLQILHALDWTLQDYIRGYVLQDASGKVLDHWSIMTSEEEVATLQQFLRFGETKSIVELMAIQEKEEQSIIIPPSTANVDIRAFIESCSHRSSSLPTPVDKGNPSSIHPFENLISNMTFMLPFQFFNPLPPALIGSLPEQYMLEQGHDQSQDPKQEVHGPFPDSSFLTSSSTPFQVEKDQCLNCPDAITKKEDSTHLSDSSSYNIVTKFERTQLSPEAKVKPERNSLGTKKGRVFCTACEKTFYDKGTLKIHYNAVHLKIKHKCTIEGCNMVFSSLRSRNRHSANPNPRLHMPMNRNNRDKDLRNSLNLASSENYKCPGFTVTSPDCRPPPSYPGSGEDSKGQPAFPNIGQNGVLFPNLKTVQPVLPFYRSPATPAEVANTPGILPSLPLLSSSIPEQLISNEMPFDALPKKKSRKSSMPIKIEKEAVEIANEKRHNLSSDEDMPLQVVSEDEQEACSPQSHRVSEEQHVQSGGLGKPFPEGERPCHRESVIESSGAISQTPEQATHNSERETEQTPALIMVPREVEDGGHEHYFTPGMEPQVPFSDYMELQQRLLAGGLFSALSNRGMAFPCLEDSKELEHVGQHALARQIEENRFQCDICKKTFKNACSVKIHHKNMHVKEMHTCTVEGCNATFPSRRSRDRHSSNLNLHQKALSQEALESSEDHFRAAYLLKDVAKEAYQDVAFTQQASQTSVIFKGTSRMGSLVYPITQVHSASLESYNSGPLSEGTILDLSTTSSMKSESSSHSSWDSDGVSEEGTVLMEDSDGNCEGSSLVPGEDEYPICVLMEKADQSLASLPSGLPITCHLCQKTYSNKGTFRAHYKTVHLRQLHKCKVPGCNTMFSSVRSRNRHSQNPNLHKSLASSPSHLQ

SEQ ID NO: 5599 - protein, 1114 aa, unidentified; identical to SEQ ID NO: 594

SEQ ID NO: 5600 - protein, 185 aa, unidentified
MADGGGGGGTGAVGGGGTSQASAGAATGATGASGGGGPINPASLPPGDPQLIALIVEQLKSRGLFDSFRRDCLADVDTKPAYQNLRQKVDNFVSTHLDKQEWNPTMNKNQLRNGLRQSVVQSGMLEAGVDRIISQVVDPKLNHIFRPQIERAIHEFLAAQKKAAVPAPPPEPEGQDPPAPSQDTS

SEQ ID NO: 5601 - protein, 137 aa, unidentified
MLSGRLVLGLVSMAGRVCLCQGSAGSGAIGPVEAAIRTKLEEALSPEVLELRNESGGHAVPPGSETHFRVAVVSSRFEGLSPLQRHRLVHAALAEELGGPVHALAIQARTPAQWRENSQLDTSPPCLGGNKKTLGTP

SEQ ID NO: 5602 - protein, 487 aa, unidentified; identical to SEQ ID NO: 596

SEQ ID NO: 5603 - protein, 256 aa, unidentified
MFQTGGLIVFYGLLAQTMAQFGGLPVPLDQTLPLNVNPALPLSPTGLAGSLTNALSNGLLSGGLLGILENLPLLDILKPGGGTSGGLLGGLLGKVTSVIPGLNNIIDIKVTDPQLLELGLVQSPDGHRLYVTIPLGIKLQVNTPLVGASLLRLAVKLDITAEILAVRDKQERIHLVLGDCTHSPGSLQISLLDGLGPLPIQGLLDSLTGILNKVLPELVQGNVCPLVNEVLRGLDITLVHDIVNMLIHGLQFVIKV

SEQ ID NO: 5604 - protein, 249 aa, unidentified
MLQLWKLVLLCGVLTGTSESLLDNLGNDLSNVVDKLEPVLHEGLETVDNTLKGILEKLKVDLGVLQKSSAWQLAKQKAQEAEKLLNNVISKLLPTNTDIFGLKISNSLILDVKAEPIDDGKGLNLSFPVTANVTVAGPIIGQIINLKASLDLLTAVTIETDPQTHQPVAVLGECASDPTSISLSLLDKHSQIINKFVNSVINTLKSTVSSLLQKEICPLIRIFIHSLDVNVIQQVVDNPQHKTQLQTLI

SEQ ID NO: 5605 - protein, 254 aa, unidentified
MMCPLWRLLIFLGLLALPLAPHKQPWPGLAQAHRDNKSTLARIIAQGLIKHNAESRIQNIHFGDRLNASAQVAPGLVGWLISGRKHQQQQESSINITNIQLDCGGIQISFHKEWFSANISLEFDLELRPSFDNNIVKMCAHMSIVVEFWLEKDEFGRRDLVIGKCDAEPSSVHVAILTEAIPPKMNQFLYNLKENLQKVLPHMVESQVCPLIGEILGQLDVKLLKSLIEQEAAHEPTHHETSQPSACQAGESPS

SEQ ID NO: 5606 - protein, 484 aa, unidentified
MAGPWTFTLLCGLLAATLIQATLSPTAVLILGPKVIKEKLTQELKDHNATSILQQLPLLSAMREKPAGGIPVLGSLVNTVLKHIIWLKVITANILQLQVKPSANDQELLVKIPLDMVAGFNTPLVKTIVEFHMTTEAQATIRMDTSASGPTRLVLSDCATSHGSLRIQLLHKLSFLVNALAKQVMNLLVPSLPNLVKNQLCPVIEASFNGMYADLLQLVKVPISLSIDRLEFDLLYPAIKGDTIQLYLGAKLLDSQGKVTKWFNNSAASLTMPTLDNIPFSLIVSQDVVKAAVAAVLSPEEFMVLLDSVLPESAHRLKSSIGLINEKAADKLGSTQIVKILTQDTPEFFIDQGHAKVAQLIVLEVFPSSEALRPLFTLGIEASSEAQFYTKGDQLILNLNNISSDRIQLMNSGIGWFQPDVLKNIITEIIHSILLPNQNGKLRSGVPVSLVKALGFEAAESSLTKDALVLTPASLWKPSSPVSQ

SEQ ID NO: 5607 - protein, 458 aa, unidentified
MAWASRLGLLLALLLPVVGASTPGTVVRLNKAALSYVSEIGKAPLQRALQVTVPHFLDWSGEALQPTRIRILNVHVPRLHLKFIAGFGVRLLAAANFTFKVFRAPEPLELTLPVELLADTRVTQSSIRTPVVSISACSLFSGHANEFDGSNSTSHALLVLVQKHIKAVLSNKLCLSISNLVQGVNVHLGTLIGLNPVGPESQIRYSMVSVPTVTSDYISLEVNAVLFLLGKPIILPTDATPFVLPRHVGTEGSMATVGLSQQLFDSALLLLQKAGALNLDITGQLRSDDNLLNTSALGRLIPEVARQFPEPMPVVLKVRLGATPVAMLHTNNATLRLQPFVEVLATASNSAFQSLFSLDVVVNLRLQLSVSKVKLQGTTSVLGDVQLTVASSNVGFIDTDQVRTLMGTVFEKPLLDHLNALLAMGIALPGVVNLHYVAPEIFVYEGYVVISSGLFYQS

SEQ ID NO: 5608 - protein, 476 aa, unidentified
MQPVMLALWSLLLLWGLATPCQELLETVGTLARIDKDELGKAIQNSLVGEPILQNVLGSVTAVNRGLLGSGGLLGGGGLLGHGGVFGVVEELSGLKIEELTLPKVLLKLLPGFGVQLSLHTKVGMHCSGPLGGLLQLAAEVNVTSRVALAVSSRGTPILILKRCSTLLGHISLFSGLLPTPLFGVVEQMLFKVLPGLLCPVVDSVLGVVNELLGAVLGLVSLGALGSVEFSLATLPLISNQYIELDINPIVKSVAGDIIDFPKSRAPAKVPPKKDHTSQVMVPLYLFNTTFGLLQTNGALDMDITPELVPSDVPLTTTDLAALLPEALGKLPLHQQLLLFLRVREAPTVTLHNKKALVSLPANIHVLFYVPKGTPESLFELNSVMTVRAQLAPSATKLHISLSLERLSVKVASSFTHAFDGSRLEEWLSHVVGAVYAPKLNVALDVGIPLPKVLNINFSNSVLEIVENAVVLTVAS

SEQ ID NO: 5609 - protein, 614 aa, unidentified
MWMAWCVAALSVVAVCGTSHETNTVLRVTKDVLSNAISGMLQQSDALHSALREVPLGVGDIPYNDFHVRGPPPVYTNGKKLDGIYQYGHIETNDNTAQLGGKYRYGEILESEGSIRDLRNSGYRSAENAYGGHRGLGRYRAAPVGRLHRRELQPGEIPPGVATGAVGPGGLLGTGGMLAADGILAGQGGLLGGGGLLGDGGLLGGGGVLGVLGEGGILSTVQGITGLRIVELTLPRVSVRLLPGVGVYLSLYTRVAINGKSLIGFLDIAVEVNITAKVRLTMDRTGYPRLVIERCDTLLGGIKVKLLRGLLPNLVDNLVNRVLADVLPDLLCPIVDVVLGLVNDQLGLVDSLIPLGILGSVQYTFSSLPLVTGEFLELDLNTLVGEAGGGLIDYPLGWPAVSPKPMPELPPMGDNTKSQLAMSANFLGSVLTLLQKQHALDLDITNGMFEELPPLTTATLGALIPKVFQQYPESCPLIIRIQVLNPPSVMLQKDKALVKVLATAEVMVSQPKDLETTICLIDVDTEFLASFSTEGDKLMIDAKLEKTSLNLRTSNVGNFDIGLMEVLVEKIFDLAFMPAMNAVLGSGVPLPKILNIDFSNADIDVLEDLLVLSA

SEQ ID NO: 5610 - protein, 453 aa, unidentified
MLRILCLALCSLLTGTRADPGALLRLGMDIMNQVQSAMDESHILEKMAAEAGKKQPGMKPIKGITNLKVKDVQLPVITLNFVPGVGIFQCVSTGMTVTGKSFMGGNMEIIVALNITATNRLLRDEETGLPVFKSEGCEVILVNVKTNLPSNMLPKMVNKFLDSTLHKVLPGLMCPAIDAVLVYVNRKWTNLSDPMPVGQMGTVKYVLMSAPATTASYIQLDFSPVVQQQKGKTIKLADAGEALTFPEGYAKGSSQLLLPATFLSAELALLQKSFHVNIQDTMIGELPPQTTKTLARFIPEVAVAYPKSKPLTTQIKIKKPPKVTMKTGKSLLHLHSTLEMFAARWRSKAPMSLFLLEVHFNLKVQYSVHENQLQMATSLDRLLSLSRKSSSIGNFNERELTGFITSYLEEAYIPVVNDVLQVGLPLPDFLAMNYNLAELDIVENALMLDLKLG

SEQ ID NO: 5611 - protein, 507 aa, unidentified
MCTKTIPVLWGCFLLWNLYVSSSQTIYPGIKARITQRALDYGVQAGMKMIEQMLKEKKLPDLSGSESLEFLKVDYVNYNFSNIKISAFSFPNTSLAFVPGVGIKALTNHGTANISTDWGFESPLFQDTGGADLFLSGVYFTGIIILTRNDFGHPTLKLQDCYAQLSHAHVSFSGELSVLYNSFAEPMEKPILKNLNEMLCPIIASEVKALNANLSTLEVLTKIDNYTLLDYSLISSPEITENYLDLNLKGVFYPLENLTDPPFSPVPFVLPERSNSMLYIGIAEYFFKSASFAHFTAGVFNVTLSTEEISNHFVQNSQGLGNVLSRIAEIYILSQPFMVRIMATEPPIINLQPGNFTLDIPASIMMLTQPKNSTVETIVSMDFVASTSVGLVILGQRLVCSLSLNRFRLALPESNRSNIEVLRFENILSSILHFGVLPLANAKLQQGFPLSNPHKFLFVNSDIEVLEGFLLISTDLKYETSSKQQPSFHVWEGLNLISRQWRGKSAP

SEQ ID NO: 5612 - protein, 677 aa, unidentified
MTGRVCRGCGGTDIELDAARGDAVCTACGSVLEDNIIVSEVQFVESSGGGSSAVGQFVSLDGAGKTPTLGGGFHVNLGKESRAQTLQNGRRHIHHLGNQLQLNQHCLDTAFNFFKMAVSRHLTRGRKMAHVIAACLYLVCRTEGTPHMLLDLSDLLQVNVYVLGKTFLLLARELCINAPAIDPCLYIPRFAHLLEFGEKNHEVSMTALRLLQRMKRDWMHTGRRPSGLCGAALLVAARMHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDPKDASGDGELDLSGIDDLEIDRYILNESEARVKAELWMRENAEYLREQREKEARIAKEKELGIYKEHKPKKSCKRREPIQASTAREAIEKMLEQKKISSKINYSVLRGLSSAGGGSPHREDAQPEHSASARKLSRRRTPASRSGADPVTSVGKRLRPLVSTQPAKKVATGEALLPSSPTLGAEPARPQAVLVESGPVSYHADEEADEEEPDEEDGEPCVSALQMMGSNDYGCDGDEDDGY

SEQ ID NO: 5613 - protein, 761 aa, unidentified
MNWRFVELLYFLFIWGRISVQPSHQEPAGTDQHVSKEFDWLISDRGPFHHSRSYLSFVERHRQGFTTRYKIYREFARWKVRNTAIERRDLVRHPVPLMPEFQRSIRLLGRRPTTQQFIDTIIKKYGTHLLISATLGGEEALTMYMDKSRLDRKSGNATQSVEALHQLASSYFVDRDGTMRRLHEIQISTGAIKVTETRTGPLGCNSYDNLDSVSSVLLQSTESKLHLQGLQIIFPQYLQEKFVQSALSYIMCNGEGEYLCQNSQCRCQCAEEFPQCNCPITDIQIMEYTLANMAKSWAEAYKDLENSDEFKSFMKRLPSNHFLTIGSIHQHWGNDWDLQNRYKLLQSATEAQRQKIQRTARKLFGLSVRCRHNPNHQLPRERTIQQWLARVQSLLYCNENGFWGTFLESQRSCVCHGSTTLCQRPIPCVIGGNNSCAMCSLANISLCGSCNKGYKLYRGRCEPQNVDSERSEQFISFETDLDFQDLELKYLLQKMDSRLYVHTTFISNEIRLDTFFDPRWRKRMSLTLKSNKNRMDFIHMVIGMSMRICQMRNSSLDPMFFVYVNPFSGSHSEGWNMPFGEFGYPRWEKIRLQNSQCYNWTLLLGNRWKTFFETVHIYLRSRTRLPTLLRNETGQGPVDLSDPSKRQFYIKISDVQVFGYSLRFNADLLRSAVQQVNQSYTQGGQFYSSSSVMLLLLDIRDRINRLAPPVAPGKPQLDLFSCMLKHRLKLTNSEIIRVNHALDLYNTEILKQSDQMTAKLC

SEQ ID NO: 5614 - protein, 783 aa, unidentified
MRWQCGTRFRGLRPAVAPWTALLALGLPGWVLAVSATAAAVVPEQHASVAGQHPLDWLLTDRGPFHRAQEYADFMERYRQGFTTRYRIYREFARWKVNNLALERKDFFSLPLPLAPEFIRNIRLLGRRPNLQQVTENLIKKYGTHFLLSATLGGEESLTIFVDKQKLGRKTETTGGASIIGGSGNSTAVSLETLHQLAASYFIDRESTLRRLHHIQIATGAIKVTETRTGPLGCSNYDNLDSVSSVLVQSPENKVQLLGLQVLLPEYLRERFVAAALSYITCSSEGELVCKENDCWCKCSPTFPECNCPDADIQAMEDSLLQIQDSWATHNRQFEESEEFQALLKRLPDDRFLNSTAISQFWAMDTSLQHRYQQLGAGLKVLFKKTHRILRRLFNLCKRCHRQPRFRLPKERSLSYWWNRIQSLLYCGESTFPGTFLEQSHSCTCPYDQSSCQGPIPCALGEGPACAHCAPDNSTRCGSCNPGYVLAQGLCRPEVAESLENFLGLETDLQDLELKYLLQKQDSRIEVHSIFISNDMRLGSWFDPSWRKRMLLTLKSNKYKPGLVHVMLALSLQICLTKNSTLEPVMAIYVNPFGGSHSESWFMPVNEGSFPDWERTNVDAAAQCQNWTITLGNRWKTFFETVHVYLRSRIKSLDDSSNETIYYEPLEMTDPSKNLGYMKINTLQVFGYSLPFDPDAIRDLILQLDYPYTQGSQDSALLQLIELRDRVNQLSPPGKVRLDLFSCLLRHRLKLANNEVGRIQSSLRAFNSKLPNPVEYETGKLCS

SEQ ID NO: 5615 - protein, 766 aa, unidentified
MIWRSRAGAELFSLMALWEWIALSLHCWVLAVAAVSDQHATSPFDWLLSDKGPFHRSQEYTDFVDRSRQGFSTRYKIYREFGRWKVNNLAVERRNFLGSPLPLAPEFFRNIRLLGRRPTLQQITENLIKKYGTHFLLSATLGGEESLTIFVDKRKLSKRAEGSDSTTNSSSVTLETLHQLAASYFIDRDSTLRRLHHIQIASTAIKVTETRTGPLGCSNYDNLDSVSSVLVQSPENKIQLQGLQVLLPDYLQERFVQAALSYIACNSEGEFICKENDCWCHCGPKFPECNCPSMDIQAMEENLLRITETWKAYNSDFEESDEFKLFMKRLPMNYFLNTSTIMHLWTMDSNFQRRYEQLENSMKQLFLKAQKIVHKLFSLSKRCHKQPLISLPRQRTSTYWLTRIQSFLYCNENGLLGSFSEETHSCTCPNDQVVCTAFLPCTVGDASACLTCAPDNRTRCGTCNTGYMLSQGLCKPEVAESTDHYIGFETDLQDLEMKYLLQKTDRRIEVHAIFISNDMRLNSWFDPSWRKRMLLTLKSNKYKSSLVHMILGLSLQICLTKNSTLEPVLAVYVNPFGGSHSESWFMPVNENSFPDWERTKLDLPLQCYNWTLTLGNKWKTFFETVHIYLRSRIKSNGPNGNESIYYEPLEFIDPSRNLGYMKINNIQVFGYSMHFDPEAIRDLILQLDYPYTQGSQDSALLQLLEIRDRVNKLSPPGQRRLDLFSCLLRHRLKLSTSEVVRIQSALQAFNAKLPNTMDYDTTKLCS

SEQ ID NO: 5616 - protein, 385 aa, unidentified; identical to SEQ ID NO: 604

SEQ ID NO: 5617 - protein, 132 aa, unidentified
MGSLMLLFVETTRNSSACIFPVILNELSSTVETITHFPEVTDGECVFPFHYKNGTYYDCIKSKARHKWCSLNKTYEGYWKFCSAEDFANCVFPFWYRRLIYWECTDDGEAFGKKWCSLTKNFNKDRIWKYCE

SEQ ID NO: 5618 - protein, 318 aa, unidentified
MAAQGCAASRLLQLLLQLLLLLLLLAAGGARARWRGEGTSAHLRDIFLGRCAEYRALLSPEQRNKNCTAIWEAFKVALDKDPCSVLPSDYDLFINLSRHSIPRDKSLFWENSHLLVNSFADNTRRFMPLSDVLYGRVADFLSWCRQKNDSGLDYQSCPTSEDCENNPVDSFWKRASIQYSKDSSGVIHVMLNGSEPTGAYPIKGFFADYEIPNLQKEKITRIEIWVMHEIGGPNVESCGEGSMKVLEKRLKDMGFQYSCINDYRPVKLLQCVDHSTHPDCALKSAAAATQRKAPSLYTEQRAGLIIPLFLVLASRTQL

SEQ ID NO: 5619 - protein, 478 aa, unidentified
MPRRGYSKPGSWGSFWAMLTLVGLVTHAAQRADVGGEAAGTSINHSQAVLQRLQELLRQGNASDVVLRVQAAGTDEVRVFHAHRLLLGLHSELFLELLSNQSEAVLQEPQDCAAVFDKFIRYLYCGELTVLLTQAIPLHRLATKYGVSSLQRGVADYMRAHLAGGAGPAVGWYHYAVGTGDEALRESCLQFLAWNLSAVAASTEWGAVSPELLWQLLQRSDLVLQDELELFHALEAWLGRARPPPAVAERALRAIRYPMIPPAQLFQLQARSAALARHGPAVADLLLQAYQFHAASPLHYAKFFDVNGSAFLPRNYLAPAWGAPWVINNPARDDRSTSFQTQLGPSGHDAGRRVTWNVLFSPRWLPVSLRPVYADAAGTALPAARPEDGRPRLVVTPASSGGDAAGVSFQKTVLVGARQQGRLLVRHAYSFHQSSEEAGDFLAHADLQRRNSEYLVENALHLHLIVKPVYHTLIRTPK

SEQ ID NO: 5620 - protein, 543 aa, unidentified
MAHAHIQGGRRAKSRFVVCIMSGARSKLALFLCGCYVVALGAHTGEESVADHHEAEYYVAAVYEHPSILSLNPLALISRQEALELMNQNLDIYEQQVMTAAQKDVQIIVFPEDGIHGFNFTRTSIYPFLDFMPSPQVVRWNPCLEPHRFNDTEVLQRLSCMAIRGDMFLVANLGTKEPCHSSDPRCPKDGRYQFNTNVVFSNNGTLVDRYRKHNLYFEAAFDVPLKVDLITFDTPFAGRFGIFTCFDILFFDPAIRVLRDYKVKHVVYPTAWMNQLPLLAAIEIQKAFAVAFGINVLAANVHHPVLGMTGSGIHTPLESFWYHDMENPKSHLIIAQVAKNPVGLIGAENATGETDPSHSKFLKILSGDPYCEKDAQEVHCDEATKWNVNAPPTFHSEMMYDNFTLVPVWGKEGYLHVCSNGLCCYLLYERPTLSKELYALGVFDGLHTVHGTYYIQVCALVRCGGLGFDTCGQEITEATGIFEFHLWGNFSTSYIFPLFLTSGMTLEVPDQLGWENDHYFLRKSRLSSGLVTAALYGRLYERD

SEQ ID NO: 5621 - protein, 523 aa, unidentified; identical to SEQ ID NO: 611

SEQ ID NO: 5622 - protein, 513 aa, unidentified; identical to SEQ ID NO: 612

SEQ ID NO: 5623 - protein, 334 aa, unidentified; identical to SEQ ID NO: 613

SEQ ID NO: 5624 - protein, 584 aa, unidentified; identical to SEQ ID NO: 614

SEQ ID NO: 5625 - protein, 212 aa, unidentified
MRSRLLLSVAHLPTIRETTEEMLLGGPGQEPPPSPSLDDYVRSISRLAQPTSVLDKATAQGQPRPPHRPAQACRKGRPAVSLRDITARFSGQQPTLPMADTVDPLDWLFGESQEKQPSQRDLPRRTGPSAGLWGPHRQMDSSKPMGAPRGRLCEARMPGHSLARPPQDGQQSSDLRSWTFGQSAQAMASRHRPRPSSVLRTLYSHLPVIHEL

SEQ ID NO: 5626 - protein, 257 aa, unidentified
MERSNAATKCGEEPRSGSRRLPKAEGDKSGSAGAPSKNSSRLGGRPCMCTAGRRPNRASGRRRRSCSPAPTWPPLCCYPQSRPTASAAGPGACMRASGRPHGNTTASTAPPRHPRPRRPGGPALRPTPRPCAGPAPPPASRDCRCRRPRRWPRAGRRGRRAGACKPSCAGAAWSARGAPLCSYRTSCAGSCGARTAPTPAPTCASPSAAASSCCRRRRACSSPTTAWSGACGAGPTAATAAQPGKPRSAAAPGRARA

SEQ ID NO: 5627 - protein, 81 aa, unidentified
MRLLVLSSLLCILLLCFSIFSTEGKRRPAKAWSGRRTRLCCHRVPSPNSTNLKGHHVRLCKPCKLEPEPRLWVVPGALPQV

SEQ ID NO: 5628 - protein, 150 aa, unidentified
MAASQCLCCSKFLFQRQNLACFLTNPHCGSLVNADGHGEVWTDWNNMSKFFQYGWRCTTNENTYSNRTLMGNWNQERYDLRNIVQPKPLPSQFGHYFETTYDTSYNNKMPLSTHRFKREPHWFPGHQPELDPPRYKCTEKSTYMNSYSKP

SEQ ID NO: 5629 - protein, 449 aa, unidentified; identical to SEQ ID NO: 622

SEQ ID NO: 5630 - protein, 145 aa, unidentified
MLTRLVLSAHLSSTTSPPWTHAAISWELDNVLMPSPRIWPQVTPTGRSASVRSEGNTSSLWNFSAGQDVHAIVTRTCESVLSSAVYTHGCGCVRSATNITCQSSGQQRQAARQEEENSICKAHDSREGRLGYPLSAHQPGSGGPN

SEQ ID NO: 5631 - protein, 98 aa, unidentified
MVLAMLGALHPRAGLSLFLHLILAVALLRSQPLRSQRSVPEAFSAPLELSQPLSGLVDDYGILPKHPRPRGPRPLLSRAQQRKRDGPDLAEYYYDAHL

SEQ ID NO: 5632 - protein, 213 aa, unidentified
MYENFVEEVDAVDNGISQWAEGEPRYALTTTLSARVARLNPTWNHPDQDTEAGFKRAMDLVQEEFLQRLDFYQHSWLPARALVEEALAQRFQVDPSGEIVELAKGACPWKEHLYHLESGLSPPVAIFFVIYTDQAGQWRIQCVPKEPHSFQSRLPLPEPWRGLRDEALDQVSGIPGCIFVHASGFTGGHHTREGALSMARATLAQRSYLPQIS

SEQ ID NO: 5633 - protein, 205 aa, unidentified
MVNLAAMVWRRLLRKRWVLALVFGLSLVYFLSSTFKQEERAVRDRNLLQVHDHNQPIPWKVQFNLGNSSRPSNQCRNSIQGKHLITDELGYVCERKDLLVNGCCNVNVPSTKQYCCDGCWPNGCCSAYEYCVSCCLQPNKQLLLERFLNRAAVAFQNLFMAVEDHFELCLAKCRTSSQSVQHENTYRDPIAKYCYGESPPELFPA

SEQ ID NO: 5634 - protein, 71 aa, unidentified
MPAGVPMSTYLKMFAASLLAMCAGAEVVHRYYRPDLTIPEIPPKRGELKTELLGLKERKHKPQVSQQEELK

SEQ ID NO: 5635 - protein, 135 aa, unidentified; identical to SEQ ID NO: 625

SEQ ID NO: 5636 - protein, 495 aa, unidentified
MGRRRQRVDPAAGARAGALPEAIAALSRSLPSGPSPEIFRRAKFDRPEATSALWQLLFRVLSPLPAGNALASLALEVQARLVKSALCSQGYPRLALAQLPEDGSQGSRELLLALSWLLARGPVPEQMLAQARVPLGDEMTVCQCEALASPGPPAPHMEAEGPVDVRHVQWLMGKLRFRWRQLVSSQQEQCALLSKIHLYTRGCHSDQSLSHLSVTEAEMLRDPEGGQQVSGAGAAQNLDLAYPKCLHSFCTPGMGPRTFWNDLWLVCEQPGLLPGDWAAPLDPGGASACSLLSPFRALLRTLERENQRLEAVLAWRRSELVFWRWMDTVLGTCAPEVPAAASQPTFLPWVPERGGGELDLVVRELQALEEELREAAERRRAAWEAKAGGCGRGPEWSAARRASREAVEKELGALQQCWERDGGPAQPHGPHRLVRREDGAAGDRDLRAAVVIRTLRSQEACLEAVLRRLQGQCRQELARLVGARPGLIWIPPPGR

SEQ ID NO: 5637 - protein, 538 aa, unidentified
MSFSATILFSPPSGSEARCCCCACKSETNGGNTGSQGGNPPPSTPITVTGHGLAVQSSEQLLHVIYQRVDKAVGLAEAALGLARANNELLKRLQEEVGDLRQGKVSIPDEDGESRAHSSPPEEPGPLKESPGEAFKALSAVEEECDSVGSGVQVVIEELRQLGAASVGPGPLGFPATQRDMRLPGCTLAASEAAPLLNPLVDDYVASEGAVQRVLVPAYAKQLSPATQLAIQRATPETGPENGTKLPPPRPEDMLNAAAALDSALEESGPGSTGELRHSLGLTVSPCRTRGSGQKNSRRKRDLVLSKLVHNVHNHITNDKRFNGSESIKSSWNISVVKFLLEKLKQELVTSPHNYTDKELKGACVAYFLTKRREYRNSLNPFKGLKEKEEKKLRSRRYRLFANRSSIMRHFGPEDQRLWNDVTEELMSDEEDSLNEPGVWVARPPRFRAQRLTELCYHLDANSKHGTKANRVYGPPSDRLPSAEAQLLPPELYNPNFQEEEDEGGDENAPGSPSFDQPHKTCCPDLNSFIEIKVEKDE

SEQ ID NO: 5638 - protein, 402 aa, unidentified
MASLGLLLLLLLTALPPLWSSSLPGLDTAESKATIADLILSALERATVFLEQRLPEINLDGMVGVRVLEEQLKSVREKWAQEPLLQPLSLRVGMLGEKLEAAIQRSLHYLKLSDPKYLREFQLTLQPGFWKLPHAWIHTDASLVYPTFGPQDSFSEERSDVCLVQLLGTGTDSSEPCGLSDLCRSLMTKPGCSGYCLSHQLLFFLWARMRGCTQGPLQQSQDYINLFCANMMDLNRRAEAIGYAYPTRDIFMENIMFCGMGGFSDFYKLRWLEAILSWQKQQEGCFGEPDAEDEELSKAIQYQQHFSRRVKRREKQFPDSRSVAQAGVQWRNLGSLQPLPPGFKQFSCLILPSSWDYRSVPPYLANFYIFLVETGFHHVAHAGLELLISRDPPTSGSQSVGL

SEQ ID NO: 5639 - protein, 182 aa, unidentified
MEALVCAFSELHIREDAVSQAQGRPGHPDAPPNIYEGGLGSPQPQCPSAQGSKPKNFRLRHLRGLGLYLESHPPPTGQCESHWLGRLMAGGCLPQPEGTAWALDLPQGTLGPRNSLCSALLEARLPRDSLGSSASSSSMDPDKGALPQPSPSRLRPKRSWGTWEEAMCPLCKRTRSGALERP

SEQ ID NO: 5640 - protein, 97 aa, unidentified
MNRLYLTPDGFFFRVHMLALDSSSCNKPCPEFKPGSRYIVMGHIYHKRRQLPTALLQVLRGRLRPGDGLLRSSSSYVKRFNRKREGQIQGAIHTQCI

SEQ ID NO: 5641 - protein, 90 aa, unidentified
MKTLPVLVLSLTLLTVFSETSPILTEKQAKQLLRSRRQDRPSKPGFPDEPMREYMHHLLALEHRAEEQFLEHWLNPHCKPHCDRNRIHPV

SEQ ID NO: 5642 - protein, 396 aa, unidentified
MLPSLQESMDGDEKELESSEEGGSAEERRLEPPSSSHYCLYSYRGSRLAQQRGDSEDGSPSGTNAETPSGDDFSLSLADTNLPSEVEPELRSFIAKRLSRGAVFEGLGNVASVELKIPGYRVGCYYCLFQNEKLLPETVTIDSERNPSEYVVCFLGGSEKGLELFRLELDKYIQGLKNNMNCEARGLESHIKSYLSSWFEDVVCPIQRVVLLFQEKLTFLLHAALSYTPVEVKESDEKTKRDINRFLSVASLQGLIHEGTMTSLCMAMTEEQHKSVVIDCSSSQPQFCNAGSNRFCEDWMQAFLNGAKGGNPFLFRQVLENFKLKAIQDTNNLKRFIRQAEMNHYALFKCYMFLKNCGSGDILLKIVKVEHEEMPEAKNVIAVLEEFMKEALDQSF

SEQ ID NO: 5643 - protein, 265 aa, unidentified
MGLPGLFCLAVLAASSFSKAREEEITPVVSIAYKVLEVFPKGRWVLITCCAPQPPPPITYSLCGTKNIKVAKKVVKTHEPASFNLNVTLKSSPDLLTYFCWASSTSGAHVDSARLQMHWELWSKPVSELRANFTLQDRGAGPRVEMICQASSGSPPITNSLIGKDGQVHLQQRPCHRQPANFSFLPSQTSDWFWCQAANNANVQHSALTVVPPGGDQKMEDWQGPLESPILALPLYRSTRRLSEEEFGGFRIGNGEVRGRKAAAM

SEQ ID NO: 5644 - protein, 372 aa, unidentified
MAKSKTKHRLCSQESSVSALLASCTLSGSNSSNSDGSFHYKDKLYRSASQALQAYIDDFDLGQIYPGASTGKINIDEDFTNMSQFCNYIYKPNNAFENLDHKKHSNFISCRRHTVNDIDSMSLTTDDLLRLPADGSFSYTYVGPSHRTSKKNKKCRGRLGSLDIEKNPHFQGPYTSMGKDNFVTPVIRSNINGKQCGDKIELLILKAKRNLEQCTEELPKSMKKDDSPCSLDKLEADRSWENIPVTFKSPVPVNSDDSPQQTSRAKSAKGVLEDFLNNDNQSCTLSGGKHHGPVEALKQMLFNLQAVQERFNQNKTTDPKEEIKQVSEDDFSKLQLKESMIPITRSLQKALHHLSRLRDLVDDTNGERSPKM

SEQ ID NO: 5645 - protein, 422 aa, unidentified
MVMAALSLVAACWGRAAADESVQLPAAPGSSVRARETMVSVTMATSEWIQFFKEAGIPPGPAVNYAVMFVDNRIQKSMLLDLNKEIMNELGVTVVGDIIAILKHAKVVHRQDMCKAATESVPCSPSPLAGEIRRGTSAASRMITNSLNHDSPPSTPPRRPDTSTSKISVTVSNKMAAKSAKATAALARREEESLAVPAKRRRVTAEMEGKYVINMPKGTTPRTRKILEQQQAAKGLHRTSVFDRLGAETKADTTTGSKPTGVFSRLGATPETDEDLAWDSDNDSSSSVLQYAGVLKKLGRGPAKASPQPALTVKAKATSSATTAAAPTLRRLALSSRSGLERKPESLSKVSIIKRLGAAALVPEAQDSQVTSTKSKSSAEVKVTIKRTLVGPRGSSSSEGLGAQMDHAGTVSVFKRLGRRTF

SEQ ID NO: 5646 - protein, 118 aa, unidentified
MVARVWSLMRFLIKGSVAGGAVYLVYDQELLGPSDKSQAALQKAGEVVPPAMYQFSQYVCQQTGLQIPQLPAPPKIYFPIRDSWNAGIMTVMSALSVAPSKAREYSKEGWEYVKARTK

SEQ ID NO: 5647 - protein, 363 aa, unidentified
MASKSWLNFLTFLCGSAIGFLLCSQLFSILLGEKVDTQPNVLHNDPHARHSDDNGQNHLEGQMNFNADSSQHKDENTDIAENLYQKVRILCWVMTGPQNLEKKAKHVKATWAQRCNKVLFMSSEENKDFPAVGLKTKEGRDQLYWKTIKAFQYVHEHYLEDADWFLKADDDTYVILDNLRWLLSKYDPEEPIYFGRRFKPYVKQGYMSGGAGYVLSKEALKRFVDAFKTDKCTHSSSIEDLALGRCMEIMNVEAGDSRDTIGKETFHPFVPEHHLIKGYLPRTFWYWNYNYYPPVEGPGCCSDLAVSFHYVDSTTMYELEYLVYHLRPYGYLYRYQPTLPERILKEISQANKNEDTKVKLGNP

SEQ ID NO: 5648 - protein, 823 aa, unidentified
MWGSPALAWAVWLACVQPTVFPWSLSFRSDTDKPSSAAEVLTEASSCWTDTVECFSDYMTLWIPRSHVEGLRRWLARTLHLPGTWRSPDHLDSSLAKCGYFLHLASDGDFLFRVQYSACFVQKEKANYRLEIRIFQKGVMGLERSDRYIMKCPMLRSRLGQESVHCGPMFIQVSRPLPLWRDNRQTPWLLSLRGELVASLEDASLMGLYVDMNATTVTVQSPRQGLLQRWEVLNTSAELLPLWLVSGHHAYSLEAACPPVSFQPESEVLVHIPKQRLGLVKRGSYIEETLSLRFLRVHQSNIFMVTENKDFVVVSIPAAGVLQVQRCQEVGGTPGTQAFYRVDLSLEFAEMAAPVLWTVESFFQCVGSGTESPASTAALRTTPSPPSPGPETPPAGVPPAASSQVWAAGPAAQEWLSRDLLHRPSDALAKKGLGPFLQTAKPARRGQTSASILPRVVQAQRGPQPPPGEAGIPGHPTPPATLPSEPVEGVQASPWRPRPVLPTHPALTLPVSSDASSPSPPAPRPERPESLLVSGPSVTLTEGLGTVRPEQDPAKSPGSPLLLRGLSSGDVAAPEPIMGEPGQASEEFQPLARPWRATLAAEELVSHRSPGEPQETCSGTEVERPRQTGPGLPREGARGHMDLSSSEPSQDIEGPGLSILPARDATFSTPSVRQPDPSAWLSSGPELTGMPRVRLAAPLAVLPMEPLPPEPVRPAALLTPEASSVGGPDQARYLESAPGWPVGQEEWGVAHTSSPPSTQTLSLWAPTGVLLPSLVELEYPFQAGRGASLQQELTEPTLALSAESHRPPELQDSVEGLSERPSR

SEQ ID NO: 5649 - protein, 380 aa, unidentified; identical to SEQ ID NO: 645

SEQ ID NO: 5650 - protein, 327 aa, unidentified
MASMAAAIAASRSAVMSGNRPLDDRERKRFTYFSSLSPMARKIMQDKEKIREKYGPEWARLPPAQQDEIIDRCLVGPRAPAPRDPGDSEELTRFPGLRGPTGQKVVRFGDEDLTWQDEHSAPFSWETKSQMEFSISALSIQEPSNGTAASEPRPLSKASQGSQALKSSQGSRSSSLDALGPTRKEEEASFWKINAERSRGEGPEAEFQSLTPSQIKSMEKGEKVLPPCYRQEPAPKDREAKVERPSTLRQEQRPLPNVSTERERPQPVQAFSSALHEAAPSQLEGKLPSPDVRQDDGEDTLFSEPKFAQVSSSNVVLKTGFDFLDNW

SEQ ID NO: 5651 - protein, 121 aa, unidentified
MSLHGILASAGTIGAVAAWLMSYKPALFGFLFLLLLLSNWLVKYEHKLTLPEPQQDEILQRLLFSEMKMKVLENQMFIIWNKMNHHGRSSRHRNFPMKKHRMRRHESICPTLSDCTSSSPS

SEQ ID NO: 5652 - protein, 121 aa, unidentified
MDVLFVAIFAVPLILGQEYEDEERLGEDEYYQVVYYYTVTPSYDDFSADFTIDYSIFESEDRLNRLDKDITEAIETTISLETARADHPKPVTVKPVTTEPVEEGCYDSLDGSLARGNWKIK

SEQ ID NO: 5653 - protein, 341 aa, unidentified
MVPAAGALLWVLLLNLGPRAAGAQGLTQTPTEMQRVSLRFGGPMTRSYRSTARTGLPRKTRIILEDENDAMADADRLAGPAAAELLAATVSTGFSRSSAINEEDGSSEEGVVINAGKDSTSRELPSATPNTAGSSSTRFIANSQEPEIRLTSSLPRSPGRSTEDLPGSQATLSQWSTPGSTPSRWPSPSPTAMPSPEDLRLVLMPWGPWHCHCKSGTMSRSRSGKLHGLSGRLRVGALSQLRTEHKPCTYQQCPCNRLREECPLDTSLCTDTNCASQSTTSTRTTTTPFPTIHLRSSPSLPPASPCPALAFWKRVRIGLEDIWNSLSSVFTEMQPIDRNQR

SEQ ID NO: 5654 - protein, 245 aa, unidentified
MEGPRGWLVLCVLAISLASMVTEDLCRAPDGKKGEAGRPGRRGRPGLKGEQGEPGAPGIRTGIQGLKGDQGEPGPSGNPGKVGYPGPSGPLGARGIPGIKGTKGSPGNIKDQPRPAFSAIRRNPPMGGNVVIFDTVITNQEEPYQNHSGRFVCTVPGYYYFTFQVLSQWEICLSIVSSSRGQVRRSLGFCDTTNKGLFQVVSGGMVLQLQQGDQVWVEKDPKKGHIYQGSEADSVFSGFLIFPSA

SEQ ID NO: 5655 - protein, 253 aa, unidentified
MMMKIPWGSIPVLMLLLLLGLIDISQAQLSCTGPPAIPGIPGIPGTPGPDGQPGTPGIKGEKGLPGLAGDHGEFGEKGDPGIPGNPGKVGPKGPMGPKGGPGAPGAPGPKGESGDYKATQKIAFSATRTINVPLRRDQTIRFDHVITNMNNNYEPRSGKFTCKVPGLYYFTYHASSRGNLCVNLMRGRERAQKVVTFCDYAYNTFQVTTGGMVLKLEQGENVFLQATDKNSLLGMEGANSIFSGFLLFPDMEA

SEQ ID NO: 5656 - protein, 245 aa, unidentified
MDVGPSSLPHLGLKLLLLLLLLPLRGQANTGCYGIPGMPGLPGAPGKDGYDGLPGPKGEPGIPAIPGIRGPKGQKGEPGLPGHPGKNGPMGPPGMPGVPGPMGIPGEPGEEGRYKQKFQSVFTVTRQTHQPPAPNSLIRFNAVLTNPQGDYDTSTGKFTCKVPGLYYFVYHASHTANLCVLLYRSGVKVVTFCGHTSKTNQVNSGGVLLRLQVGEEVWLAVNDYYDMVGIQGSDSVFSGFLLFPD

SEQ ID NO: 5657 - protein, 258 aa, unidentified
MLLVLVVLIPVLVSSGGPEGHYEMLGTCRMVCDPYPARGPGAGARTDGGDALSEQSGAPPPSTLVQGPQGKPGRTGKPGPPGPPGDPGPPGPVGPPGEKGEPGKPGPPGLPGAGGSGAISTATYTTVPRVAFYAGLKNPHEGYEVLKFDDVVTNLGNNYDAASGKFTCNIPGTYFFTYHVLMRGGDGTSMWADLCKNGQVRASAIAQDADQNYDYASNSVILHLDAGDEVFIKLDGGKAHGGNSNKYSTFSGFIIYSD

SEQ ID NO: 5658 - protein, 287 aa, unidentified
MALGLLIAVPLLLQAAPRGAAHYEMMGTCRMICDPYTAAPGGEPPGAKAQPPGPSTAALEVMQDLSANPPPPFIQGPKGDPGRPGKPGPRGPPGEPGPPGPRGPPGEKGDSGRPGLPGLQLTAGTASGVGVVGGGAGVGGDSEGEVTSALSATFSGPKIAFYVGLKSPHEGYEVLKFDDVVTNLGNHYDPTTGKFSCQVRGIYFFTYHILMRGGDGTSMWADLCKNGQVRASAIAQDADQNYDYASNSVVLHLDSGDEVYVKLDGGKAHGGNNNKYSTFSGFLLYPD

SEQ ID NO: 5659 - protein, 255 aa, unidentified
MVLLLVILIPVLVSSAGTSAHYEMLGTCRMVCDPYGGTKAPSTAATPDRGLMQSLPTFIQGPKGEAGRPGKAGPRGPPGEPGPPGPMGPPGEKGEPGRQGLPGPPGAPGLNAAGAISAATYSTVPKIAFYAGLKRQHEGYEVLKFDDVVTNLGNHYDPTTGKFTCSIPGIYFFTYHVLMRGGDGTSMWADLCKNNQVRASAIAQDADQNYDYASNSVVLHLEPGDEVYIKLDGGKAHGGNNNKYSTFSGFIIYAD

SEQ ID NO: 5660 - protein, 238 aa, unidentified
MVLLLLVAIPLLVHSSRGPAHYEMLGRCRMVCDPHGPRGPGPDGAPASVPPFPPGAKGEVGRRGKAGLRGPPGPPGPRGPPGEPGRPGPPGPPGPGPGGVAPAAGYVPRIAFYAGLRRPHEGYEVLRFDDVVTNVGNAYEAASGKFTCPMPGVYFFAYHVLMRGGDGTSMWADLMKNGQVRASAIAQDADQNYDYASNSVILHLDVGDEVFIKLDGGKVHGGNTNKYSTFSGFIIYPD

SEQ ID NO: 5661 - protein, 281 aa, unidentified
MGSRGQGLLLAYCLLLAFASGLVLSRVPHVQGEQQEWEGTEELPSPPDHAERAEEQHEKYRPSQDQGLPASRCLRCCDPGTSMYPATAVPQINITILKGEKGDRGDRGLQGKYGKTGSAGARGHTGPKGQKGSMGAPGERCKSHYAAFSVGRKKPMHSNHYYQTVIFDTEFVNLYDHFNMFTGKFYCYVPGLYFFSLNVHTWNQKETYLHIMKNEEEVVILFAQVGDRSIMQSQSLMLELREQDQVWVRLYKGERENAIFSEELDTYITFSGYLVKHATEP

SEQ ID NO: 5662 - protein, 302 aa, unidentified
MRRWAWAAVVVLLGPQLVLLGGVGARREAQRTQQPGQRADPPNATASASSREGLPEAPKPSQASGPEFSDAHMTWLNFVRRPDDGALRKRCGSRDKKPRDLFGPPGPPGAEVTAETLLHEFQELLKEATERRFSGLLDPLLPQGAGLRLVGEAFHCRLQGPRRVDKRTLVELHGFQAPAAQGAFLRGSGLSLASGRFTAPVSGIFQFSASLHVDHSELQGKARLRARDVVCVLICIESLCQRHTCLEAVSGLESNSRVFTLQVQGLLQLQAGQYASVFVDNGSGAVLTIQAGSSFSGLLLGT

SEQ ID NO: 5663 - protein, 285 aa, unidentified
MIPWVLLACALPCAADPLLGAFARRDFRKGSPQLVCSLPGPQGPPGPPGAPGPSGMMGRMGFPGKDGQDGHDGDRGDSGEEGPPGRTGNRGKPGPKGKAGAIGRAGPRGPKGVNGTPGKHGTPGKKGPKGKKGEPGLPGPCSCGSGHTKSAFSVAVTKSYPRERLPIKFDKILMNEGGHYNASSGKFVCGVPGIYYFTYDITLANKHLAIGLVHNGQYRIRTFDANTGNHDVASGSTILALKQGDEVWLQIFYSEQNGLFYDPYWTDSLFTGFLIYADQDDPNEV

SEQ ID NO: 5664 - protein, 246 aa, unidentified
MLWRQLIYWQLLALFFLPFCLCQDEYMESPQTGGLPPDCSKCCHGDYSFRGYQGPPGPPGPPGIPGNHGNNGNNGATGHEGAKGEKGDKGDLGPRGERGQHGPKGEKGYPGIPPELQIAFMASLATHFSNQNSGIIFSSVETNIGNFFDVMTGRFGAPVSGVYFFTFSMMKHEDVEEVYVYLMHNGNTVFSMYSYEMKGKSDTSSNHAVLKLAKGDEVWLRMGNGALHGDHQRFSTFAGFLLFETK

SEQ ID NO: 5665 - protein, 329 aa, unidentified
MLPLLLGLLGPAACWALGPTPGPGSSELRSAFSAARTTPLEGTSEMAVTFDKVYVNIGGDFDVATGQFRCRVPGAYFFSFTAGKAPHKSLSVMLVRNRDEVQALAFDEQRRPGARRAASQSAMLQLDYGDTVWLRLHGAPQYALGAPGATFSGYLVYADADADAPARGPPAPPEPRSAFSAARTRSLVGSDAGPGPRHQPLAFDTEFVNIGGDFDAAAGVFRCRLPGAYFFSFTLGKLPRKTLSVKLMKNRDEVQAMIYDDGASRRREMQSQSVMLALRRGDAVWLLSHDHDGYGAYSNHGKYITFSGFLVYPDLAPAAPPGLGASELL

SEQ ID NO: 5666 - protein, 243 aa, unidentified
MRPLLVLLLLGLAAGSPPLDDNKIPSLCPGHPGLPGTPGHHGSQGLPGRDGRDGRDGAPGAPGEKGEGGRPGLPGPRGDPGPRGEAGPAGPTGPAGECSVPPRSAFSAKRSESRVPPPSDAPLPFDRVLVNEQGHYDAVTGKFTCQVPGVYYFAVHATVYRASLQFDLVKNGESIASFFQFFGGWPKPASLSGGAMVRLEPEDQVWVQVGVGDYIGIYASIKTDSTFSGFLVYSDWHSSPVFA

SEQ ID NO: 5667 - protein, 289 aa, unidentified
MFVLLYVTSFAICASGQPRGNQLKGENYSPRYICSIPGLPGPPGPPGANGSPGPHGRIGLPGRDGRDGRKGEKGEKGTAGLRGKTGPLGLAGEKGDQGETGKKGPIGPEGEKGEVGPIGPPGPKGDRGEQGDPGLPGVCRCGSIVLKSAFSVGITTSYPEERLPIIFNKVLFNEGEHYNPATGKFICAFPGIYYFSYDITLANKHLAIGLVHNGQYRIKTFDANTGNHDVASGSTVIYLQPEDEVWLEIFFTDQNGLFSDPGWADSLFSGFLLYVDTDYLDSISEDDEL

SEQ ID NO: 5668 - protein, 252 aa, unidentified
MAAPALLLLALLLPVGAWPGLPRRPCVHCCRPAWPPGPYARVSDRDLWRGDLWRGLPRVRPTIDIEILKGEKGEAGVRGRAGRSGKEGPPGARGLQGRRGQKGQVGPPGAACRRAYAAFSVGRREGLHSSDHFQAVPFDTELVNLDGAFDLAAGRFLCTVPGVYFLSLNVHTWNYKETYLHIMLNRRPAAVLYAQPSERSVMQAQSLMLLLAAGDAVWVRMFQRDRDNAIYGEHGDLYITFSGHLVKPAAEL

SEQ ID NO: 5669 - protein, 333 aa, unidentified
MRIWWLLLAIEICTGNINSQDTCRQGHPGIPGNPGHNGLPGRDGRDGAKGDKGDAGEPGRPGSPGKDGTSGEKGERGADGKVEAKGIKGDQGSRGSPGKHGPKGLAGPMGEKGLRGETGPQGQKGNKGDVGPTGPEGPRGNIGPLGPTGLPGPMGPIGKPGPKGEAGPTGPQGEPGVRGIRGWKGDRGEKGKIGETLVLPKSAFTVGLTVLSKFPSSDMPIKFDKILYNEFNHYDTAAGKFTCHIAGVYYFTYHITVFSRNVQVSLVKNGVKILHTKDAYMSSEDQASGGIVLQLKLGDEVWLQVTGGERFNGLFADEDDDTTFTGFLLFSSP

SEQ ID NO: 5670 - protein, 333 aa, unidentified
MRIWWLLLAIEICTGNINSQDTCRQGHPGIPGNPGHNGLPGRDGRDGAKGDKGDAGEPGCPGSPGKDGTSGEKGERGADGKVEAKGIKGDQGSRGSPGKHGPKGLAGPMGEKGLRGETGPQGQKGNKGDVGPTGPEGPRGNIGPLGPTGLPGPMGPIGKPGPKGEAGPTGPQGEPGVRGIRGWKGDRGEKGKIGETLVLPKSAFTVGLTVLSKFPSSDVPIKFDKILYNEFNHYDTAVGKFTCHIAGVYYFTYHITVFSRNVQVSLVKNGVKILHTRDAYVSSEDQASGSIVLQLKLGDEMWLQVTGGERFNGLFADEDDDTTFTGFLLFSSQ

SEQ ID NO: 5671 - protein, 705 aa, unidentified
MWLLYLLVPALFCRAGGSIPIPQKLFGEVTSPLFPKPYPNNFETTTVITVPTGYRVKLVFQQFDLEPSEGCFYDYVKISADKKSLGRFCGQLGSPLGNPPGKKEFMSQGNKMLLTFHTDFSNEENGTIMFYKGFLAYYQAVDLDECASRSKSGEEDPQPQCQHLCHNYVGGYFCSCRPGYELQEDTHSCQAECSSELYTEASGYISSLEYPRSYPPDLRCNYSIRVERGLTLHLKFLEPFDIDDHQQVHCPYDQLQIYANGKNIGEFCGKQRPPDLDTSSNAVDLLFFTDESGDSRGWKLRYTTEIIKCPQPKTLDEFTIIQNLQPQYQFRDYFIATCKQGYQLIEGNQVLHSFTAVCQDDGTWHRAMPRCKIKDCGQPRNLPNGDFRYTTTMGVNTYKARIQYYCHEPYYKMQTRAGSRESEQGVYTCTAQGIWKNEQKGEKIPRCLPVCGKPVNPVEQRQRIIGGQKAKMGNFPWQVFTNIHGRGGGALLGDRWILTAAHTLYPKEHEAQSNASLDVFLGHTNVEELMKLGNHPIRRVSVHPDYRQDESYNFEGDIALLELENSVTLGPNLLPICLPDNDTFYDLGLMGYVSGFGVMEEKIAHDLRFVRLPVANPQACENWLRGKNRMDVFSQNMFCAGHPSLKQDACQGDSGGVFAVRDPNTDRWVATGIVSWGIGCSRGYGFYTKVLNYVDWIKKEMEEED

SEQ ID NO: 5672 - protein, 487 aa, unidentified
MPGPRVWGKYLWRSPHSKGCPGAMWWLLLWGVLQACPTRGSVLLAQELPQQLTSPGYPEPYGKGQESSTDIKAPEGFAVRLVFQDFDLEPSQDCAGDSVTISFVGSDPSQFCGQQGSPLGRPPGQREFVSSGRSLRLTFRTQPSSENKTAHLHKGFLALYQTVAVNYSQPISEASRGSEAINAPGDNPAKVQNHCQEPYYQAAAAGALTCATPGTWKDRQDGEEVLQCMPVCGRPVTPIAQNQTTLGSSRAKLGNFPWQAFTSIHGRGGGALLGDRWILTAAHTIYPKDSVSLRKNQSVNVFLGHTAIDEMLKLGNHPVHRVVVHPDYRQNESHNFSGDIALLELQHSIPLGPNVLPVCLPDNETLYRSGLLGYVSGFGMEMGWLTTELKYSRLPVAPREACNAWLQKRQRPEVFSDNMFCVGDETQRHSVCQGDSGSVYVVWDNHAHHWVATGIVSWGIGCGEGYDFYTKVLSYVDWIKGVMNGKN

SEQ ID NO: 5673 - protein, 688 aa, unidentified
MWCIVLFSLLAWVYAEPTMYGEILSPNYPQAYPSEVEKSWDIEVPEGYGIHLYFTHLDIELSENCAYDSVQIISGDTEEGRLCGQRSSNNPHSPIVEEFQVPYNKLQVIFKSDFSNEERFTGFAAYYVATDINECTDFVDVPCSHFCNNFIGGYFCSCPPEYFLHDDMKNCGVNCSGDVFTALIGEIASPNYPKPYPENSRCEYQIRLEKGFQVVVTLRREDFDVEAADSAGNCLDSLVFVAGDRQFGPYCGHGFPGPLNIETKSNALDIIFQTDLTGQKKGWKLRYHGDPMPCPKEDTPNSVWEPAKAKYVFRDVVQITCLDGFEVVEGRVGATSFYSTCQSNGKWSNSKLKCQPVDCGIPESIENGKVEDPESTLFGSVIRYTCEEPYYYMENGGGGEYHCAGNGSWVNEVLGPELPKCVPVCGVPREPFEEKQRIIGGSDADIKNFPWQVFFDNPWAGGALINEYWVLTAAHVVEGNREPTMYVGSTSVQTSRLAKSKMLTPEHVFIHPGWKLLEVPEGRTNFDNDIALVRLKDPVKMGPTVSPICLPGTSSDYNLMDGDLGLISGWGRTEKRDRAVRLKAARLPVAPLRKCKEVKVEKPTADAEAYVFTPNMICAGGEKGMDSCKGDSGGAFAVQDPNDKTKFYAAGLVSWGPQCGTYGLYTRVKNYVDWIMKTMQENSTPRED

SEQ ID NO: 5674 - protein, 752 aa, unidentified
MGPLMVLFCLLFLYPGLADSAPSCPQNVNISGGTFTLSHGWAPGSLLTYSCPQGLYPSPASRLCKSSGQWQTPGATRSLSKAVCKPVRCPAPVSFENGIYTPRLGSYPVGGNVSFECEDGFILRGSPVRQCRPNGMWDGETAVCDNGAGHCPNPGISLGAVRTGFRFGHGDKVRYRCSSNLVLTGSSERECQGNGVWSGTEPICRQPYSYDFPEDVAPALGTSFSHMLGATNPTQKTKESLGRKIQIQRSGHLNLYLLLDCSQSVSENDFLIFKESASLMVDRIFSFEINVSVAIITFASEPKVLMSVLNDNSRDMTEVISSLENANYKDHENGTGTNTYAALNSVYLMMNNQMRLLGMETMAWQEIRHAIILLTDGKSNMGGSPKTAVDHIREILNINQKRNDYLDIYAIGVGKLDVDWRELNELGSKKDGERHAFILQDTKALHQVFEHMLDVSKLTDTICGVGNMSANASDQERTPWHVTIKPKSQETCRGALISDQWVLTAAHCFRDGNDHSLWRVNVGDPKSQWGKEFLIEKAVISPGFDVFAKKNQGILEFYGDDIALLKLAQKVKMSTHARPICLPCTMEANLALRRPQGSTCRDHENELLNKQSVPAHFVALNGSKLNINLKMGVEWTSCAEVVSQEKTMFPNLTDVREVVTDQFLCSGTQEDESPCKGESGGAVFLERRFRFFQVGLVSWGLYNPCLGSADKNSRKRAPRSKVPPPRDFHINLFRMQPWLRQHLGDVLNFLPL

SEQ ID NO: 5675 - protein, 219 aa, unidentified
MAPPSRHCLLLISTLGVFALNCFTKGQKNSTLIFTRENTIRNCSCSADIRDCDYSLANLMCNCKTVLPLAVERTSYNGHLTIWFTDTSALGHLLNFTLVQDLKLSLCSTNTLPTEYLAICGLKRLRINMEAKHPFPEQSLLIHSGGDSDSREKPMWLHKGWQPCMYISFLDMALFNRDSAFKSYSIENVTSIANNFPDFSYFRTFPMPSNKSYVVTFIY

SEQ ID NO: 5676 - protein, 148 aa, unidentified
MFIKVMFGAGCSVLVNTSCRLVNLTAHLRQKAGLPPDATIALLAEDGNLVSLEEDLKEGASRAQTMGNSLLKERAIYVLVRIIKGEDMASTRYESLLENLDDHYPELAEELRRLSGLSSVGHNWRKRMGTRRGRHEQSPTSRPRKGPD

SEQ ID NO: 5677 - protein, 243 aa, unidentified
MLLSLLGACAVVGPFHGPEWEPVQGLLSQNHSCRDPQCCGNLLVLCLFLVWQVRHCWHQVTRTRFSTRNVIKVPLQKRAVPSMRCETVFKLTPEFFSPGKSRGLDSQQCAQRQRWGYRRSLQESWAQNLLSPQHPCPGPPSGVHTHSEPIFCTTSISNTCLLPQNSSWKAWQVPWCLHDGQTRPALDMCQEMEQLLLHSQERLVSLEPVISVRSRPTSMTLTTSLPNLLSAERLQFCPQRAPA

SEQ ID NO: 5678 - protein, 696 aa, unidentified
MAMARLGSWLGEAQWLALVSLFVAALATVGLYLAQWALARARPQPQRRAVEPGEGPRPGSDALLSWILTLGSWRSQWQAAWVTALNEEAERKGGPPFLSFEEDPRQQALELVVQEVSSVLRSAEEKVVVCHVVGQAIQFLVSETPALGAGCRLYDMRLSPFHLQLEFHMKEKREDLQISWSFISVPEMAVNIQPKALGEDQVAETSAMSDVLKDILKHLAGSASPSVVLITKPTTVKEAQNLQCAASTAQESCPPKPPRAHELKLLVRNIHVLLLSEPGASGHINAVCVVQLNDPVQRFSSTLTKNTPDLMWEEEFTFELNAKSKELHLQISEAGRSSEGLLATATVPLDLFKKQPSGPQSFTLTSGSACGSSVLGSVTAEFSYMEPGELKSWPIPPPVPAAKIEKDRTVMPCGTVVTTVTAVKTKPRVDVGRASPLSSDSPVKTPIKVKVIEKDISVQAIACRSAPVSKTLSSSDTELLVLNGSDPVAEVAIRQLSESSKLKLKSPRKKSTIIISGISKTSLSQDHDAALMQGYTASVDSTHQEDAPSHPERAAASAPPEEAESAQASLAPKPQEDELDSWDLEKEPQAAAWSSQVLLDPDGDELSESSMSVLEPGTAKKHKGGILRKGAKLFFRRRHQQKDPGMSQSHNDLVFLEQPEGSRRKGITLTRILNKKLLSRHRNKNTMNGAPVEPCT

SEQ ID NO: 5679 - protein, 148 aa, unidentified
MAASPARPAVLALTGLALLLLLCWGPGGISGNKLKLMLQKREAPVPTKTKVAVDENKAKEFLGSLKRQKRQLWDRTRPEVQQWYQQFLYMGFDEAKFEDDITYWLNRDRNGHEYYGDYYQRHYDEDSAIGPRSPYGFRHGASVNYDDY

SEQ ID NO: 5680 - protein, 117 aa, unidentified
MIIDSSRIPSFTQLHSTMTRAPLLLLCVALVLLGHVNGATVRNEDKWKPLNNPRNRDLFFRRLQAYFKGRGLDLGTFPNPFPTNENPRPLSFQSELTASASADYEEQKNSFHNYLKG

SEQ ID NO: 5681 - protein, 385 aa, unidentified
MWGFRLLRSPPLLLLLPQLGIGNASSCSQARTMNPGGSGGARCSLSAEVRRRQCLQLSTVPGADPQRSNELLLLAAAGEGLERQDLPGDPAKEEPQPPPQHHVLYFPGDVQNYHEIMTRHPENYQWENWSLENVATILAHRFPNSYIWVIKCSRMHLHKFSCYDNFVKSNMFGAPEHNTDFGAFKHLYMLLVNAFNLSQNSLSKKSLNVWNKDSIASNCRSSPSHTTNGCQGEKVRTCEKSDESAMSFYPPSLNDASFTLIGFSKGCVVLNQLLFELKEAKKDKNIDAFIKSIRTMYWLDGGHSGGSNTWVTYPEVLKEFAQTGIIVHTHVTPYQVRDPMRSWIGKEHKKFVQILGDLGMQVTSQIHFTKEAPSIENHFRVHEVF

SEQ ID NO: 5682 - protein, 1663 aa, unidentified
MGPTSGPSLLLLLLTHLPLALGSPMYSIITPNILRLESEETMVLEAHDAQGDVPVTVTVHDFPGKKLVLSSEKTVLTPATNHMGNVTFTIPANREFKSEKGRNKFVTVQATFGTQVVEKVVLVSLQSGYLFIQTDKTIYTPGSTVLYRIFTVNHKLLPVGRTVMVNIENPEGIPVKQDSLSSQNQLGVLPLSWDIPELVNMGQWKIRAYYENSPQQVFSTEFEVKEYVLPSFEVIVEPTEKFYYIYNEKGLEVTITARFLYGKKVEGTAFVIFGIQDGEQRISLPESLKRIPIEDGSGEVVLSRKVLLDGVQNPRAEDLVGKSLYVSATVILHSGSDMVQAERSGIPIVTSPYQIHFTKTPKYFKPGMPFDLMVFVTNPDGSPAYRVPVAVQGEDTVQSLTQGDGVAKLSINTHPSQKPLSITVRTKKQELSEAEQATRTMQALPYSTVGNSNNYLHLSVLRTELRPGETLNVNFLLRMDRAHEAKIRYYTYLIMNKGRLLKAGRQVREPGQDLVVLPLSITTDFIPSFRLVAYYTLIGASGQREVVADSVWVDVKDSCVGSLVVKSGQSEDRQPVPGQQMTLKIEGDHGARVVLVAVDKGVFVLNKKNKLTQSKIWDVVEKADIGCTPGSGKDYAGVFSDAGLTFTSSSGQQTAQRAELQCPQPAARRRRSVQLTEKRMDKVGKYPKELRKCCEDGMRENPMRFSCQRRTRFISLGEACKKVFLDCCNYITELRRQHARASHLGLARSNLDEDIIAEENIVSRSEFPESWLWNVEDLKEPPKNGISTKLMNIFLKDSITTWEILAVSMSDKKGICVADPFEVTVMQDFFIDLRLPYSVVRNEQVEIRAVLYNYRQNQELKVRVELLHNPAFCSLATTKRRHQQTVTIPPKSSLSVPYVIVPLKTGLQEVEVKAAVYHHFISDGVRKSLKVVPEGIRMNKTVAVRTLDPERLGREGVQKEDIPPADLSDQVPDTESETRILLQGTPVAQMTEDAVDAERLKHLIVTPSGCGEQNMIGMTPTVIAVHYLDETEQWEKFGLEKRQGALELIKKGYTQQLAFRQPSSAFAAFVKRAPSTWLTAYVVKVFSLAVNLIAIDSQVLCGAVKWLILEKQKPDGVFQEDAPVIHQEMIGGLRNNNEKDMALTAFVLISLQEAKDICEEQVNSLPGSITKAGDFLEANYMNLQRSYTVAIAGYALAQMGRLKGPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVVTMYHAKAKDQLTCNKFDLKVTIKPAPETEKRPQDAKNTMILEICTRYRGDQDATMSILDISMMTGFAPDTDDLKQLANGVDRYISKYELDKAFSDRNTLIIYLDKVSHSEDDCLAFKVHQYFNVELIQPGAVKVYAYYNLEESCTRFYHPEKEDGKLNKLCRDELCRCAEENCFIQKSDDKVTLEERLDKACEPGVDYVYKTRLVKVQLSNDFDEYIMAIEQTIKSGSDEVQVGQQRTFISPIKCREALKLEEKKHYLMWGLSSDFWGEKPNLSYIIGKDTWVEHWPEEDECQDEENQKQCQDLGAFTESMVVFGCPN

SEQ ID NO: 5683 - protein, 294 aa, unidentified
MAGQPAATGSPSADKDGMEPNVVARISQWADDHLRLVRNISTGMAIAGIMLLLRSIRLTSKFTSSSDIPVEFIRRNVKLRGRLRRITENGLEIEHIPITLPIIASLRKEPRGALLVKLAGVELAETGKAWLQKELKPSQLLWFQLLGKENSALFCYLLVSKGGYFSVNLNEEILRRGLGKTVLVKGLKYDSKIYWTVHRNLLKAELTALKKGEGIWKEDSEKESYLEKFKDSWREIWKKDSFLKTTGSDFSLKKESYYEKLKRTYEIWKDNMNNCSLILKFRELISRINFRRKG

SEQ ID NO: 5684 - protein, 430 aa, unidentified
MWRLVPPKLGRLSRSLKLAALGSLLVLMVLHSPSLLASWQRNELTDRRFLQLNKCPACFGTSWCRRFLNGQVVFEAWGRLRLLDFLNVKNVYFAQYGEPREGGRRRVVLKRLGSQRELAQLDQSICKRATGRPRCDLLQAMPRTEFARLNGDVRLLTPEAVEGWSDLVHCPSQRLLDRLVRRYAETKDSGSFLLRNLKDSERMQLLLTLAFNPEPLVLQSFPSDEGWPFAKYLGACGRMVAVNYVGEELWSYFNAPWEKRVDLAWQLMEIAEQLTNNDFEFALYLLDVSFDNFAVGPRDGKVIIVDAENVLVADKRLIRQNKPENWDVWYESKFDDCDKEACLSFSKEILCARATVDHNYYAVCQNLLSRHATWRGTSGGLLHDPPSEIAKDGRLEALLDECANPKKRYGRFQAAKELREYLAQLSNNVR

SEQ ID NO: 5685 - protein, 1744 aa, unidentified
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAAAAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRDSSTWLTAFVLKVLSLAQEQVGGSPEKLQETSNWLLSQQQADGSFQDPCPVLDRSMQGGLVGNDETVALTAFVTIALHHGLAVFQDEGAEPLKQRVEASISKANSFLGEKASAGLLGAHAAAITAYALTLTKAPVDLLGVAHNNLMAMAQETGDNLYWGSVTGSQSNAVSPTPAPRNPSDPMPQAPALWIETTAYALLHLLLHEGKAEMADQASAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 5686 - protein, 1744 aa, unidentified
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRTTNIQGINLLFSSRRGHLFLQTDQPIYNPGQRVRYRVFALDQKMRPSTDTITVMVENSHGLRVRKKEVYMPSSIFQDDFVIPDISEPGTWKISARFSDGLESNSSTQFEVKKYVLPNFEVKITPGKPYILTVPGHLDEMQLDIQARYIYGKPVQGVAYVRFGLLDEDGKKTFFRGLESQTKLVNGQSHISLSKAEFQDALEKLNMGITDLQGLRLYVAAAIIESPGGEMEEAELTSWYFVSSPFSLDLSKTKRHLVPGAPFLLQALVREMSGSPASGIPVKVSATVSSPGSVPEVQDIQQNTDGSGQVSIPIIIPQTISELQLSVSAGSPHPAIARLTVAAPPSGGPGFLSIERPDSRPPRVGDTLNLNLRAVGSGATFSHYYYMILSRGQIVFMNREPKRTLTSVSVFVDHHLAPSFYFVAFYYHGDHPVANSLRVDVQAGACEGKLELSVDGAKQYRNGESVKLHLETDSLALVALGALDTALYAAGSKSHKPLNMGKVFEAMNSYDLGCGPGGGDSALQVFQAAGLAFSDGDQWTLSRKRLSCPKEKTTRKKRNVNFQKAINEKLGQYASPTAKRCCQDGVTRLPMMRSCEQRAARVQQPDCREPFLSCCQFAESLRKKSRDKGQAGLQRALEILQEEDLIDEDDIPVRSFFPENWLWRVETVDRFQILTLWLPDSLTTWEIHGLSLSKTKGLCVATPVQLRVFREFHLHLRLPMSVRRFEQLELRPVLYNYLDKNLTVSVHVSPVEGLCLAGGGGLAQQVLVPAGSARPVAFSVVPTAATAVSLKVVARGSFEFPVGDAVSKVLQIEKEGAIHREELVYELNPLDHRGRTLEIPGNSDPNMIPDGDFNSYVRVTASDPLDTLGSEGALSPGGVASLLRLPRGCGEQTMIYLAPTLAASRYLDKTEQWSTLPPETKDHAVDLIQKGYMRIQQFRKADGSYAAWLSRGSSTWLTAFVLKVLSLAQEQVGGSPEKLQETSNWLLSQQQADGSFQDLSPVIHRSMQGGLVGNDETVALTAFVTIALHHGLAVFQDEGAEPLKQRVEASISKASSFLGEKASAGLLGAHAAAITAYALTLTKAPADLRGVAHNNLMAMAQETGDNLYWGSVTGSQSNAVSPTPAPRNPSDPMPQAPALWIETTAYALLHLLLHEGKAEMADQAAAWLTRQGSFQGGFRSTQDTVIALDALSAYWIASHTTEERGLNVTLSSTGRNGFKSHALQLNNRQIRGLEEELQFSLGSKINVKVGGNSKGTLKVLRTYNVLDMKNTTCQDLQIEVTVKGHVEYTMEANEDYEDYEYDELPAKDDPDAPLQPVTPLQLFEGRRNRRRREAPKVVEEQESRVHYTVCIWRNGKVGLSGMAIADVTLLSGFHALRADLEKLTSLSDRYVSHFETEGPHVLLYFDSVPTSRECVGFEAVQEVPVGLVQPASATLYDYYNPERRCSVFYGAPSKSRLLATLCSAEVCQCAEGKCPRQRRALERGLQDEDGYRMKFACYYPRVEYGFQVKVLREDSRAAFRLFETKITQVLHFTKDVKAAANQMRNFLVRASCRLRLEPGKEYLIMGLDGATYDLEGHPQYLLDSNSWIEEMPSERLCRSTRQRAACAQLNDFLQEYGTQGCQV

SEQ ID NO: 5687 - protein, 597 aa, unidentified
MHPPKTPSGALHRKRKMAAWPFSRLWKVSDPILFQMTLIAALLPAVLGNCGPPPTLSFAAPMDITLTETRFKTGTTLKYTCLPGYVRSHSTQTLTCNSDGEWVYNTFCIYKRCRHPGELRNGQVEIKTDLSFGSQIEFSCSEGFFLIGSTTSRCEVQDRGVGWSHPLPQCEIVKCKPPPDIRNGRHSGEENFYAYGFSVTYSCDPRFSLLGHASISCTVENETIGVWRPSPPTCEKITCRKPDVSHGEMVSGFGPIYNYKDTIVFKCQKGFVLRGSSVIHCDADSKWNPSPPACEPNSCINLPDIPHASWETYPRPTKEDVYVVGTVLRYRCHPGYKPTTDEPTTVICQKNLRWTPYQGCEALCCPEPKLNNGEITQHRKSRPANHCVYFYGDEISFSCHETSRFSAICQGDGTWSPRTPSCGDICNFPPKIAHGHYKQSSSYSFFKEEIIYECDKGYILVGQAKLSCSYSHWSAPAPQCKALCRKPELVNGRLSVDKDQYVEPENVTIQCDSGYGVVGPQSITCSGNRTWYPEVPKCEWETPEGCEQVLTGKRLMQCLPNPEDVKMALEVYKLSLEIEQLELQRDSARQSTLDKEL

SEQ ID NO: 5688 - protein, 252 aa, unidentified
MFFWCACCLMVAWRVSASDAEHCPELPPVDNSIFVAKEVEGQILGTYVCIKGYHLVGKKTLFCNASKEWDNTTTECRLGHCPDPVLVNGEFSSSGPVNVSDKITFMCNDHYILKGSNRSQCLEDHTWAPPFPICKSRDCDPPGNPVHGYFEGNNFTLGSTISYYCEDRYYLVGVQEQQCVDGEWSSALPVCKLIQEAPKPECEKALLAFQESKNLCEAMENFMQQLKESGMTMEELKYSLELKKAELKAKLL

SEQ ID NO: 5689 - protein, 130 aa, unidentified
MARRHCFSYWLLVCWLVVTVAEGQEEVFTPPGDSQNNADATDCQIFTLTPPPAPRSPVTRAQPITKTPRCPFHFFPRRPRIHFRFPNRPFVPSRCNHRFPFQPFYWPHRYLTYRYFPRRRLQRGSSSEES

SEQ ID NO: 5690 - protein, 1676 aa, unidentified
MGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLINGIAQVTFDSETAVKELSYYSLEDLNNKYLYIAVTVIESTGGFSEEAEIPGIKYVLSPYKLNLVATPLFLKPGIPYPIKVQVKDSLDQLVGGVPVTLNAQTIDVNQETSDLDPSKSVTRVDDGVASFVLNLPSGVTVLEFNVKTDAPDLPEENQAREGYRAIAYSSLSQSYLYIDWTDNHKALLVGEHLNIIVTPKSPYIDKITHYNYLILSKGKIIHFGTREKFSDASYQSINIPVTQNMVPSSRLLVYYIVTGEQTAELVSDSVWLNIEEKCGNQLQVHLSPDADAYSPGQTVSLNMATGMDSWVALAAVDSAVYGVQRGAKKPLERVFQFLEKSDLGCGAGGGLNNANVFHLAGLTFLTNANADDSQENDEPCKEILRPRRTLQKKIEEIAAKYKHSVVKKCCYDGACVNNDETCEQRAARISLGPRCIKAFTECCVVASQLRANISHKDMQLGRLHMKTLLPVSKPEIRSYFPESWLWEVHLVPRRKQLQFALPDSLTTWEIQGVGISNTGICVADTVKAKVFKDVFLEMNIPYSVVRGEQIQLKGTVYNYRTSGMQFCVKMSAVEGICTSESPVIDHQGTKSSKCVRQKVEGSSSHLVTFTVLPLEIGLHNINFSLETWFGKEILVKTLRVVPEGVKRESYSGVTLDPRGIYGTISRRKEFPYRIPLDLVPKTEIKRILSVKGLLVGEILSAVLSQEGINILTHLPKGSAEAELMSVVPVFYVFHYLETGNHWNIFHSDPLIEKQKLKKKLKEGMLSIMSYRNADYSYSVWKGGSASTWLTAFALRVLGQVNKYVEQNQNSICNSLLWLVENYQLDNGSFKENSQYQPIKLQGTLPVEARENSLYLTAFTVIGIRKAFDICPLVKIDTALIKADNFLLENTLPAQSTFTLAISAYALSLGDKTHPQFRSIVSALKREALVKGNPPIYRFWKDNLQHKDSSVPNTGTARMVETTAYALLTSLNLKDINYVNPVIKWLSEEQRYGGGFYSTQDTINAIEGLTEYSLLVKQLRLSMDIDVSYKHKGALHNYKMTDKNFLGRPVEVLLNDDLIVSTGFGSGLATVHVTTVVHKTSTSEEVCSFYLKIDTQDIEASHYRGYGNSDYKRIVACASYKPSREESSSGSSHAVMDISLPTGISANEEDLKALVEGVDQLFTDYQIKDGHVILQLNSIPSSDFLCVRFRIFELFEVGFLSPATFTVYEYHRPDKQCTMFYSTSNIKIQKVCEGAACKCVEADCGQMQEELDLTISAETRKQTACKPEIAYAYKVSITSITVENVFVKYKATLLDIYKTGEAVAEKDSEITFIKKVTCTNAELVKGRQYLIMGKEALQIKYNFSFRYIYPLDSLTWIEYWPRDTTCSSCQAFLANLDEFAEDIFLNGC

SEQ ID NO: 5691 - protein, 87 aa, unidentified
MAVSVLRLTVVLGLLVLFLTCYADDKPDKPDDKPDDSGKDPKPDFPKFLSLLGTEIIENAVEFILRSMSRSTGFMEFDDNEGKHSSK

SEQ ID NO: 5692 - protein, 934 aa, unidentified
MARRSVLYFILLNALINKGQACFCDHYAWTQWTSCSKTCNSGTQSRHRQIVVDKYYQENFCEQICSKQETRECNWQRCPINCLLGDFGPWSDCDPCIEKQSKVRSVLRPSQFGGQPCTAPLVAFQPCIPSKLCKIEEADCKNKFRCDSGRCIARKLECNGENDCGDNSDERDCGRTKAVCTRKYNPIPSVQLMGNGFHFLAGEPRGEVLDNSFTGGICKTVKSSRTSNPYRVPANLENVGFEVQTAEDDLKTDFYKDLTSLGHNENQQGSFSSQGGSSFSVPIFYSSKRSENINHNSAFKQAIQASHKKDSSFIRIHKVMKVLNFTTKAKDLHLSDVFLKALNHLPLEYNSALYSRIFDDFGTHYFTSGSLGGVYDLLYQFSSEELKNSGLTEEEAKHCVRIETKKRVLFAKKTKVEHRCTTNKLSEKHEGSFIQGAEKSISLIRGGRSEYGAALAWEKGSSGLEEKTFSEWLESVKENPAVIDFELAPIVDLVRNIPCAVTKRNNLRKALQEYAAKFDPCQCAPCPNNGRPTLSGTECLCVCQSGTYGENCEKQSPDYKSNAVDGQWGCWSSWSTCDATYKRSRTRECNNPAPQRGGKRCEGEKRQEEDCTFSIMENNGQPCINDDEEMKEVDLPEIEADSGCPQPVPPENGFIRNEKQLYLVGEDVEISCLTGFETVGYQYFRCLPDGTWRQGDVECQRTECIKPVVQEVLTITPFQRLYRIGESIELTCPKGFVVAGPSRYTCQGNSWTPPISNSLTCEKDTLTKLKGHCQLGQKQSGSECICMSPEEDCSHHSEDLCVFDTDSNDYFTSPACKFLAEKCLNNQQLHFLHIGSCQDGRQLEWGLERTRLSSNSTKKESCGYDTCYDWEKCSASTSKCVCLLPPQCFKGGNQLYCVKMGSSTSEKTLNICEVGTIRCANRKMEILHPGKCLA

SEQ ID NO: 5693 - protein, 191 aa, unidentified
MAAPRGRAAPWTTALLLLLASQVLSPGSCADEEEVPEEWVLLHVVQGQIGAGNYSYLRLNHEGKIVLRMRSLKGDADLYVSASSLHPSFDDYELQSATCGPDAVSIPAHFRRPVGIGVYGHPSHLESEFEMKVYYDGTVEQHPFGEAAYPADGADAGQKHAGAPEDASQEEESVLWTILISILKLVLEILF

SEQ ID NO: 5694 - protein, 325 aa, unidentified
MQGRVAGSCAPLGLLLVCLHLPGLFARSIGVVEEKVSQNLGTNLPQLGQPSSTGPSNSEHPQPALDPRSNDLARVPLKLSVPASDGFPPAGGSAVQRWPPSWGLPAMDSWPPEDPWQMMAAAAEDRLGEALPEELSYLSSAAALAPGSGPLPGESSPDATGLSPKASLLHQDSESRRLPRSNSLGAGGKILSQRPPWSLIHRVLPDHPWGTLNPSVSWGGGGPGTGWGTRPMPHPEGIWGINNQPPGTSWGNINRYPGGSWGNINRYPGGSWGNINRYPGGSWGNIHLYPGINNPFPPGVLRPPGSSWNIPAGFPNPPSPRLQWG

SEQ ID NO: 5695 - protein, 330 aa, unidentified
MAFLPSWVCVLVGSFSASLAGTSNLSETEPPLWKESPGQLSDYRVENSMYIINPWVYLERMGMYKIILNQTARYFAKFAPDNEQNILWGLPLQYGWQYRTGRLADPTRRTNCGYESGDHMCISVDSWWADLNYFLSSLPFLAAVDSGVMGISSDQVRLLPPPKNERKFCYDVSSCRSSFPETMNKWNTFYQYLQSPFSKFDDLLKYLWAAHTSTLADNIKSFEDRYDYYSKAEAHFERSWVLAVDHLAAVLFPTTLIRSYKFQKGMPPRILLNTDVAPFISDFTAFQNVVLVLLNMLDNVDKSIGYLCTEKSNVYRDHSESSSRSYGNNS

SEQ ID NO: 5696 - protein, 843 aa, unidentified
MKVISLFILVGFIGEFQSFSSASSPVNCQWDFYAPWSECNGCTKTQTRRRSVAVYGQYGGQPCVGNAFETQSCEPTRGCPTEEGCGERFRCFSGQCISKSLVCNGDSDCDEDSADEDRCEDSERRPSCDIDKPPPNIELTGNGYNELTGQFRNRVINTKSFGGQCRKVFSGDGKDFYRLSGNVLSYTFQVKINNDFNYEFYNSTWSYVKHTSTEHTSSSRKRSFFRSSSSSSRSYTSHTNEIHKGKSYQLLVVENTVEVAQFINNNPEFLQLAEPFWKELSHLPSLYDYSAYRRLIDQYGTHYLQSGSLGGEYRVLFYVDSEKLKQNDFNSVEEKKCKSSGWHFVVKFSSHGCKELENALKAASGTQNNVLRGEPFIRGGGAGFISGLSYLELDNPAGNKRRYSAWAESVTNLPQVIKQKLTPLYELVKEVPCASVKKLYLKWALEEYLDEFDPCHCRPCQNGGLATVEGTHCLCHCKPYTFGAACEQGVLVGNQAGGVDGGWSCWSSWSPCVQGKKTRSRECNNPPPSGGGRSCVGETTESTQCEDEELEHLRLLEPHCFPLSLVPTEFCPSPPALKDGFVQDEGTMFPVGKNVVYTCNEGYSLIGNPVARCGEDLRWLVGEMHCQKIACVLPVLMDGIQSHPQKPFYTVGEKVTVSCSGGMSLEGPSAFLCGSSLKWSPEMKNARCVQKENPLTQAVPKCQRWEKLQNSRCVCKMPYECGPSLDVCAQDERSKRILPLTVCKMHVLHCQGRNYTLTGRDSCTLPASAEKACGACPLWGKCDAESSKCVCREASECEEEGFSICVEVNGKEQTMSECEAGALRCRGQSISVTSIRPCAAETQ

SEQ ID NO: 5697 - protein, 295 aa, unidentified
MRNTSKELQGATHRYAPCDWYYHVPVKRSEKAVDAPPASQIPGLSNLGDSHSENLPGTRRYWIKETDSEYVKLAKQGGRPDLLKHFAPGTRKGSPVAYSLPDWYIHHSKPPTASQQEVRAVSMPDYMVHEEFNPDQANGSYASRRGPFDFDMKTVWQREAEELEKEKKKLRLPAIDSKYLSKAGTPLGPKNPAGSRLSFPPVPGQKNSSPTNFSKLISNGYKDEWLQQQQRADSDKRTPKTSRASVLSQSPRDLEGPQDAARLQDAEASEGPEDTPESSQSPEESVSASTPAELK

SEQ ID NO: 5698 - protein, 47 aa, unidentified
MLQFLLGFTLGNVVGMYLAQNYDIPNLAKKLEEIKKDLDAKKKPPSA

SEQ ID NO: 5699 - protein, 584 aa, unidentified
MFAVVFFILSLMTCQPGVTAQEKVNQRVRRAATPAAVTCQLSNWSEWTDCFPCQDKKYRHRSLLQPNKFGGTICSGDIWDQASCSSSTTCVRQAQCGQDFQCKETGRCLKRHLVCNGDQDCLDGSDEDDCEDVRAIDEDCSQYEPIPGSQKAALGYNILTQEDAQSVYDASYYGGQCETVYNGEWRELRYDSTCERLYYGDDEKYFRKPYNFLKYHFEALADTGISSEFYDNANDLLSKVKKDKSDSFGVTIGIGPAGSPLLVGVGVSHSQDTSFLNELNKYNEKKFIFTRIFTKVQTAHFKMRKDDIMLDEGMLQSLMELPDQYNYGMYAKFINDYGTHYITSGSMGGIYEYILVIDKAKMESLGITSRDITTCFGGSLGIQYEDKINVGGGLSGDHCKKFGGGKTERARKAMAVEDIISRVRGGSSGWSGGLAQNRSTITYRSWGRSLKYNPVVIDFEMQPIHEVLRHTSLGPLEAKRQNLRRALDQYLMEFNACRCGPCFNNGVPILEGTSCRCQCRLGSLGAACEQTQTEGAKADGSWSCWSSWSVCRAGIQERRRECDNPAPQNGGASCPGRKVQTQAC

SEQ ID NO: 5700 - protein, 591 aa, unidentified
MKNSRTWAWRAPVELFLLCAALGCLSLPGSRGERPHSFGSNAVNKSFAKSRQMRSVDVTLMPIDCELSSWSSWTTCDPCQKKRYRYAYLLQPSQFHGEPCNFSDKEVEDCVTNRPCRSQVRCEGFVCAQTGRCVNRRLLCNGDNDCGDQSDEANCRRIYKKCQHEMDQYWGIGSLASGINLFTNSFEGPVLDHRYYAGGCSPHYILNTRFRKPYNVESYTPQTQGKYEFILKEYESYSDFERNVTEKMASKSGFSFGFKIPGIFELGISSQSDRGKHYIRRTKRFSHTKSVFLHARSDLEVAHYKLKPRSLMLHYEFLQRVKRLPLEYSYGEYRDLFRDFGTHYITEAVLGGIYEYTLVMNKEAMERGDYTLNNVHACAKNDFKIGGAIEEVYVSLGVSVGKCRGILNEIKDRNKRDTMVEDLVVLVRGGASEHITTLAYQELPTADLMQEWGDAVQYNPAIIKVKVEPLYELVTATDFAYSSTVRQNMKQALEEFQKEVSSCHCAPCQGNGVPVLKGSRCDCICPVGSQGLACEVSYRKNTPIDGKWNCWSNWSSCSGRRKTRQRQCNNPPPQNGGSPCSGPASETLDCS

SEQ ID NO: 5701 - protein, 202 aa, unidentified
MLPPGTATLLTLLLAAGSLGQKPQRPRRPASPISTIQPKANFDAQQFAGTWLLVAVGSACRFLQEQGHRAEATTLHVAPQGTAMAVSTFRKLDGICWQVRQLYGDTGVLGRFLLQARDARGAVHVVVAETDYQSFAVLYLERAGQLSVKLYARSLPVSDSVLSGFEQRVQEAHLTEDQIFYFPKYGFCEAADQFHVLDEVRR

SEQ ID NO: 5702 - protein, 559 aa, unidentified
MSACRSFAVAICILEISILTAQYTTSYDPELTESSGSASHIDCRMSPWSEWSQCDPCLRQMFRSRSIEVFGQFNGKRCTDAVGDRRQCVPTEPCEDAEDDCGNDFQCSTGRCIKMRLRCNGDNDCGDFSDEDDCESEPRPPCRDRVVEESELARTAGYGINILGMDPLSTPFDNEFYNGLCNRDRDGNTLTYYRRPWNVASLIYETKGEKNFRTEHYEEQIEAFKSIIQEKTSNFNAAISLKFTPTETNKAEQCCEETASSISLHGKGSFRFSYSKNETYQLFLSYSSKKEKMFLHVKGEIHLGRFVMRNRDVVLTTTFVDDIKALPTTYEKGEYFAFLETYGTHYSSSGSLGGLYELIYVLDKASMKRKGVELKDIKRCLGYHLDVSLAFSEISVGAEFNKDDCVKRGEGRAVNITSENLIDDVVSLIRGGTRKYAFELKEKLLRGTVIDVTDFVNWASSINDAPVLISQKLSPIYNLVPVKMKNAHLKKQNLERAIEDYINEFSVRKCHTCQNGGTVILMDGKCLCACPFKFEGIACEISKQKISEGLPALEFPNEK

SEQ ID NO: 5703 - protein, 202 aa, unidentified
MVRIWTTIMIVLILLLRIGPNKPSLSGRQAPAQAQTSDLVPSLFPLGLWAPGFCTWSSPDEDKVWRPAWEQGPKGEPDPRGLRPRKPVPGTGNRDSGTRRRLQDATEQDPRPGNDVASAETAGPPSPSGIRAQDRAPRHRRAPPARMPVAPAPSADGEPLQEQGGGLFHRTRSVYNGLELNTWMKVERLFVEKFHQSFSLDN

SEQ ID NO: 5704 - protein, 328 aa, unidentified
MEIVWEVLFLLQANFIVCISAQQNSPKIHEGWWAYKEVVQGSFVPVPSFWGLVNSAWNLCSVGKRQSPVNIETSHMIFDPFLTPLRINTGGRKVSGTMYNTGRHVSLRLDKEHLVNISGGPMTYSHRLEEIRLHFGSEDSQGSEHLLNGQAFSGEVQLIHYNHELYTNVTEAAKSPNGLVVVSIFIKVSDSSNPFLNRMLNRDTITRITYKNDAYLLQGLNIEELYPETSSFITYDGSMTIPPCYETASWIIMNKPVYITRMQMHSLRLLSQNQPSQIFLSMSDNFRPVQPLNNRCIRTNINFSLQGKDCPNNRAQKLQYRVNEWLLK

SEQ ID NO: 5705 - protein, 328 aa, unidentified
MGAAARLSAPRALVLWAALGAAAHIGPAPDPEDWWSYKDNLQGNFVPGPPFWGLVNAAWSLCAVGKRQSPVDVELKRVLYDPFLPPLRLSTGGEKLRGTLYNTGRHVSFLPAPRPVVNVSGGPLLYSHRLSELRLLFGARDGAGSEHQINHQGFSAEVQLIHFNQELYGNFSAASRGPNGLAILSLFVNVASTSNPFLSRLLNRDTITRISYKNDAYFLQDLSLELLFPESFGFITYQGSLSTPPCSETVTWILIDRALNITSLQMHSLRLLSQNPPSQIFQSLSGNSRPLQPLAHRALRGNRDPRHPERRCRGPNYRLHVDGVPHGR

SEQ ID NO: 5706 - protein, 308 aa, unidentified
MRALVLLLSLFLLGGQAQHVSDWTYSEGALDEAHWPQHYPACGGQRQSPINLQRTKVRYNPSLKGLNMTGYETQAGEFPMVNNGHTVQISLPSTMRMTVADGTVYIAQQMHFHWGGASSEISGSEHTVDGIRHVIEIHIVHYNSKYKSYDIAQDAPDGLAVLAAFVEVKNYPENTYYSNFISHLANIKYPGQRTTLTGLDVQDMLPRNLQHYYTYHGSLTTPPCTENVHWFVLADFVKLSRTQVWKLENSLLDHRNKTIHNDYRRTQPLNHRVVESNFPNQEYTLGSEFQFYLHKIEEILDYLRRALN

SEQ ID NO: 5707 - protein, 459 aa, unidentified; identical to SEQ ID NO: 682

SEQ ID NO: 5708 - protein, 633 aa, unidentified
MAAAAAAATTAACSSGSAGTDAAGASGLQQPPPQPQPQPAAAAPAQPPPEPPRKPRMDPRRRQAALSFLTNISLDGRLPPQDAEWGGGEEGGAAKPGAGGACGARTRFSLLAAAERGGCIALAAPGTPAAGLAAGSGPCLPQPSSLPPLIPGGHATVSGPGVARGFASPLGAGRASGEQWQPPRPAPLAACAQLQLLDGSGAAGQEELEEDDAFISVQVPAAAFLGSGTPGSGSGSRGRLNSFTQGILPIAFSRPTSQNYCSLEQPGQGGSTSAFEQLQRSRRRLISQRSSLETLEDIEENAPLRRCRTLSGSPRPKNFKKIHFIKNMRQHDTRNGRIVLISGRRSFCSIFSVLPYRDSTQVGDLKLDGGRQSTGAVSLKEIIGLEGVELGADGKTVSYTQFLLPTNAFGARRNTIDSTSSFSQFRNLSHRSLSIGRASGTQGSLDTGSDLGDFMDYDPNLLDDPQWPCGKHKRVLIFPSYMTTVIDYVKPSDLKKDMNETFKEKFPHIKLTLSKIRSLKREMRKLAQEDCGLEEPTVAMAFVYFEKLALKGKLNKQNRKLCAGACVLLAAKIGSDLKKHEVKHLIDKLEEKFRLNRRELIAFEFPVLVALEFALHLPEHEVMPHYRRLVQSS

SEQ ID NO: 5709 - protein, 370 aa, unidentified
MGGGDGAAFKRPGDGARLQRVLGLGSRREPRSLPAGGPAPRRTAPPPPGHASAGPAAMSSHIAKSESKTSLLKAAAAAASGGSRAPRHGPARDPGLPSRRLPGSCPATPQSSGDPSSRRPLCRPAPREEGARGSQRVLPQAHCRPREALPAAASRPSPSSPLPPARGRDGEERGLSPALGLRGSLRARGRGDSVPAAASEADPFLHRLRPMLSSAFGQDRSLRPEEIEELREAFREFDKDKDGYINCRDLGNCMRTMGYMPTEMELIELSQQINMNLGGHVDFDDFVELMGPKLLAETADMIGVKELRDAFREFDTNGDGEISTSELREAMRKLLGHQVGHRDIEEIIRDVDLNGDGRVDFEEFVRMMSR

SEQ ID NO: 5710 - protein, 1103 aa, unidentified; identical to SEQ ID NO: 697

SEQ ID NO: 5711 - protein, 1137 aa, unidentified; identical to SEQ ID NO: 699

SEQ ID NO: 5712 - protein, 398 aa, unidentified; identical to SEQ ID NO: 711

SEQ ID NO: 5713 - protein, 128 aa, unidentified
MGFQKFSPFLALSILVLLQAGSLHAAPFRSALESSPADPATLSEDEARLLLAALVQDYVQMKASELEQEQEREGSRIIAQKRACDTATCVTHRLAGLLSRSGGVVKNNFVPTNVGSKAFGRRRRDLQA

SEQ ID NO: 5714 - protein, 127 aa, unidentified
MGFRKFSPFLALSILVLYQAGSLQAAPFRSALESSPDPATLSKEDARLLLAALVQDYVQMKASELKQEQETQGSSSAAQKRACNTATCVTHRLAGLLSRSGGMVKSNFVPTNVGSKAFGRRRRDLQA

SEQ ID NO: 5715 - protein, 461 aa, unidentified; identical to SEQ ID NO: 713

SEQ ID NO: 5716 - protein, 417 aa, unidentified
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEEEAEDKEDDEDKDEDEEDEEDKEEDEEEDVPGQAKDEL

SEQ ID NO: 5717 - protein, 384 aa, unidentified
MARALVQLWAICMLRVALATVYFQEEFLDGEHWRNRWLQSTNDSRFGHFRLSSGKFYGHKEKDKGLQTTQNGRFYAISARFKPFSNKGKTLVIQYTVKHEQKMDCGGGYIKVFPADIDQKNLNGKSQYYIMFGPDICGFDIKKVHVILHFKNKYHENKKLIRCKVDGFTHLYTLILRPDLSYDVKIDGQSIESGSIEYDWNLTSLKKETSPAESKDWEQTKDNKAQDWEKHFLDASTSKQSDWNGDLDGDWPAPMLQKPPYQDGLKPEGIHKDVWLHRKMKNTDYLTQYDLSEFENIGAIGLELWQVRSGTIFDNFLITDDEEYADNFGKATWGETKGPEREMDAIQAKEEMKKAREEEEEELLSGKINRHEHYFNQFHRRNEL

SEQ ID NO: 5718 - protein, 315 aa, unidentified
MDLRQFLMCLSLCTAFALSKPTEKKDRVHHEPQLSDKVHNDAQSFDYDHDAFLGAEEAKTFDQLTPEESKERLGKIVSKIDGDKDGFVTVDELKDWIKFAQKRWIYEDVERQWKGHDLNEDGLVSWEEYKNATYGYVLDDPDPDDGFNYKQMMVRDERRFKMADKDGDLIATKEEFTAFLHPEEYDYMKDIVVQETMEDIDKNADGFIDLEEYIGDMYSHDGNTDEPEWVKTEREQFVEFRDKNRDGKMDKEETKDWILPSDYDHAEAEARHLVYESDQNKDGKLTKEEIVDKYDLFVGSQATDFGEALVRHDEF

SEQ ID NO: 5719 - protein, 499 aa, unidentified; identical to SEQ ID NO: 724

SEQ ID NO: 5720 - protein, 170 aa, unidentified
MKTQRDGHSLGRWSLVLLLLGLVMPLAIIAQVLSYKEAVLRAIDGINQRSSDANLYRLLDLDPRPTMDGDPDTPKPVSFTVKETVCPRTTQQSPEDCDFKKDGLVKRCMGTVTLNQARGSFDISCDKDNKRFALLGDFFRKSKEKIGKEFKRIVQRIKDFLRNLVPRTES

SEQ ID NO: 5721 - protein, 592 aa, unidentified; identical to SEQ ID NO: 730

SEQ ID NO: 5722 - protein, 608 aa, unidentified
MAAAAAAVGPGAGGAGSAVPGGAGPCATVSVFPGARLLTIGDANGEIQRHAEQQALRLEVRAGPDSAGIALYSHEDVCVFKCSVSRETECSRVGKQSFIITLGCNSVLIQFATPNDFCSFYNILKTCRGHTLERSVFSERTEESSAVQYFQFYGYLSQQQNMMQDYVRTGTYQRAILQNHTDFKDKIVLDVGCGSGILSFFAAQAGARKIYAVEASTMAQHAEVLVKSNNLTDRIVVIPGKVEEVSLPEQVDIIISEPMGYMLFNERMLESYLHAKKYLKPSGNMFPTIGDVHLAPFTDEQLYMEQFTKANFWYQPSFHGVDLSALRGAAVDEYFRQPVVDTFDIRILMAKSVKYTVNFLEAKEGDLHRIEIPFKFHMLHSGLVHGLAFWFDVAFIGSIMTVWLSTAPTEPLTHWYQVRCLFQSPLFAKAGDTLSGTCLLIANKRQSYDISIVAQVDQTGSKSSNLLDLKNPFFRYTGTTPSPPPGSHYTSPSENMWNTGSTYNLSSGMAVAGMPTAYDLSSVIASGSSVGHNNLIPLANTGIVNHTHSRMGSIMSTGIVQGSSGAQGSGGGSTSAHYAVNSQFTMGGPAISMASPMSIPTNTMHYGS

SEQ ID NO: 5723 - protein, 827 aa, unidentified
MLLCLSPAWLMKVPAPGQPGEAALLVSKAVSFHPGGLTFLDDFVPPRRATYFLAGLGLGPGRGREAAELARDLTCPTGASAELARLLEDRLLTRQLLAQQGGVAVPATLAFTYKPPGLLRGGDASLGLRLVELSGKEGQETLVKEEVEAFLRSEALGDILQVAVKLSGWRWRGRQAWRLHPRAELGAVVDTVLALLEKLEEEESVLVEAVYPPAQLPCSDGPSPGPGLAVRICAVVCRTQGDRPLLSKVVCGVGRGDRPLRHHNSLPRTLEVALAQCGLGEEAQVAAVRQRVKAAAEAALAAVLALEAGLSAEQRGGRRAHTDFLGVDFALTAAGGVLTPVALELNGGLCLEACGALEGLWAAPRLGPAADEAVAAPLVETMLRRSARCLMEGKQLLVVGAGGVSKKFVWEAARDYGLQLHLVESDPNHFASQLVQTFIHFDMTEHRRDEENARLLAELVRARGLKLDGCFSYWDDCLVLTALLCQELGLPCSSPAAMRLAKQKSLTQLHLLHHHGPPWPAPSLHAVPCCPLESEADVERAVHQVPLPGVMKLEFGAGAVGVRLVEDAPQCHEHFSRITRDLQGEADHPGIGLGWGNAMLLMEFVEGTEHDVDLVLFGGRLLAAFVSDNGPTRLPGFTETAACMPTGLAPEQEAQMVQAAFRCCLGCGLLDGVFNVELKLTGAGPRLIEINPRMGGFYLRDWILELYGVDLLLAAVMVACGLRPALPTRPRARGHLVGVMCLVSQHLQALSSTASRETLQALHDRGLLRLNLLEEALVPGEYEEPYCSVACAGPSPTEARLRLLGLCQGLGIDGPSYPVAHFLSHFK

SEQ ID NO: 5724 - protein, 116 aa, unidentified
MESSRVRLLPLLGAALLLMLPLLGTRAQEDAELQPRALDIYSAVDDASHEKELIEALQEVLKKLKSKRVPIYEKKYGQVPMCDAGEQCAVRKGARIGKLCDCPRGTSCNSFLLKCL

SEQ ID NO: 5725 - protein, 396 aa, unidentified
MSATDRMGPRAVPGLRLALLLLLVLGTPKSGVQGQEGLDFPEYDGVDRVINVNAKNYKNVFKKYEVLALLYHEPPEDDKASQRQFEMEELILELAAQVLEDKGVGFGLVDSEKDAAVAKKLGLTEVDSMYVFKGDEVIEYDGEFSADTIVEFLLDVLEDPVELIEGERELQAFENIEDEIKLIGYFKSKDSEHYKAFEDAAEEFHPYIPFFATFDSKVAKKLTLKLNEIDFYEAFMEEPVTIPDKPNSEEEIVNFVEEHRRSTLRKLKPESMYETWEDDMDGIHIVAFAEEADPDGFEFLETLKAVAQDNTENPDLSIIWIDPDDFPLLVPYWEKTFDIDLSAPQIGVVNVTDADSVWMEMDDEEDLPSAEELEDWLEDVLEGEINTEDDDDDDDD

SEQ ID NO: 5726 - protein, 399 aa, unidentified
MKRTHLFIVGIYFLSSCRAEEGLNFPTYDGKDRVVSLSEKNFKQVLKKYDLLCLYYHEPVSSDKVTQKQFQLKEIVLELVAQVLEHKAIGFVMVDAKKEAKLAKKLGFDEEGSLYILKGDRTIEFDGEFAADVLVEFLLDLIEDPVEIISSKLEVQAFERIEDYIKLIGFFKSEDSEYYKAFEEAAEHFQPYIKFFATFDKGVAKKLSLKMNEVDFYEPFMDEPIAIPNKPYTEEELVEFVKEHQRPTLRRLRPEEMFETWEDDLNGIHIVAFAEKSDPDGYEFLEILKQVARDNTDNPDLSILWIDPDDFPLLVAYWEKTFKIDLFRPQIGVVNVTDADSVWMEIPDDDDLPTAEELEDWIEDVLSGKINTEDDDEDDDDDDNSDEEDNDDSDDDDDE

SEQ ID NO: 5727 - protein, 1159 aa, unidentified; identical to SEQ ID NO: 741

SEQ ID NO: 5728 - protein, 193 aa, unidentified
MLGVLELLLLGAAWLAGPARGQNETEPIVLEGKCLVVCDSNPTSDPTGTALGISVRSGSAKVAFSAIRSTNHEPSEMSNRTMIIYFDQVLVNIGNNFDSERSTFIAPRKGIYSFNFHVVKVYNRQTIQVSLMLNGWPVISAFAGDQDVTREAASNGVLIQMEKGDRAYLKLERGNLMGGWKYSTFSGFLVFPL

SEQ ID NO: 5729 - protein, 224 aa, unidentified
MQAPGRGPLGLRLMMPGRRGALREPGGCGSCLGVALALLLLLLPACCPVRAQNDTEPIVLEGKCLVVCDSSPSADGAVTSSLGISVRSGSAKVAFSATRSTNHEPSEMSNRTMTIYFDQVLVNIGNHFDLASSIFVAPRKGIYSFSFHVVKVYNRQTIQVSLMQNGYPVISAFAGDQDVTREAASNGVLLLMEREDKVHLKLERGNLMGGWKYSTFSGFLVFPL

SEQ ID NO: 5730 - protein, 205 aa, unidentified
MLGAKPHWLPGPLHSPGLPLVLVLLALGAGWAQEGSEPVLLEGECLVVCEPGRAAAGGPGGAALGEAPPGRVAFAAVRSHHHEPAGETGNGTSGAIYFDQVLVNEGGGFDRASGSFVAPVRGVYSFRFHVVKVYNRQTVQVSLMLNTWPVISAFANDPDVTREAATSSVLLPLDPGDRVSLRLRRGNLLGGWKYSSFSGFLIFPL

SEQ ID NO: 5731 - protein, 201 aa, unidentified
MGSGRRALSAVPAVLLVLTLPGLPVWAQNDTEPIVLEGKCLVVCDSNPATDSKGSSSSPLGISVRAANSKVAFSAVRSTNHEPSEMSNKTRIIYFDQILVNVGNFFTLESVFVAPRKGIYSFSFHVIKVYQSQTIQVNLMLNGKPVISAFAGDKDVTREAATNGVLLYLDKEDKVYLKLEKGNLVGGWQYSTFSGFLVFPL

SEQ ID NO: 5732 - protein, 406 aa, unidentified
MVPPPPSRGGAARGQLGRSLGPLLLLLALGHTWTYREEPEDGDREICSESKIATTKYPCLKSSGELTTCYRKKCCKGYKFVLGQCIPEDYDVCAEAPCEQQCTDNFGRVLCTCYPGYRYDRERHRKREKPYCLDIDECASSNGTLCAHICINTLGSYRCECREGYIREDDGKTCTRGDKYPNDTGHEKSENMVKAGTCCATCKEFYQMKQTVLQLKQKIALLPNNAADLGKYITGDKVLASNTYLPGPPGLPGGQGPPGSPGPKGSPGFPGMPGPPGQPGPRGSMGPMGPSPDLSHIKQGRRGPVGPPGAPGRDGSKGERGAPGPRGSPGPPGSFDFLLLMLADIRNDITELQEKVFGHRTHSSAEEFPLPQEFPSYPEAMDLGSGDDHPRRTETRDLRAPRDFYP

SEQ ID NO: 5733 - protein, 446 aa, unidentified
MEKDKHSHFYNQKSDFRIEHSMLEELENKLIHSRKTERAKIQQQLAKIHNNVKKLQHQLKDVKPTPDFVEKLREMMEEIENAINTFKEEQRLIYEELIKEEKTTNNELSAISRKIDTWALGNSETEKAFRAISSKVPVDKVTPSTLPEEVLDFEKFLQQTGGRQGAWDDYDHQNFVKVRNKHKGKPTFMEEVLEHLPGKTQDEVQQHEKWYQKFLALEERKKESIQIWKTKKQQKREEIFKLKEKADNTPVLFHNKQEDNQKQKEEQRKKQKLAVEAWKKQKSIEMSMKCASQLKEEEEKEKKHQKERQRQFKLKLLLESYTQQKKEQEEFLRLEKEIREKAEKAEKRKNAADEISRFQERDLHKLELKILDRQAKEDEKSQKQRRLAKLKEKVENNVSRDPSRLYKPTKGWEERTKKIGPTGSGPLLHIPHRAIPTWRQGIQRRV

SEQ ID NO: 5734 - protein, 1044 aa, unidentified
MMAQKSQGSDNLQEGQEKSKREILKCTKSAWAPLDEWLPPDPEEESQSLTIPMLEDSKQESIQQWLDSGFFVSANENFQQVIDRTVSLYEQGMVQMTVKDYMRSLHQFSETPILSRGTSFNSCYSTASVPQSIPEWLEFWEIDPVEILLDLGFGADEPDICMQIPARFLGCGSAARGINIRVFLEAQKQRMDIENPNLYGRFRQLEILDHVTNAFSSLLSDVSILPNRAEEKAGGESVQRTSVSAAKEHRRRMGKLLRRASKQNIRRDCNPEVSESFKVKDEVFVPFTKPWDCGAELAATSINHKQNHLSLSVEHQSLQACDDLLPYPPHGLLSKQWPCSSMPAKQAPPSCVSEGSVKGRTQKENLFQTNKLKSLSHLAGKGPDSFEMEEVQSFEEETGNPLDMTSGTVGARVDRANSCQSDSSGFLEEPLEPLPLQMPSLPNSQSPAENGGRKPRDQSHSLVSSQDCQLESDGPDSKSRASMSFSSQEANALEQRASVSVMEEEFLLEAMEGPPELYIPDMACAKTTTRGECPRKDSHLWQLLPMPHAEYEVTRPTATSKYDHPLGFMVTHVTEMQDSFVRPEGAGKVQSHHNESQRSPGNDHTQDKFLHVDSEAPREEESSGFCPHTNHSLLVPESSSQCIPKHSEITPYATDLAQTSEKLIPHLHKLPGDPAQVKSRSGTLGQILPGTEAEMENLPLNTGSSRSVMTQMSSSLVSAAQRAVALGTGPRGTSLECTVCDPVTATETRLGTKARQLNDASIQTSALSNKTLTHGPQPLTKSVSLDSGFSSICPMGTCHAIPAHCCICCHHHPHCHGERQSPGPEPSVCRHCLCSLTGHQEAQFMTTLKALQDTTVRELCSCTVHEMEAMKTICQSFREYLEEIEQHLMGQQALFSRDMSEEEREEAEQLQTLREALRQQVAELEFQLGDRAQQIREGILLQLEVLTAEPPEHYSNLHQYNWIEESNGQTSCSKIHPGMAPRTVFPPDDGQEAPCSGGTQLAAFTPPTLENSTRMSPSSSAWAKLGPTPLSNCPVGEKDADVFL

SEQ ID NO: 5735 - protein, 229 aa, unidentified
MDLLQFLAFLFVLLLSGMGATGTLRTSLDPSLEIYKKMFEVKRREQLLALKNLAQLNDIHQQYKILDVMLKGLFKVLEDSRTVLTAADVLPDGPFPQDEKLKDAFSHVVENTAFFGDVVLRFPRIVHYYFDHNSNWNLLIRWGISFCNQTGVFNQGPHSPILSLMAQELGISEKDSNFQNPFKIDRTEFIPSTDPFQKALREEEKRRKKEEKRKEIRKGPRISRSQSEL

SEQ ID NO: 5736 - protein, 474 aa, unidentified
MANQLRERHQSLKKKYRELIDGDPSLPPEKRKQANLAQLLRDSQDRNKHLGEEIKELQQRLGEVQGDNKLLRMTIAKQRLGDEAIGVRHFAAHEREDLVQQLERAKEQIESLEHDLQASVDELQDVKEERSSYQDKVERLNQELNHILSGHENRIIDVDALCMENRYLQERLKQLHEEVNLLKSNIAKYKNALERRKNSKGQGKSSSSALTGVLSAKQVQDLLSEDHGCSLPATPQSISDLKSLATALLETIHEKNMVIQHQRQTNKILGNRVAELEKKLRTLEVSGLWSLPGGKDTILFSDPTLPSGQRSRSPLLKFVEQPTENKADPKDGEAQKQEEDESCAAAEALTAPEDAGRPAVNSPANQSRGNQCKLFHPSLPQLPSEEEVNSLGREIIKLTKEQAAAELEEVRRESPIEGQRSETGPAPPGLAIQGELPKSHLDSFEASRPAAKASTPEDGKGIPEGGGMRSTVKT

SEQ ID NO: 5737 - protein, 270 aa, unidentified
MLRQLLLAALCLAGPPAPARACQLPSEWRPLSEGCRAELAETIVYARVLALHPEAPGLYNHLPWQYHAGQGGLFYSAEVEMLCDQAWGSMLEVPAGSRLNLTGLGYFSCHSHTVVQDYSYFFFLRMDENYNLLPHGVNFQDAIFPDTQENRRMFSSLFQFSNCSQGQQLATFSSDWEIQEDSRLMCSSVQKALFEEEDHVKKLQQKVATLEKRNRQLRERVKKVKRSLRQARKKGRHLELANQKLSEKLAAGALPHINARGPVRPPYLRG

SEQ ID NO: 5738 - protein, 950 aa, unidentified
MTWRMGPRFTMLLAMWLVCGSEPHPHATIRGSHGGRKVPLVSPDSSRPARFLRHTGRSRGIERSTLEEPNLQPLQRRRSVPVLRLARPTEPPARSDINGAAVRPEQRPAARGSPREMIRDEGSSARSRMLRFPSGSSSPNILASFAGKNRVWVISAPHASEGYYRLMMSLLKDDVYCELAERHIQQIVLFHQAGEEGGKVRRITSEGQILEQPLDPSLIPKLMSFLKLEKGKFGMVLLKKTLQVEERYPYPVRLEAMYEVIDQGPIRRIEKIRQKGFVQKCKASGVEGQVVAEGNDGGGGAGRPSLGSEKKKEDPRRAQVPPTRESRVKVLRKLAATAPALPQPPSTPRATTLPPAPATTVTRSTSRAVTVAARPMTTTAFPTTQRPWTPSPSHRPPTTTEVITARRPSVSENLYPPSRKDQHRERPQTTRRPSKATSLESFTNAPPTTISEPSTRAAGPGRFRDNRMDRREHGHRDPNVVPGPPKPAKEKPPKKKAQDKILSNEYEEKYDLSRPTASQLEDELQVGNVPLKKAKESKKHEKLEKPEKEKKKKMKNENADKLLKSEKQMKKSEKKSKQEKEKSKKKKGGKTEQDGYQKPTNKHFTQSPKKSVADLLGSFEGKRRLLLITAPKAENNMYVQQRDEYLESFCKMATRKISVITIFGPVNNSTMKIDHFQLDNEKPMRVVDDEDLVDQRLISELRKEYGMTYNDFFMVLTDVDLRVKQYYEVPITMKSVFDLIDTFQSRIKDMEKQKKEGIVCKEDKKQSLENFLSRFRWRRRLLVISAPNDEDWAYSQQLSALSGQACNFGLRHITILKLLGVGEEVGGVLELFPINGSSVVEREDVPAHLVKDIRNYFQVSPEYFSMLLVGKDGNVKSWYPSPMWSMVIVYDLIDSMQLRRQEMAIQQSLGMRCPEDEYAGYGYHSYHQGYQDGYQDDYRHHESYHHGYPY

SEQ ID NO: 5739 - protein, 553 aa, unidentified
MSKAAGGAAAAAAAAESCSPAPAGSSAAPPAPVEDLSKVSDEELLQWSKEELIRSLRRAEAEKVSAMLDHSNLIREVNRRLQLHLGEIRGLKDINQKLQEDNQELRDLCCFLDDDRQKGKRVSREWQRLGRYTAGVMHKEVALYLQKLKDLEVKQEEVVKENMELKELCVLLDEEKGAGCAGSRCSIDSQASLCQLTASTAPYVRDVGDGSSTSSTGSTDSPDHHKHHASSGSPEHLQKPRSEGSPEHSKHRSASPEHPQKPRACGTPDRPKALKGPSPEHHKPLCKGSPEQQRHPHPGSSPETLPKHVLSGSPEHFQKHRSGSSPEHARHSGGSPEHLQKHALGGSLEHLPRARGTSPEHLKQHYGGSPDHKHGGGSGGSGGSGGGSREGTLRRQAQEDGSPHHRNVYSGMNESTLSYVRQLEARVRQLEEENRMLPQASQNRRQPPTRNSSNMEKGWGSRARRVLQWWQGCRGIGRCLPTLPGSFRLSSGADGSNSSPNSAASFSGHATPSQQPEPVVHSLKVVWRKLGDAAGSCPGIRQHLSGNQYKGPM

SEQ ID NO: 5740 - protein, 1476 aa, unidentified
MEGGKGPRLRDFLSGSLATWALGLAGLVGEAEDSEGEEEEEEEEPPLWLEKRFLRLSDGALLLRVLGIIAPSSRGGPRMLRGLDGPAAWRVWNLNHLWGRLRDFYQEELQLLILSPPPDLQTLGFDPLSEEAVEQLEGVLRLLLGASVQCEHRELFIRHIQGLSLEVQSELAAAIQEVTQPGAGVVLALSGPDPGELAPAELEMLSRSLMGTLSKLARERDLGAQRLAELLLEREPLCLRPEAPSRAPAEGPSHHLALQLANAKAQLRRLRQELEEKAELLLDSQAEVQGLEAEIRRLRQEAQALSGQAKRAELYREEAEALRERAGRLPRLQEELRRCRERLQAAEAYKSQLEEERVLSGVLEASKALLEEQLEAARERCARLHETQRENLLLRTRLGEAHAELDSLRHQVDQLAEENVELELELQRSLEPPPGSPGEAPLAGAAPSLQDEVREAEAGRLRTLERENRELRGLLQVLQGQPGGQHPLLEAPREDPVLPVLEEAPQTPVAFDHSPQGLVQKARDGGPQALDLAPPALDSVLEASAECPQAPDSDPQEAESPLQAAAMDPQASDWSPQESGSPVETQESPEKAGRRSSLQSPASVAPPQGPGTKIQAPQLLGGETEGREAPQGELVPEAWGLRQEGPEHKPGPSEPSSVQLEEQEGPNQGLDLATGQAEAREHDQRLEGTVRDPAWQKPQQKSEGALEVQVWEGPIPGESLASGVAEQEALREEVAQLRRKAEALGDELEAQARKLEAQNTEAARLSKELAQARRAEAEAHREAEAQAWEQARLREAVEAAGQELESASQEREALVEALAAAGRERRQWEREGSRLRAQSEAAEERMQVLESEGRQHLEEAERERREKEALQAELEKAVVRGKELGDRLEHLQRELEQAALERQEFLREKESQHQRYQGLEQRLEAELQAAATSKEEALMELKTRALQLEEELFQLRQGPAGLGPKKRAEPQLVETQNVRLIEVERSNAMLVAEKAALQGQLQHLEGQLGSLQGRAQELLLQSQRAQEHSSRLQAEKSVLEIQGQELHRKLEVLEEEVRAARQSQEETRGQQQALLRDHKALAQLQRRQEAELEGLLVRHRDLKANMRALELAHRELQGRHEQLQAQRASVEAQEVALLAERERLMQDGHRQRGLEEELRRLQSEHDRAQMLLAELSRERGELQGERGELRGRLARLELERAQLEMQSQQLRESNQQLDLSACRLTTQCELLTQLRSAQEEENRQLLAEVQALSRENRELLERSLESRDHLHREQREYLDQLNALRREKQKLVEKIMDQYRVLEPVPLPRTKKGSWLADKVKRLMRPRREGGPPGGLRLGADGAGSTESLGGPPETELPEGREADGTGSPSPAPMRRAQSSLCLRDETLAGGQRRKLSSRFPVGRSSESFSPGDTPRQRFRQRHPGPLGAPVSHSKGPGVGWENSAETLQEHETDANREGPEVQEPEKRPLTPSLSQ

SEQ ID NO: 5741 - protein, 266 aa, unidentified
MPPRGPASELLLLRLLLLGAATAAPLAPRPSKEELTRCLAEVVTEVLTVGQVQRGPCTALLHKELCGTEPHGCASTEEKGLLLGDFKKQEAGKMRSSQEVRDEEEEEVAERTHKSEVQEQAIRMQGHRQLHQEEDEEEEKEERKRGPMETFEDLWQRHLENGGDLQKRVAEKASDKETAQFQAEEKGVRVLGGDRSLWQGAERGGGERREDLPHHHHHHHQPEAEPRQEKEEASEREEKEVEQLEHLRDELKKVTETLGEQLRREG

SEQ ID NO: 5742 - protein, 115 aa, unidentified
MNSGVCLCVLMAVLAAGALTQPVPPADPAGSGLQRAEEAPRRQLRVSQRTDGESRAHLGALLARYIQQARKAPSGRMSIVKNLQNLDPSHRISDRDYMGWMDFGRRSAEEYEYPS

SEQ ID NO: 5743 - protein, 96 aa, unidentified
MQIITTALVCLLLAGMWPEDVDSKSMQVPFSRCCFSFAEQEIPLRAILCYRNTSSICSNEGLIFKLKRGKEACALDTVGWVQRHRKMLRHCPSKRK

SEQ ID NO: 5744 - protein, 97 aa, unidentified
MKVSAALLWLLLIAAAFSPQGLAGPASVPTTCCFNLANRKIPLQRLESYRRITSGKCPQKAVIFKTKLAKDICADPKKKWVQDSMKYLDQKSPTPKP

SEQ ID NO: 5745 - protein, 98 aa, unidentified
MKVSAVLLCLLLMTAAFNPQGLAQPDALNVPSTCCFTFSSKKISLQRLKSYVITTSRCPQKAVIFRTKLGKEICADPKEKWVQNYMKHLGRKAHTLKT

SEQ ID NO: 5746 - protein, 94 aa, unidentified
MAPLKMLALVTLLLGASLQHIHAARGTNVGRECCLEYFKGAIPLRKLKTWYQTSEDCSRDAIVFVTVQGRAICSDPNNKRVKNAVKYLQSLERS

SEQ ID NO: 5747 - protein, 98 aa, unidentified
MALLLALSLLVLWTSPAPTLSGTNDAEDCCLSVTQKPIPGYIVRNFHYLLIKDGCRVPAVVFTTLRGRQLCAPPDQPWVERIIQRLQRTSAKMKRRSS

SEQ ID NO: 5748 - protein, 99 aa, unidentified
MKVSAALLCLLLIAATFIPQGLAQPDAINAPVTCCYNFTNRKISVQRLASYRRITSSKCPKEAVIFKTIVAKEICADPKQKWVQDSMDHLDKQTQTPKT

SEQ ID NO: 5749 - protein, 96 aa, unidentified
MCCTKSLLLAALMSVLLLHLCGESEAASNFDCCLGYTDRILHPKFIVGFTRQLANEGCDINAIIFHTKKKLSVCANPKQTWVKYIVRLLSKKVKNM

SEQ ID NO: 5750 - protein, 134 aa, unidentified
MAQSLALSLLILVLAFGIPRTQGSDGGAQDCCLKYSQRKIPAKVVRSYRKQEPSLGCSIPAILFLPRKRSQAELCADPKELWVQQLMQHLDKTPSPQKPAQGCRKDRGASKTGKKGKGSKGCKRTERSQTPKGP

SEQ ID NO: 5751 - protein, 93 aa, unidentified
MDRLQTALLVVLVLLAVALQATEAGPYGANMEDSVCCRDYVRYRLPLRVVKHFYWTSDSCPRPGVVLLTFRDKEICADPRVPWVKMILNKLSQ

SEQ ID NO: 5752 - protein, 119 aa, unidentified
MAGLMTIVTSLLFLGVCAHHIIPTGSVVIPSPCCMFFVSKRIPENRVVSYQLSSRSTCLKAGVIFTTKKGQQFCGDPKQEWVQRYMKNLDAKQKKASPRARAVAVKGPVQRYPGNQTTC

SEQ ID NO: 5753 - protein, 150 aa, unidentified
MNLWLLACLVAGFLGAWAPAVHTQGVFEDCCLAYHYPIGWAVLRRAWTYRIQEVSGSCNLPAAIFYLPKRHRKVCGNPKSREVQRAMKLLDARNKVFAKLHHNTQTFQAGPHAVKKLSSGNSKLSSSKFSNPISSSKRNVSLLISANSGL

SEQ ID NO: 5754 - protein, 94 aa, unidentified
MMGLSLASAVLLASLLSLHLGTATRGSDISKTCCFQYSHKPLPWTWVRSYEFTSNSCSQRAVIFTTKRGKKVCTHPRKKWVQKYISLLKTPKQL

SEQ ID NO: 5755 - protein, 112 aa, unidentified
MKGPPTFCSLLLLSLLLSPDPTAAFLLPPSTACCTQLYRKPLSDKLLRKVIQVELQEADGDCHLQAFVLHLAQRSICIHPQNPSLSQWFEHQERKLHGTLPKLNFGMLRKMG

SEQ ID NO: 5756 - protein, 127 aa, unidentified
MQQRGLAIVALAVCAALHASEAILPIASSCCTEVSHHISRRLLERVNMCRIQRADGDCDLAAVILHVKRRRICVSPHNHTVKQWMKVQAAKKNGKGNVCHRKKHHGKRNSNRAHQGKHETYGHKTPY

SEQ ID NO: 5757 - protein, 91 aa, unidentified; identical to SEQ ID NO: 756

SEQ ID NO: 5758 - protein, 99 aa, unidentified; identical to SEQ ID NO: 757

SEQ ID NO: 5759 - protein, 99 aa, unidentified
MKVSAALLCLLLMAATFSPQGLAQPDSVSIPITCCFNVINRKIPIQRLESYTRITNIQCPKEAVIFKTKRGKEVCADPKERWVRDSMKHLDQIFQNLKP

SEQ ID NO: 5760 - protein, 277 aa, unidentified
MSLCEDMLLCNYRKCRIKLSGYAWVTACSHIFCDQHGSGEFSRSPAICPACNSTLSGKLDIVRTELSPSEEYKAMVLAGLRPEIVLDISSRALAFWTYQVHQERLYQEYNFSKAEGHLKQMEKIYTQQIQSKDVELTSMKGEVTSMKKVLEEYKKKFSDISEKLMERNRQYQKLQGLYDSLRLRNITIANHEGTLEPSMIAQSGVLGFPLGNNSKFPLDNTPVRNRGDGDGDFQFRPFFAGSPTAPEPSNSFFSFVSPSRELEQQQVSSRAFKVKRI

SEQ ID NO: 5761 - protein, 526 aa, unidentified
MASGPHSTATAAAAASSAAPSAGGSSSGTTTTTTTTTGGILIGDRLYSEVSLTIDHSLIPEERLSPTPSMQDGLDLPSETDLRILGCELIQAAGILLRLPQVAMATGQVLFHRFFYSKSFVKHSFEIVAMACINLASKIEEAPRRIRDVINVFHHLRQLRGKRTPSPLILDQNYINTKNQVIKAERRVLKELGFCVHVKHPHKIIVMYLQVLECERNQTLVQTAWNYMNDSLRTNVFVRFQPETIACACIYLAARALQIPLPTRPHWFLLFGTTEEEIQEICIETLRLYTRKKPNYELLEKEVEKRKVALQEAKLKAKGLNPDGTPALSTLGGFSPASKPSSPREVKAEEKSPISINVKTVKKEPEDRQQASKSPYNGVRKDSKRSRNSRSASRSRSRTRSRSRSHTPRRHYNNRRSRSGTYSSRSRSRSRSHSESPRRHHNHGSPHLKAKHTRDDLKSSNRHGHKRKKSRSRSQSKSRDHSDAAKKHRHERGHHRDRRERSRSFERSHKSKHHGGSRSGHGRHRR

SEQ ID NO: 5762 - protein, 520 aa, unidentified
MAAAAAAAGAAGSAAPAAAAGAPGSGGAPSGSQGVLIGDRLYSGVLITLENCLLPDDKLRFTPSMSSGLDTDTETDLRVVGCELIQAAGILLRLPQVAMATGQVLFQRFFYTKSFVKHSMEHVSMACVHLASKIEEAPRRIRDVINVFHRLRQLRDKKKPVPLLLDQDYVNLKNQIIKAERRVLKELGFCVHVKHPHKIIVMYLQVLECERNQHLVQTSWNYMNDSLRTDVFVRFQPESIACACIYLAARTLEIPLPNRPHWFLLFGATEEEIQEICLKILQLYARKKVDLTHLEGEVEKRKHAIEEAKAQARGLLPGGTQVLDGTSGFSPAPKLVESPKEGKGSKPSPLSVKNTKRRLEGAKKAKADSPVNGLPKGRESRSRSRSREQSYSRSPSRSASPKRRKSDSGSTSGGSKSQSRSRSRSDSPPRQAPRSAPYKGSEIRGSRKSKDCKYPQKPHKSRSRSSSRSRSRSRERADNPGKYKKKSHYYRDQRRERSRSYERTGRRYERDHPGHSRHRR

SEQ ID NO: 5763 - protein, 375 aa, unidentified
MERASCLLLLLLPLVHVSATTPEPCELDDEDFRCVCNFSEPQPDWSEAFQCVSAVEVEIHAGGLNLEPFLKRVDADADPRQYADTVKALRVRRLTVGAAQVPAQLLVGALRVLAYSRLKELTLEDLKITGTMPPLPLEATGLALSSLRLRNVSWATGRSWLAELQQWLKPGLKVLSIAQAHSPAFSCEQVRAFPALTSLDLSDNPGLGERGLMAALCPHKFPAIQNLALRNTGMETPTGVCAALAAAGVQPHSLDLSHNSLRATVNPSAPRCMWSSALNSLNLSFAGLEQVPKGLPAKLRVLDLSCNRLNRAPQPDELPEVDNLTLDGNPFLVPGTALPHEGSMNSGVVPACARSTLSVGVSGTLVLLQGARGFA

SEQ ID NO: 5764 - protein, 181 aa, unidentified
MLLEPGRGCCALAILLAIVDIQSGGCINITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLSSGFLQEKVWVMLVTSLVALQAL

SEQ ID NO: 5765 - protein, 197 aa, unidentified; identical to SEQ ID NO: 775

SEQ ID NO: 5766 - protein, 437 aa, unidentified
MSAVLLLALLGFILPLPGVQALLCQFGTVQHVWKVSDLPRQWTPKNTSCDSGLGCQDTLMLIESGPQVSLVLSKGCTEAKDQEPRVTEHRMGPGLSLISYTFVCRQEDFCNNLVNSLPLWAPQPPADPGSLRCPVCLSMEGCLEGTTEEICPKGTTHCYDGLLRLRGGGIFSNLRVQGCMPQPGCNLLNGTQEIGPVGMTENCNRKDFLTCHRGTTIMTHGNLAQEPTDWTTSNTEMCEVGQVCQETLLLLDVGLTSTLVGTKGCSTVGAQNSQKTTIHSAPPGVLVASYTHFCSSDLCNSASSSSVLLNSLPPQAAPVPGDRQCPTCVQPLGTCSSGSPRMTCPRGATHCYDGYIHLSGGGLSTKMSIQGCVAQPSSFLLNHTRQIGIFSAREKRDVQPPASQHEGGGAEGLESLTWGVGLALAPALWWGVVCPSC

SEQ ID NO: 5767 - protein, 388 aa, unidentified; identical to SEQ ID NO: 783

SEQ ID NO: 5768 - protein, 351 aa, unidentified; identical to SEQ ID NO: 784

SEQ ID NO: 5769 - protein, 278 aa, unidentified; identical to SEQ ID NO: 785

SEQ ID NO: 5770 - protein, 325 aa, unidentified [sequence omitted]

SEQ ID NO: 5771 - protein, 847 aa, unidentified; identical to SEQ ID NO: 790

SEQ ID NO: 5772 - protein, 336 aa, unidentified; identical to SEQ ID NO: 791

SEQ ID NO: 5773 - protein, 534 aa, unidentified; identical to SEQ ID NO: 797

SEQ ID NO: 5774 - protein, 299 aa, unidentified; identical to SEQ ID NO: 799

SEQ ID NO: 5775 - protein, 201 aa, unidentified; identical to SEQ ID NO: 802

SEQ ID NO: 5776 - protein, 290 aa, unidentified; identical to SEQ ID NO: 804

SEQ ID NO: 5777 - protein, 332 aa, unidentified; identical to SEQ ID NO: 805

SEQ ID NO: 5778 - protein, 171 aa, unidentified; identical to SEQ ID NO: 812

SEQ ID NO: 5779 - protein, 458 aa, unidentified; identical to SEQ ID NO: 815

SEQ ID NO: 5780 - protein, 277 aa, unidentified; identical to SEQ ID NO: 816

SEQ ID NO: 5781 - protein, 742 aa, unidentified; identical to SEQ ID NO: 818

SEQ ID NO: 5782 - protein, 243 aa, unidentified; identical to SEQ ID NO: 821

SEQ ID NO: 5783 - protein, 495 aa, unidentified; identical to SEQ ID NO: 822

SEQ ID NO: 5784 - protein, 381 aa, unidentified; identical to SEQ ID NO: 825

SEQ ID NO: 5785 - protein, 128 aa, unidentified; identical to SEQ ID NO: 827

SEQ ID NO: 5786 - protein, 347 aa, unidentified
MALLFSLILAICTRPGFLASPSGVRLVGGLHRCEGRVEVEQKGQWGTVCDDGWDIKDVAVLCRELGCGAASGTPSGILYEPPAEKEQKVLIQSVSCTGTEDTLAQCEQEEVYDCSHDEDAGASCENPESSFSPVPEGVRLADGPGHCKGRVEVKHQNQWYTVCQTGWSLRAAKVVCRQLGCGRAVLTQKRCNKHAYGRKPIWLSQMSCSGREATLQDCPSGPWGKNTCNHDEDTWVECEDPFDLRLVGGDNLCSGRLEVLHKGVWGSVCDDNWGEKEDQVVCKQLGCGKSLSPSFRDRKCYGPGVGRIWLDNVRCSGEEQSLEQCQHRFWGFHDCTHQEDVAVICSG

SEQ ID NO: 5787 - protein, 668 aa, unidentified; identical to SEQ ID NO: 828

SEQ ID NO: 5788 - protein, 354 aa, unidentified; identical to SEQ ID NO: 830

SEQ ID NO: 5789 - protein, 240 aa, unidentified; identical to SEQ ID NO: 832

SEQ ID NO: 5790 - protein, 226 aa, unidentified; identical to SEQ ID NO: 836

SEQ ID NO: 5791 - protein, 288 aa, unidentified; identical to SEQ ID NO: 838

SEQ ID NO: 5792 - protein, 329 aa, unidentified; identical to SEQ ID NO: 843

SEQ ID NO: 5793 - protein, 235 aa, unidentified; identical to SEQ ID NO: 844

SEQ ID NO: 5794 - protein, 210 aa, unidentified; identical to SEQ ID NO: 845

SEQ ID NO: 5795 - protein, 185 aa, unidentified; identical to SEQ ID NO: 849

SEQ ID NO: 5796 - protein, 597 aa, unidentified
MAASTSMVPVAVTAAVAPVLSINSDFSDLREIKKQLLLIAGLTRERGLLHSSKWSAELAFSLPALPLAELQPPPPITEEDAQDMDAYTLAKAYFDVKEYDRAAHFLHGCNSKKAYFLYMYSRYLSGEKKKDDETVDSLGPLEKGQVKNEALRELRVELSKKHQARELDGFGLYLYGVVLRKLDLVKEAIDVFVEATHVLPLHWGAWLELCNLITDKEMLKFLSLPDTWMKEFFLAHIYTELQLIEEALQKYQNLIDVGFSKSSYIVSQIAVAYHNIRDIDKALSIFNELRKQDPYRIENMDTFSNLLYVRSMKSELSYLAHNLCEIDKYRVETCCVIGNYYSLRSQHEKAALYFQRALKLNPRYLGAWTLMGHEYMEMKNTSAAIQAYRHAIEVNKRDYRAWYGLGQTYEILKMPFYCLYYYRRAHQLRPNDSRMLVALGECYEKLNQLVEAKKCYWRAYAVGDVEKMALVKLAKLHEQLTESEQAAQCYIKYIQDIYSCGEIVEHLEESTAFRYLAQYYFKCKLWDEASTCAQKCCAFNDTREEGKALLRQILQLRNQGETPTTEVPAPFFLPASLSANNTPTRRVSPLNLSSVTP

SEQ ID NO: 5797 - protein, 579 aa, unidentified
MSAAIAALAASYGSGSGSESDSDSESSRCPLPAADSLMHLTKSPSSKPSLAVAVDSAPEVAVKEDLETGVHLDPAVKEVQYNPTYETMFAPEFGPENPFRTQQMAAPRNMLSGYAEPAHINDFMFEQQRRTFATYGYALDPSLDNHQVSAKYIGSVEEAEKNQGLTVFETGQKKTEKRKKFKENDASNIDGFLGPWAKYVDEKDVAKPSEEEQKELDEITAKRQKKGKQEEEKPGEEKTILHVKEMYDYQGRSYLHIPQDVGVNLRSTMPPEKCYLPKKQIHVWSGHTKGVSAVRLFPLSGHLLLSCSMDCKIKLWEVYGERRCLRTFIGHSKAVRDICFNTAGTQFLSAAYDRYLKLWDTETGQCISRFTNRKVPYCVKFNPDEDKQNLFVAGMSDKKIVQWDIRSGEIVQEYDRHLGAVNTIVFVDENRRFVSTSDDKSLRVWEWDIPVDFKYIAEPSMHSMPAVTLSPNGKWLACQSMDNQILIFGAQNRFRLNKKKIFKGHMVAGYACQVDFSPDMSYVISGDGNGKLNIWDWKTTKLYSRFKAHDKVCIGAVWHPHETSKVITCGWDGLIKLWD

SEQ ID NO: 5798 - protein, 566 aa, unidentified
MFVSDFRKEFYEVVQSQRVLLFVASDVDALCACKILQALFQCDHVQYTLVPVSGWQELETAFLEHKEQFHYFILINCGANVDLLDILQPDEDTIFFVCDTHRPVNVVNVYNDTQIKLLIKQDDDLEVPAYEDIFRDEEEDEEHSGNDSDGSEPSEKRTRLEEEIVEQTMRRRQRREWEARRRDILFDYEQYEYHGTSSAMVMFELAWMLSKDLNDMLWWAIVGLTDQWVQDKITQMKYVTDVGVLQRHVSRHNHRNEDEENTLSVDCTRISFEYDLRLVLYQHWSLHDSLCNTSYTAARFKLWSVHGQKRLQEFLADMGLPLKQVKQKFQAMDISLKENLREMIEESANKFGMKDMRVQTFSIHFGFKHKFLASDVVFATMSLMESPEKDGSGTDHFIQALDSLSRSNLDKLYHGLELAKKQLRATQQTIASCLCTNLVISQGPFLYCSLMEGTPDVMLFSRPASLSLLSKHLLKSFVCSTKNRRCKLLPLVMAAPLSMEHGTVTVVGIPPETDSSDRKNFFGRAFEKAAESTSSRMLHNHFDLSVIELKAEDRSKFLDALISLLS

SEQ ID NO: 5799 - protein, 836 aa, unidentified; identical to SEQ ID NO: 853

SEQ ID NO: 5800 - protein, 449 aa, unidentified; identical to SEQ ID NO: 854

SEQ ID NO: 5801 - protein, 882 aa, unidentified; identical to SEQ ID NO: 855

SEQ ID NO: 5802 - protein, 796 aa, unidentified; identical to SEQ ID NO: 857

SEQ ID NO: 5803 - protein, 713 aa, unidentified
MQPRTPLVLCVLLSQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQDIFKFARTSPVPRQKRSIVVSPILIPENQRQPFPRDVGKVVDSDRPERSKFRLTGKGVDQEPKGIFRINENTGSVSVTRTLDREVIAVYQLFVETTDVNGKTLEGPVPLEVIVIDQNDNRPIFREGPYIGHVMEGSPTGTTVMRMTAFDADDPATDNALLRYNIRQQTPDKPSPNMFYIDPEKGDIVTVVSPALLDRETLENPKYELIIEAQDMAGLDVGLTGTATATIMIDDKNDHSPKFTKKEFQATVEEGAVGVIVNLTVEDKDDPTTGAWRAAYTIINGNPGQSFEIHTNPQTNEGMLSVVKPLDYEISAFHTLLIKVENEDPLVPDVSYGPSSTATVHITVLDVNEGPVFYPDPMMVTRQEDLSVGSVLLTVNATDPDSLQHQTIRYSVYKDPAGWLNINPINGTVDTTAVLDRESPFVDNSVYTALFLAIDSGNPPATGTGTLLITLEDVNDNAPFIYPTVAEVCDDAKNLSVVILGASDKDLHPNTDPFKFEIHKQAVPDKVWKISKINNTHALVSLLQNLNKANYNLPIMVTDSGKPPMTNITDLRVQVCSCRNSKVDCNAAGALRFSLPSVLLLSLFSLACL

SEQ ID NO: 5804 - protein, 832 aa, unidentified; identical to SEQ ID NO: 861

SEQ ID NO: 5805 - protein, 790 aa, unidentified; identical to SEQ ID NO: 862

SEQ ID NO: 5806 - protein, 772 aa, unidentified; identical to SEQ ID NO: 863

SEQ ID NO: 5807 - protein, 3354 aa, unidentified; identical to SEQ ID NO: 867

SEQ ID NO: 5808 - protein, 784 aa, unidentified; identical to SEQ ID NO: 872

SEQ ID NO: 5809 - protein, 859 aa, unidentified; identical to SEQ ID NO: 877

SEQ ID NO: 5810 - protein, 788 aa, unidentified; identical to SEQ ID NO: 880

SEQ ID NO: 5811 - protein, 845 aa, unidentified; identical to SEQ ID NO: 881

SEQ ID NO: 5812 - protein, 132 aa, unidentified
MVRRFLVTLRIRRACGPPRVRVFVVHIPRLTGEWAAPGAPAAVALVLMLLRSQRLGQQPLPRRPGHDDGQRPSGGAAAAPRRGAQLRRPRHSHPTRARRCPGGLPGHAGGAAPGRGAAGRARCLGPSARGPG

SEQ ID NO: 5813 - protein, 187 aa, unidentified
MWCASPVAVVAFCAGLLVSHPVLTQGQEAGGRPGADCEVCKEFLNRFYKSLIDRGVNFSLDTIEKELISFCLDTKGKENRLCYYLGATKDAATKILSEVTRPMSVHMPAMKICEKLKKLDSQICELKYEKTLDLASVDLRKMRVAELKQILHSWGEECRACAEKTDYVNLIQELAPKYAATHPKTEL

SEQ ID NO: 5814 - protein, 1287 aa, unidentified; identical to SEQ ID NO: 885

SEQ ID NO: 5815 - protein, 425 aa, unidentified
MALTGYSWLLLSATFLNVGAEISITLEPAQPSEGDNVTLVVHGLSGELLAYSWYAGPTLSVSYLVASYIVSTGDETPGPAHTGREAVRPDGSLDIQGILPRHSGTYILQTFNRQLQTEVGYGHVQVHEILAQPTVLANSTALVERRDTLRLMCSSPSPTAEVRWFFNGGALPVALRLGLSPDGRVLARHGIRREEAGAYQCEVWNPVSVSRSEPINLTVYFGPERVAILQDSTTRTGCTIKVDFNTSLTLWCVSRSCPEPEYVWTFNGQALKNGQDHLNISSMTAAQEGTYTCIAKNTKTLLSGSASVVVKLSAAAVATMIVPVPTKPTEGQDVTLTVQGYPKDLLVYAWYRGPASEPNRLLSQLPSGTWIAGPAHTGREVGFPNCSLLVQKLNLTDTGRYTLKTVTVQGKTETLEVELQVAPLG

SEQ ID NO: 5816 - protein, 300 aa, unidentified; identical to SEQ ID NO: 890

SEQ ID NO: 5817 - protein, 702 aa, unidentified
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNKLSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 5818 - protein, 265 aa, unidentified; identical to SEQ ID NO: 895

SEQ ID NO: 5819 - protein, 349 aa, unidentified
MGPISAPSCRWRIPWQGLLLTASLFTFWNPPTTAQLTIEAVPSNAAEGKEVLLLVHNLPQDPRGYNWYKGETVDANRRIIGYVISNQQITPGPAYSNRETIYPNASLLMRNVTRNDTGSYTLQVIKLNLMSEEVTGQFSVHPETPKPSISSNNSNPVEDKDAVAFTCEPETQNTTYLWWVNGQSLPVSPRLQLSNGNRTLTLLSVTRNDVGPYECEIQNPASANFSDPVTLNVLYGPDAPTISPSDTYYHAGVNLNLSCHAASNPPSQYSWSVNGTFQQYTQKLFIPNITTKNSGSYACHTTNSATGRNRTTVRMITVSDALVQGSSPGLSARATVSIMIGVLARVALI

SEQ ID NO: 5820 - protein, 511 aa, unidentified
MLVDGPSERPALCFLLLAVAMSFFGSALSIDETRAHLLLKEKMMRLGGRLVLNTKEELANERLMTLKIAEMKEAMRTLIFPPSMHFFQAKHLIERSQVFNILRMMPKGAALHLHDIGIVTMDWLVRNVTYRPHCHICFTPRGIMQFRFAHPTPRPSEKCSKWILLEDYRKRVQNVTEFDDSLLRNFTLVTQHPEVIYTNQNVVWSKFETIFFTISGLIHYAPVFRDYVFRSMQEFYEDNVLYMEIRARLLPVYELSGEHHDEEWSVKTYQEVAQKFVETHPEFIGIKIIYSDHRSKDVAVIAESIRMAMGLRIKFPTVVAGFDLVGHEDTGHSLHDYKEALMIPAKDGVKLPYFFHAGETDWQGTSIDRNILDALMLNTTRIGHGFALSKHPAVRTYSWKKDIPIEVCPISNQVLKLVSDLRNHPVATLMATGHPMVISSDDPAMFGAKGLSYDFYEVFMGIGGMKADLRTLKQLAMNSIKYSTLLESEKNTFMEIWKKRWDKFIADVATK

SEQ ID NO: 5821 - protein, 269 aa, unidentified
MIRTLLLSTLVAGALSCGDPTYPPYVTRVVGGEEARPNSWPWQVSLQYSSNGKWYHTCGGSLIANSWVLTAAHCISSSRTYRVGLGRHNLYVAESGSLAVSVSKIVVHKDWNSNQISKGNDIALLKLANPVSLTDKIQLACLPPAGTILPNNYPCYVTGWGRLQTNGAVPDVLQQGRLLVVDYATCSSSAWWGSSVKTSMICAGGDGVISSCNGDSGGPLNCQASDGRWQVHGIVSFGSRLGCNYYHKPSVFTRVSNYIDWINSVIANN

SEQ ID NO: 5822 - protein, 269 aa, unidentified
MIRTLLLSTLVAGALSCGVSTYAPDMSRMLGGEEARPNSWPWQVSLQYSSNGQWYHTCGGSLIANSWVLTAAHCISSSGIYRVMLGQHNLYVAESGSLAVSVSKIVVHKDWNSDQVSKGNDIALLKLANPVSLTDKIQLACLPPAGTILPNNYPCYVTGWGRLQTNGALPDDLKQGQLLVVDYATCSSSGWWGSTVKTNMICAGGDGVICTCNGDSGGPLNCQASDGRWEVHGIGSLTSVLGCNYYYKPSIFTRVSNYNDWINSVIANN

SEQ ID NO: 5823 - protein, 270 aa, unidentified
MMLRLLSSLLLVAVASGYGPPSSHSSSRVVHGEDAVPYSWPWQVSLQYEKSGSFYHTCGGSLIAPDWVVTAGHCISRDLTYQVVLGEYNLAVKEGPEQVIPINSEELFVHPLWNRSCVACGNDIALIKLSRSAQLGDAVQLASLPPAGDILPNKTPCYITGWGRLYTNGPLPDKLQQARLPVVDYKHCSRWNWWGSTVKKTMVCAGGYIRSGCNGDSGGPLNCPTEDGGWQVHGVTSFVSAFGCNFIWKPTVFTRVSAFIDWIEETIASH

SEQ ID NO: 5824 - protein, 270 aa, unidentified
MMLRLLSSLLLVAVASGYGPPSSRPSSRVVNGEDAVPYSWPWQVSLQYEKSGSFYHTCGGSLIAPDWVVTAGHCISSSRTYQVVLGEYDRAVKEGPEQVIPINSGDLFVHPLWNRSCVACGNDIALIKLSRSAQLGDAVQLASLPPAGDILPNETPCYITGWGRLYTNGPLPDKLQEALLPVVDYEHCSRWNWWGSSVKKTMVCAGGDIRSGCNGDSGGPLNCPTEDGGWQVHGVTSFVSAFGCNTRRKPTVFTRVSAFIDWIEETIASH

SEQ ID NO: 5825 - protein, 1361 aa, unidentified
MGAAGRQDFLFKAMLTISWLTLTCFPGATSTVAAGCPDQSPELQPWNPGHDQDHHVHIGQGKTLLLTSSATVYSIHISEGGKLVIKDHDEPIVLRTRHILIDNGGELHAGSALCPFQGNFTIILYGRADEGIQPDPYYGLKYIGVGKGGALELHGQKKLSWTFLNKTLHPGGMAEGGYFFERSWGHRGVIVHVIDPKSGTVIHSDRFDTYRSKKESERLVQYLNAVPDGRILSVAVNDEGSRNLDDMARKAMTKLGSKHFLHLGFRHPWSFLTVKGNPSSSVEDHIEYHGHRGSAAARVFKLFQTEHGEYFNVSLSSEWVQDVEWTEWFDHDKVSQTKGGEKISDLWKAHPGKICNRPIDIQATTMDGVNLSTEVVYKKGQDYRFACYDRGRACRSYRVRFLCGKPVRPKLTVTIDTNVNSTILNLEDNVQSWKPGDTLVIASTDYSMYQAEEFQVLPCRSCAPNQVKVAGKPMYLHIGEEIDGVDMRAEVGLLSRNIIVMGEMEDKCYPYRNHICNFFDFDTFGGHIKFALGFKAAHLEGTELKHMGQQLVGQYPIHFHLAGDVDERGGYDPPTYIRDLSIHHTFSRCVTVHGSNGLLIKDVVGYNSLGHCFFTEDGPEERNTFDHCLGLLVKSGTLLPSDRDSKMCKMITEDSYPGYIPKPRQDCNAVSTFWMANPNNNLINCAAAGSEETGFWFIFHHVPTGPSVGMYSPGYSEHIPLGKFYNNRAHSNYRAGMIIDNGVKTTEASAKDKRPFLSIISARYSPHQDADPLKPREPAIIRHFIAYKNQDHGAWLRGGDVWLDSCRFADNGIGLTLASGGTFPYDDGSKQEIKNSLFVGESGNVGTEMMDNRIWGPGGLDHSGRTLPIGQNFPIRGIQLYDGPINIQNCTFRKFVALEGRHTSALAFRLNNAWQSCPHNNVTGIAFEDVPITSRVFFGEPGPWFNQLDMDGDKTSVFHDVDGSVSEYPGSYLTKNDNWLVRHPDCINVPDWRGAICSGCYAQMYIQAYKTSNLRMKIIKNDFPSHPLYLEGALTRSTHYQQYQPVVTLQKGYTIHWDQTAPAELAIWLINFNKGDWIRVGLCYPRGTTFSILSDVHNRLLKQTSKTGVFVRTLQMDKVEQSYPGRSHYYWDEDSGLLFLKLKAQNEREKFAFCSMKGCERIKIKALIPKNAGVSDCTATAYPKFTERAVVDVPMPKKLFGSQLKTKDHFLEVKMESSKQHFFHLWNDFAYIEVDGKKYPSSEDGIQVVVIDGNQGRVVSHTSFRNSILQGIPWQLFNYVATIPDNSIVLMASKGRYVSRGPWTRVLEKLGADRGLKLKEQMAFVGFKGSFRPIWVTLDTEDHKAKIFQVVPIPVVKKKKL

SEQ ID NO: 5826 - protein, 500 aa, unidentified
MAAASVSAASGSHLSNSFAEPSRSNGSMVRHSSSPYVVYPSDKPFLNSDLRRSPSKPTLAYPESNSRAIFSALKNLQDKIRRLELERIQAEESVKTLSRETIEYKKVLDEQIQERENSKNEESKHNQELTSQLLAAENKCNLLEKQLEYMRNMIKHAEMERTSVLEKQVSLERERQHDQTHVQSQLEKLDLLEQEYNKLTTMQALAEKKMQELEAKLHEEEQERKRMQAKAAELQTGLETNRLIFEDKATPCVPNARRIKKKKSKPPEKKSSRNYFGAQPHYRLCLGDMPFVAGKSTSPSHAVVANVQLVLHLMKQHSKALCNDRVINSIPLAKQVSSRGGKSKKLSVTPPSSNGINEELSEVLQTLQDEFGQMSFDHQQLAKLIQESPTVELKDKLECELEALVGRMEAKANQITKVRKYQAQLEKQKLEKQKKELKATKKTLDEERNSSSRSGITGTTNKKDFMKLRPGEKRRKNLQLLKDMQSIQNSLQSSSLCWDY

SEQ ID NO: 5827 - protein, 783 aa, unidentified
MLLGFRRGRRSHFKHIIHGLLPAASVAPKAAVPRTPPPRSPNPSPERPRSALAAAILATTLTGRTVAIPQPRQRSRSESDVSSVEQDSFIEPYATTSQLRPRPNWQSEMGRRSSLPSFETLDYGDEEDIETQLSSSGKELGDVSAREDRGGHSDDLYAVPHRNQVPLLHEVNSEDDENISHQDGFPGSPPAPQRTQQKDGKHPVLNLKDEKPPLCEKPPPSPDITGRARQRYTEITREKFEALKEENMDLNNMNQSLTLELNTMKQAMKELQLKLKGMEKEKRKLKEAEKASSQEVAAPELLYLRKQAQELVDENDGLKMTVHRLNVELSRYQTKFRHLSKEESLNIEGLPSKGPIPPWLLDIKYLSPLLLAYEDMMKEKDELNATLKEEMRMFRMRVQEVVKENEELHQELNKSSAVTSEEWRQLQTQAKLVLEENKLLLEQLEIQQRKAKDSHQERLQEVSKLTKQLMLLEAKTHGQEKELAENREQLEILRAKCQELKTHSDGKIAVEVHKSIVNELKSQLQKEEEKERAEMEELMEKLTVLQAQKKSLLLEKNSLTEQNKALEAELERAQKINRKSQKKIEVLKKQVEKAMGNEMSAHQYLANLVGLAENITQERDSLMCLAKCLESEKDGVLNKVIKSNIRLGKLEEKVKGYKKQAALKLGDISHRLLEQQEDFAGKTAQYRQEMRHLHQVLKDKQEVLDQALQQNREMEGELEVIWESTFRENRRIRELLQDTLTRTGVQDNPRALVAPSLNGVSQADLLDGCDVCSYDLKSHAPTC

SEQ ID NO: 5828 - protein, 267 aa, unidentified
MHLLLFQLLVLLPLGKTTRHQDGRQNQSSLSPVLLPRNQRELPTGNHEEAEEKPDLFVAVPHLVATSPAGEGQRQREKMLSRFGRFWKKPEREMHPSRDSDSEPFPPGTQSLIQPIDGMKMEKSPLREEAKKFWHHFMFRKTPASQGVILPIKSHEVHWETCRTVPFSQTITHEGCEKVVVQNNLCFGKCGSVHFPGAAQHSHTSCSHCLPAKFTTMHLPLNCTELSSVIKVVMLVEECQCKVKTEHEDGHILHAGSQDSFIPGVSA

SEQ ID NO: 5829 - protein, 595 aa, unidentified
MRAARAAPLLQLLLLLGPWLEAAGVAESPLPAVVLAILARNAEHSLPHYLGALERLDYPRARMALWCATDHNVDNTTEMLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALVDGPRMQASAHVTRPSKRPSKIGFDEVFVISLARRPDRRERMLASLWEMEISGRVVDAVDGWMLNSSAIRNLGVDLLPGYQDPYSGRTLTKGEVGCFLSHYSIWEEVVARGLARVLVFEDDVRFESNFRGRLERLMEDVEAEKLSWDLIYLGRKQVNPEKETAVEGLPGLVVAGYSYWTLAYALRLAGARKLLASQPLRRMLPVDEFLPIMFDQHPNEQYKAHFWPRDLVAFSAQPLLAAPTHYAGDAEWLSDTETSSPWDDDSGRLISWSGSQKTLRSPRLDLTGSSGHSLQPQPRDEL

SEQ ID NO: 5830 - protein, 350 aa, unidentified; identical to SEQ ID NO: 904

SEQ ID NO: 5831 - protein, 567 aa, unidentified
MWLRAFILATLSASAAWGHPSSPPVVDTVHGKVLGKFVSLEGFAQPVAIFLGIPFAKPPLGPLRFTPPQPAEPWSFVKNATSYPPMCTQDPKAGQLLSELFTNRKENIPLKLSEDCLYLNIYTPADLTKKNRLPVMVWIHGGGLMVGAASTYDGLALAAHENVVVVTIQYRLGIWGFFSTGDEHSRGNWGHLDQVAALRWVQDNIASFGGNPGSVTIFGESAGGESVSVLVLSPLAKNLFHRAISESGVALTSVLVKKGDVKPLAEQIAITAGCKTTTSAVMVHCLRQKTEEELLETTLKMKFLSLDLQGDPRESQPLLGTVIDGMLLLKTPEELQAERNFHTVPYMVGINKQEFGWLIPMQLMSYPLSEGQLDQKTAMSLLWKSYPLVCIAKELIPEATEKYLGGTDDTVKKKDLFLDLIADVMFGVPSVIVARNHRDAGAPTYMYEFQYRPSFSSDMKPKTVIGDHGDELFSVFGAPFLKEGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 5832 - protein, 571 aa, unidentified
MERAVRVESGVLVGVVCLLLACPATATGPEVAQPEVDTTLGRVRGRQVGVKGTDRLVNVFLGIPFAQPPLGPDRFSAPHPAQPWEGVRDASTAPPMCLQDVESMNSSRFVLNGKQQIFSVSEDCLVLNVYSPAEVPAGSGRPVMVWVHGGALITGAATSYDGSALAAYGDVVVVTVQYRLGVLGFFSTGDEHAPGNQGFLDVVAALRWVQENIAPFGGDLNCVTVFGGSAGGSIISGLVLSPVAAGLFHRAITQSGVITTPGIIDSHPWPLAQKIANTLACSSSSPAEMVQCLQQKEGEELVLSKKLKNTIYPLTVDGTVFPKSPKELLKEKPFHSVPFLMGVNNHEFSWLIPRGWGLLDTMEQMSREDMLAISTPVLTSLDVPPEMMPTVIDEYLGSNSDAQAKCQAFQEFMGDVFINVPTVSFSRYLRDSGSPVFFYEFQHRPSSFAKIKPAWVKADHGAEGAFVFGGPFLMDESSRLAFPEATEEEKQLSLTMMAQWTHFARTGDPNSKALPPWPQFNQAEQYLEINPVPRAGQKFREAWMQFWSETLPSKIQQWHQKQKNRKAQEDL

SEQ ID NO: 5833 - protein, 561 aa, unidentified
MRWILCWSLTLCLMAQTALGALHTKRPQVVTKYGTLQGKQMHVGKTPIQVFLGVPFSRPPLGILRFAPPEPPEPWKGIRDATTYPPGCLQESWGQLASMYVSTRERYKWLRFSEDCLYLNVYAPARAPGDPQLPVMVWFPGGAFIVGAASSYEGSDLAAREKVVLVFLQHRLGIFGFLSTDDSHARGNWGLLDQMAALRWVQENIAAFGGDPGNVTLFGQSAGAMSISGLMMSPLASGLFHRAISQSGTALFRLFITSNPLKVAKKVAHLAGCNHNSTQILVNCLRALSGTKVMRVSNKMRFLQLNFQRDPEEIIWSMSPVVDGVVIPDDPLVLLTQGKVSSVPYLLGVNNLEFNWLLPYIMKFPLNRQAMRKETITKMLWSTRTLLNITKEQVPLVVEEYLDNVNEHDWKMLRNRMMDIVQDATFVYATLQTAHYHRDAGLPVYLYEFEHHARGIIVKPRTDGADHGDEMYFLFGGPFATGLSMGKEKALSLQMMKYWANFARTGNPNDGNLPCWPRYNKDEKYLQLDFTTRVGMKLKEKKMAFWMSLYQSQRPEKQRQF

SEQ ID NO: 5834 - protein, 575 aa, unidentified
MSGNWVHPGQILIWAIWVLAAPTKGPSAEGPQRNTRLGWIQGKQVTVLGSPVPVNVFLGVPFAAPPLGSLRFTNPQPASPWDNLREATSYPNLCLQNSEWLLLDQHMLKVHYPKFGVSEDCLYLNIYAPAHADTGSKLPVLVWFPGGAFKTGSASIFDGSALAAYEDVLVVVVQYRLGIFGFFTTWDQHAPGNWAFKDQVAALSWVQKNIEFFGGDPSSVTIFGESAGAISVSSLILSPMAKGLFHKAIMESGVAIIPYLEAHDYEKSEDLQVVAHFCGNNASDSEALLRCLRTKPSKELLTLSQKTKSFTRVVDGAFFPNEPLDLLSQKAFKAIPSIIGVNNHECGFLLPMKEAPEILSGSNKSLALHLIQNILHIPPQYLHLVANEYFHDKHSLTEIRDSLLDLLGDVFFVVPALITARYHRDAGAPVYFYEFRHRPQCFEDTKPAFVKADHADEVRFVFGGAFLKGDIVMFEGATEEEKLLSRKMMKYWATFARTGNPNGNDLSLWPAYNLTEQYLQLDLNMSLGQRLKEPRVDFWTSTIPLILSASDMLHSPLSSLTFLSLLQPFFFFCAP

SEQ ID NO: 5835 - protein, 493 aa, unidentified [sequence omitted]

SEQ ID NO: 5836 - protein, 1925 aa, unidentified
MFTLTGCRLVEKTQKVENPSVSFASSFPLIPLLLRGKSVQKKQAESKSQIKLHTQSAPFGLCPKDMMLTQAPSSVVRSRNSRNHTVNSGGSCLSASTVAIPAINDSSAAMSACSTISAQPASSMDTQMHSPKKQERVNKRVIWGIEVAEELHWKGWELGKETTRNLVLKNRSLKLQKMKYRPPKTKFFFTVIPQPIFLSPGITLTLPIVFRPLEAKEYMDQLWFEKAEGMFCVGLRATLPCHRLICRPPSLQLPMCAVGDTTEAFFCLDNVGDLPTFFTWEFSSPFQMLPATGLLEPGQASQIKVTFQPLTAVIYEVQATCWYGAGSRQRSSIQLQAVAKCAQLLVSIKHKCPEDQDAEGFQKLLYFGSVAVGCTSERQIRLHNPSAVNAPFRIEISPDELAEDQAFSCPTAHGIVLPGEKKCVSVFFHPKTLDTRTVDYCSIMPSGCASKTLLKVVGFCRGPAVSLQHYCVNFSWVNLGERSEQPLWIENQSDCTAHFQFAIDCLESVFTIRPAFGTLVGKARMTLHCAFQPTHPIICFRRVACLIHHQDPLFLDLMGTCHSDSTKPAILKPQHLTWYRTHLARGLTLYPPDILDAMLKEKKLAQDQNGALMIPIQDLEDMPAPQYPYIPPMTEFFFDGTSDITIFPPPISVEPVEVDFGACPGPEAPNPVPLCLMNHTKGKIMVVWTRRSDCPFWVTPESCDVPPLKSMAMRLHFQPPHPNCLYTVELEAFAIYKVLQSYSNIEEDCTMCPSWCLTVRARGHSYFAGFEHHIPQYSLDVPKLFPAVSSGEPTYRSLLLVNKDCKLLTFSLAPQRGSDVILRPTSGLVAPGAHQIILICTYPEGSSWKQHTFYLQCNASPQYLKEVSMYSREEPLQLKLDTHKSLYFKPTWVGCSSTSPFTFRNPSRLPLQFEWRVSEQHRKLLAVQPSRGLIQPNERLTLTWTFSPLEETKYLFQVGMWVWEAGLSPNANPAATTHYMLRLVGVGLTSSLSAKEKELAFGNVLVNSKQSRFLVLLNDGNCTLYYRLYLEQGSPEAVDNHPLALQLDRTEGSMPPRSQDTICLTACPKQRSQYSWTITYSLLSHRDNKAGEKQELCCVSLVAVYPLLSILDVSSMGSAEGITRKHLWRLFSLDLLNSYLERDPTPCELTYKVPTRHSMSQIPPVLTPLRLDFNFGAAPFKAPPSVVFLALKNSGVVSLDWAFLLPSDQRIDVELWAEQAELNSTELHQMRVQDNCLFSISPKAGSLSPGQEQMVELKYSHLFIGTDHLPVLFKVSHGREILLNFIGVTVKPEQKYVHFTSTTHQFIPIPIGDTLPPRQIYELYNGGSVPVTYEVQTDVLSQVQEKNFDHPIFCCLNPKGEIQPGSTARVLWIFSPIEAKTYTVDVPIHILGWNSALIHFQGVGYNPHMMGDTAPFHNISSWDNSSIHSRLVVPGQNVFLSQSHISLGNIPVQSKCSRLLFLNNISKNEEIAFSWQPSPLDFGEVSVSPMIGVVAPEETVPFVVTLRASVHASFYSADLVCKLYSQQLMRQYHKELQEWKDEKVRQEVEFTITDMKVKKRTCCTACEPARKYKTLPPIKNQQSVSRPASWKLQTPKEEVSWPCPQPPSPGMLCLGLTARAHATDYFLANFFSEFPCHFLHRELPKRKAPREESETSEEKSPNKWGPVSKQKKQLLVDILTTIIRGLLEDKNFHEAVDQSLVEQVPYFRQFWNEQSTKFMDQKNSLYLMPILPVPSSSWEDGKGKQPKEDRPEHYPGLGKKEEGEEEKGEEEEEELEEEEEEEEETEEEELGKEEIEEKEEERDEKEEKVSWAGIGPTPQPESQESMQWQWQQQLNVMVKEEQEQDEKEAIRRLPAFANLQEALLENMIQNILVEASRGEVVLTSRPRVIALPPFCVPRSLTPDTLLPTQQAEVLHPVVPLPTDLP

SEQ ID NO: 5837 - protein, 764 aa, unidentified
MGSNLSPQLCLMPFILGLLSGGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 5838 - protein, 223 aa, unidentified
MTWRHHVRLLFTVSLALQIINLGNSYQREKHNGGREEVTKVATQKHRQSPLNWTSSHFGEVTGSAEGWGPEEPLPYSRAFGEGASARPRCCRNGGTCVLGSFCVCPAHFTGRYCEHDQRRSECGALEHGAWTLRACHLCRCIFGALHCLPLQTPDRCDPKDFLASHAHGPSAGGAPSLLLLLPCALLHRLLRPDAPAHPRSLVPSVLQRERRPCGRPGLGHRL

SEQ ID NO: 5839 - protein, 223 aa, unidentified
MTWRHHVRLLFTVSLALQIINLGNSYQREKHNGGREEVTKVATQKHRQSPLNWTSSHFGEVTGSAEGWGPEEPLPYSWAFGEGASARPRCCRNGGTCVLGSFCVCPAHFTGRYCEHDQRRSECGALEHGAWTLRACHLCRCIFGALHCLPLQTPDRCDPKDFLASHAHGPSAGGAPSLLLLLPCALLHRLLRPDAPAHPRSLVPSVLQRERRPCGRPGLGHRL

SEQ ID NO: 5840 - protein, 253 aa, unidentified
MHSWERLAVLVLLGAAACAAPPRGRILGGREAEAHARPYMASVQLNGAHLCGGVLVAEQWVLSAAHCLEDAADGKVQVLLGAHSLSQPEPSKRLYDVLRAVPHPDSQPDTIDHDLLLLQLSEKATLGPAVRPLPWQRVDRDVAPGTLCDVAGWGIVNHAGRRPDSLQHVLLPVLDRATCNRRTHHDGAITERLMCAESNRRDSCKGDSGGPLVCGGVLEGVVTSGSRVCGNRKKPGIYTRVASYAAWIDSVLA

SEQ ID NO: 5841 - protein, 299 aa, unidentified
MEEFDSEDFSTSEEDEDYVPSGGEYSEDDVNELVKEDEVDGEEQTQKTQGKKRKAQSIPARKRRQGGLSLEEEEEEDANSESEGSSSEEEDDAAEQEKGIGSEDARKKKEDELWASFLNDVGPKSKVPPSTQVKKGEETEETSSSKLLVKAEELEKPKETEKVKITKVFDFAGEEVRVTKEVDATSKEAKSFFKQNEKEKPQANVPSALPSLPAGSGLKRSSGMSSLLGKIGAKKQKMSTLEKSKLDWESFKEEEGIGEELAIHNRGKEGYIERKAFLDRVDHRQFEIERDLRLSKMKP

SEQ ID NO: 5842 - protein, 1231 aa, unidentified
MRLLAKIICLMLWAICVAEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKPCDYPDIKHGGLYHENMRRPYFPVAVGKYYSYYCDEHFETPSGSYWDHIHCTQDGWSPAVPCLRKCYFPYLENGYNQNYGRKFVQGKSIDVACHPGYALPKAQTTVTCMENGWSPTPRCIRVKTCSKSSIDIENGFISESQYTYALKEKAKYQCKLGYVTADGETSGSITCGKDGWSAQPTCIKSCDIPVFMNARTKNDFTWFKLNDTLDYECHDGYESNTGSTTGSIVCGYNGWSDLPICYERECELPKIDVHLVPDRKKDQYKVGEVLKFSCKPGFTIVGPNSVQCYHFGLSPDLPICKEQVQSCGPPPELLNGNVKEKTKEEYGHSEVVEYYCNPRFLMKGPNKIQCVDGEWTTLPVCIVEESTCGDIPELEHGWAQLSSPPYYYGDSVEFNCSESFTMIGHRSITCIHGVWTQLPQCVAIDKLKKCKSSNLIILEEHLKNKKEFDHNSNIRYRCRGKEGWIHTVCINGRWDPEVNCSMAQIQLCPPPPQIPNSHNMTTTLNYRDGEKVSVLCQENYLIQEGEEITCKDGRWQSIPLCVEKIPCSQPPQIEHGTINSSRSSQESYAHGTKLSYTCEGGFRISEENETTCYMGKWSSPPQCEGLPCKSPPEISHGVVAHMSDSYQYGEEVTYKCFEGFGIDGPAIAKCLGEKWSHPPSCIKTDCLSLPSFENAIPMGEKKDVYKAGEQVTYTCATYYKMDGASNVTCINSRWTGRPTCRDTSCVNPPTVQNAYIVSRQMSKYPSGERVRYQCRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYSRTGESVEFVCKRGYRLSSRSHTLRTTCWDGKLEYPTCAKR

SEQ ID NO: 5843 - protein, 330 aa, unidentified
MWLLVSVILISRISSVGGEATFCDFPKINHGILYDEEKYKPFSQVPTGEVFYYSCEYNFVSPSKSFWTRITCTEEGWSPTPKCLRLCFFPFVENGHSESSGQTHLEGDTVQIICNTGYRLQNNENNISCVERGWSTPPKCRSTDTSCVNPPTVQNAHILSRQMSKYPSGERVRYECRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYLRTGESAEFVCKRGYRLSSRSHTLRTTCWDGKLEYPTCAKR

SEQ ID NO: 5844 - protein, 270 aa, unidentified
MWLLVSVILISRISSVGGEAMFCDFPKINHGILYDEEKYKPFSQVPTGEVFYYSCEYNFVSPSKSFWTRITCAEEGWSPTPKCLRLCFFPFVENGHSESSGQTHLEGDTVQIICNTGYRLQNNENNISCVERGWSTPPKCRSTISAEKCGPPPPIDNGDITSFLLSVYAPGSSVEYQCQNLYQLEGNNQITCRNGQWSEPPKCLDPCVISQEIMEKYNIKLKWTNQQKLYSRTGDIVEFVCKSGYHPTKSHSFRAMCQNGKLVYPSCEEK

SEQ ID NO: 5845 - protein, 330 aa, unidentified
MLLLINVILTLWVSCANGQVKPCDFPDIKHGGLFHENMRRPYFPVAVGKYYSYYCDEHFETPSGSYWDYIHCTQNGWSPAVPCLRKCYFPYLENGYNQNYGRKFVQGNSTEVACHPGYGLPKAQTTVTCTEKGWSPTPRCIRVRTCSKSDIEIENGFISESSSIYILNKEIQYKCKPGYATADGNSSGSITCLQNGWSAQPICINSSEKCGPPPPISNGDTTSFLLKVYVPQSRVEYQCQPYYELQGSNYVTCSNGEWSEPPRCIHPCIITEENMNKNNIKLKGRSDRKYYAKTGDTIEFMCKLGYNANTSILSFQAVCREGIVEYPRCE

SEQ ID NO: 5846 - protein, 578 aa, unidentified
MLLLINVILTLWVSCANGQEVKPCDFPEIQHGGLYYKSLRRLYFPAAAGQSYSYYCDQNFVTPSGSYWDYIHCTQDGWSPTVPCLRTCSKSDVEIENGFISESSSIYILNEETQYNCKPGYATAEGNSSGSITCLQNGWSTQPICIKFCDMPVFENSRAKSNGMWFKLHDTLDYECYDGYESSYGNTTDSIVCGEDGWSHLPTCYNSSENCGPPPPISNGDTTSFPQKVYLPWSRVEYQCQSYYELQGSKYVTCSNGDWSEPPRCISMKPCEFPEIQHGHLYYENTRRPYFPVATGQSYSYYCDQNFVTPSGSYWDYIHCTQDGWLPTVPCLRTCSKSDIEIENGFISESSSIYILNKEIQYKCKPGYATADGNSSGSITCLQNGWSAQPICIKFCDMPVFENSRAKSNGMRFKLHDTLDYECYDGYEISYGNTTGSIVCGEDGWSHFPTCYNSSEKCGPPPPISNGDTTSFLLKVYVPQSRVEYQCQSYYELQGSNYVTCSNGEWSEPPRCIHPCIITEENMNKNNIQLKGKSDIKYYAKTGDTIEFMCKLGYNANTSVLSFQAVCREGIVEYPRCE

SEQ ID NO: 5847 - protein, 569 aa, unidentified
MLLLFSVILISWVSTVGGEGTLCDFPKIHHGFLYDEEDYNPFSQVPTGEVFYYSCEYNFVSPSKSFWTRITCTEEGWSPTPKCLRMCSFPFVKNGHSESSGLIHLEGDTVQIICNTGYSLQNNEKNISCVERGWSTPPICSFTKGECHVPILEANVDAQPKKESYKVGDVLKFSCRKNLIRVGSDSVQCYQFGWSPNFPTCKGQVRSCGPPPQLSNGEVKEIRKEEYGHNEVVEYDCNPNFIINGPKKIQCVDGEWTTLPTCVEQVKTCGYIPELEYGYVQPSVPPYQHGVSVEVNCRNEYAMIGNNMITCINGIWTELPMCVATHQLKRCKIAGVNIKTLLKLSGKEFNHNSRIRYRCSDIFRYRHSVCINGKWNPEVDCTEKREQFCPPPPQIPNAQNMTTTVNYQDGEKVAVLCKENYLLPEAKEIVCKDGRWQSLPRCVESTAYCGPPPSINNGDTTSFPLSVYPPGSTVTYRCQSFYKLQGSVTVTCRNKQWSEPPRCLDPCVVSEENMNKNNIQLKWRNDGKLYAKTGDAVEFQCKFPHKAMISSPPFRAICQEGKFEYPICE

SEQ ID NO: 5848 - protein, 583 aa, unidentified
MKLLHVFLLFLCFHLRFCKVTYTSQEDLVEKKCLAKKYTHLSCDKVFCQPWQRCIEGTCVCKLPYQCPKNGTAVCATNRRSFPTYCQQKSLECLHPGTKFLNNGTCTAEGKFSVSLKHGNTDSEGIVEVKLVDQDKTMFICKSSWSMREANVACLDLGFQQGADTQRRFKLSDLSINSTECLHVHCRGLETSLAECTFTKRRTMGYQDFADVVCYTQKADSPMDDFFQCVNGKYISQMKACDGINDCGDQSDELCCKACQGKGFHCKSGVCIPSQYQCNGEVDCITGEDEVGCAGFASVTQEETEILTADMDAERRRIKSLLPKLSCGVKNRMHIRRKRIVGGKRAQLGDLPWQVAIKDASGITCGGIYIGGCWILTAAHCLRASKTHRYQIWTTVVDWIHPDLKRIVIEYVDRIIFHENYNAGTYQNDIALIEMKKDGNKKDCELPRSIPACVPWSPYLFQPNDTCIVSGWGREKDNERVFSLQWGEVKLISNCSKFYGNRFYEKEMECAGTYDGSIDACKGDSGGPLVCMDANNVTYVWGVVSWGENCGKPEFPGVYTKVANYFDWISYHVGRPFISQYNV

SEQ ID NO: 5849 - protein, 469 aa, unidentified
MITEGAQAPRLLLPPLLLLLTLPATGSDPVLCFTQYEESSGKCKGLLGGGVSVEDCCLNTAFAYQKRSGGLCQPCRSPRWSLWSTWAPCSVTCSEGSQLRYRRCVGWNGQCSGKVAPGTLEWQLQACEDQQCCPEMGGWSGWGPWEPCSVTCSKGTRTRRRACNHPAPKCGGHCPGQAQESEACDTQQVCPTHGAWATWGPWTPCSASCHGGPHEPKETRSRKCSAPEPSQKPPGKPCPGLAYEQRRCTGLPPCPVAGGWGPWGPVSPCPVTCGLGQTMEQRTCNHPVPQHGGPFCAGDATRTHICNTAVPCPVDGEWDSWGEWSPCIRRNMKSISCQEIPGQQSRGRTCRGRKFDGHRCAGQQQDIRHCYSIQHCPLKGSWSEWSTWGLCMPPCGPNPTRARQRLCTPLLPKYPPTVSMVEGQGEKNVTFWGRPLPRCEELQGQKLVVEEKRPCLHVPACKDPEEEEL

SEQ ID NO: 5850 - protein, 116 aa, unidentified
MDYYRKYAAIFLVTLSVFLHVLHSAPDVQDCPECTLQENPFFSQPGAPILQCMGCCFSRAYPTPLRSKKTMLVQKNVTSESTCCVAKSYNRVTVMGGFKVENHTACHCSTCYYHKS

SEQ ID NO: 5851 - protein, 187 aa, unidentified
MSTFPVLAEDIPLRERHVKGRVDPHFRAPKMEMFQRLLLLLLLSMGGTWASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGP

SEQ ID NO: 5852 - protein, 318 aa, unidentified
MLPLTMTVLILLLLPTGQAAPKDGVTRPDSEVQHQLLPNPFQPGQEQLGLLQSYLKGLGRTEVQLEHLSREQVLLYLFALHDYDQSGQLDGLELLSMLTAALAPGAANSPTTNPVILIVDKVLETQDLNGDGLMTPAELINFPGVALRHVEPGEPLAPSPQEPQAVGRQSLLAKSPLRQETQEAPGPREEAKGQVEARRESLDPVQEPGGQAEADGDVPGPRGEAEGQAEAKGDAPGPRGEAGGQAEAEGDAPGPRGEAGGQAEAEGDAPGPRGEAGGQAEARENGEEAKELPGETLESKNTQNDFEVHIVQVENDEI

SEQ ID NO: 5853 - protein, 359 aa, unidentified
MVRPMLLLSLGLLAGLLPALAACPQNCHCHSDLQHVICDKVGLQKIPKVSEKTKLLNLQRNNFPVLAANSFRAMPNLVSLHLQHCQIREVAAGAFRGLKQLIYLYLSHNDIRVLRAGAFDDLTELTYLYLDHNKVTELPRGLLSPLVNLFILQLNNNKIRELRAGAFQGAKDLRWLYLSENALSSLQPGALDDVENLAKFHVDRNQLSSYPSAALSKLRVVEELKLSHNPLKSIPDNAFQSFGRYLETLWLDNTNLEKFSDGAFLGVTTLKHVHLENNRLNQLPSNFPFDSLETLALTNNPWKCTCQLRGLRRWLEAKASRPDATCASPAKFKGQHIRDTDAFRSCKFPTKRSKKAGRH

SEQ ID NO: 5854 - protein, 762 aa, unidentified
MEGPRSSTHVPLVLPLLVLLLLAPARQAAAQRCPQACICDNSRRHVACRYQNLTEVPDAIPELTQRLDLQGNLLKVIPAAAFQGVPHLTHLDLRHCEVELVAEGAFRGLGRLLLLNLASNHLRELPQEALDGLGSLRRLELEGNALEELRPGTFGALGALATLNLAHNALVYLPAMAFQGLLRVRWLRLSHNALSVLAPEALAGLPALRRLSLHHNELQALPGPVLSQARGLARLELGHNPLTYAGEEDGLALPGLRELLLDGGALQALGPRAFAHCPRLHTLDLRGNQLDTLPPLQGPGQLRRLRLQGNPLWCGCQARPLLEWLARARVRSDGACQGPRRLRGEALDALRPWDLRCPGDAAQEEEELEERAVAGPRAPPRGPPRGPGEERAVAPCPRACVCVPESRHSSCEGCGLQAVPRGFPSDTQLLDLRRNHFPSVPRAAFPGLGHLVSLHLQHCGIAELEAGALAGLGRLIYLYLSDNQLAGLSAAALEGAPRLGYLYLERNRFLQVPGAALRALPSLFSLHLQDNAVDRLAPGDLGRTRALRWVYLSGNRITEVSLGALGPARELEKLHLDRNQLREVPTGALEGLPALLELQLSGNPLRALRDGAFQPVGRSLQHLFLNSSGLEQICPGAFSGLGPGLQSLHLQKNQLRALPALPSLSQLELIDLSSNPFHCDCQLLPLHRWLTGLNLRVGATCATPPNARGQRVKAAAAVFEDCPGWAARKAKRTPASRPSARRTPIKGRQCGADKVGKEKGRL

SEQ ID NO: 5855 - protein, 543 aa, unidentified; identical to SEQ ID NO: 918

SEQ ID NO: 5856 - protein, 306 aa, unidentified
MRSAAVLALLLCAGQVTALPVNSPMNKGDTEVMKCIVEVISDTLSKPSPMPVSQECFETLRGDERILSILRHQNLLKELQDLALQGAKERAHQQKKHSGFEDELSEVLENQSSQAELKGRSEALAVDGAGKPGAEEAQDPEGKGEQEHSQQKEEEEEMAVVPQGLFRGGKSGELEQEEERLSKEWEDSKRWSKMDQLAKELTAEKRLEGQEEEEDNRDSSMKLSFRARAYGFRGPGPQLRRGWRPSSREDSLEAGLPLQVRGYPEEKKEEEGSANRRPEDQELESLSAIEAELEKVAHQLQALRRG

SEQ ID NO: 5857 - protein, 677 aa, unidentified
MQPTLLLSLLGAVGLAAVNSMPVDNRNHNEGMVTRCIIEVLSNALSKSSAPPITPECRQVLKTSRKDVKDKETTENENTKFEVRLLRDPADASEAHESSSRGEAGAPGEEDIQGPTKADTEKWAEGGGHSRERADEPQWSLYPSDSQVSEEVKTRHSEKSQREDEEEEEGENYQKGERGEDSSEEKHLEEPGETQNAFLNERKQASAIKKEELVARSETHAAGHSQEKTHSREKSSQESGEETGSQENHPQESKGQPRSQEESEEGEEDATSEVDKRRTRPRHHHGRSRPDRSSQGGSLPSEEKGHPQEESEESNVSMASLGEKRDHHSTHYRASEEEPEYGEEIKGYPGVQAPEDLEWERYRGRGSEEYRAPRPQSEESWDEEDKRNYPSLELDKMAHGYGEESEEERGLEPGKGRHHRGRGGEPRAYFMSDTREEKRFLGEGHHRVQENQMDKARRHPQGAWKELDRNYLNYGEEGAPGKWQQQGDLQDTKENREEARFQDKQYSSHHTAEKRKRLGELFNPYYDPLQWKSSHFERRDNMNDNFLEGEEENELTLNEKNFFPEYNYDWWEKKPFSEDVNWGYEKRNLARVPKLDLKRQYDRVAQLDQLLHYRKKSAEFPDFYDSEEPVSTHQEAENEKDRADQTVLTEDEKKELENLAAMDLELQKIAEKFSQRG

SEQ ID NO: 5858 - protein, 383 aa, unidentified
MGVKASQTGFVVLVLLQCCSAYKLVCYYTSWSQYREGDGSCFPDALDRFLCTHIIYSFANISNDHIDTWEWNDVTLYGMLNTLKNRNPNLKTLLSVGGWNFGSQRFSKIASNTQSRRTFIKSVPPFLRTHGFDGLDLAWLYPGRRDKQHFTTLIKEMKAEFIKEAQPGKKQLLLSAALSAGKVTIDSSYDIAKISQHLDFISIMTYDFHGAWRGTTGHHSPLFRGQEDASPDRFSNTDYAVGYMLRLGAPASKLVMGIPTFGRSFTLASSETGVGAPISGPGIPGRFTKEAGTLAYYEICDFLRGATVHRILGQQVPYATKGNQWVGYDDQESVKSKVQYLKDRQLAGAMVWALDLDDFQGSFCGQDLRFPLTNAIKDALAAT

SEQ ID NO: 5859 - protein, 390 aa, unidentified
MGATTMDQKSLWAGVVVLLLLQGGSAYKLVCYFTNWSQDRQEPGKFTPENIDPFLCSHLIYSFASIENNKVIIKDKSEVMLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKPLITGHNSPLSKGWQDRGPSSYYNVEYAVGYWIHKGMPSEKVVMGIPTYGHSFTLASAETTVGAPASGPGAAGPITESSGFLAYYEICQFLKGAKITRLQDQQVPYAVKGNQWVGYDDVKSMETKVQFLKNLNLGGAMIWSIDMDDFTGKSCNQGPYPLVQAVKRSLGSL

SEQ ID NO: 5860 - protein, 476 aa, unidentified [sequence omitted]

SEQ ID NO: 5861 - protein, 393 aa, unidentified
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVGLIHMLTHLAEALHQARLLALLVIPPAITPGTDQLGMFTHKEFEQLAPVLDGFSLMTYDYSTAHQPGPNAPLSWVRACVQVLDPKSKWRSKILLGLNFYGMDYATSKDAREPVVGARYIQTLKDHRPRMVWDSQASEHFFEYKKSRSGRHVVFYPTLKSLQVRLELARELGVGVSIWELGQGLDYFYDLL

SEQ ID NO: 5862 - protein, 466 aa, unidentified
MVRSVAWAGFMVLLMIPWGSAAKLVCYFTNWAQYRQGEARFLPKDLDPSLCTHLIYAFAGMTNHQLSTTEWNDETLYQEFNGLKKMNPKLKTLLAIGGWNFGTQKFTDMVATANNRQTFVNSAIRFLRKYSFDGLDLDWEYPGSQGSPAVDKERFTTLVQDLANAFQQEAQTSGKERLLLSAAVPAGQTYVDAGYEVDKIAQNLDFVNLMAYDFHGSWEKVTGHNSPLYKRQEESGAAASLNVDAAVQQWLQKGTPASKLILGMPTYGRSFTLASSSDTRVGAPATGSGTPGPFTKEGGMLAYYEVCSWKGATKQRIQDQKVPYIFRDNQWVGFDDVESFKTKVSYLKQKGLGGAMVWALDLDDFAGFSCNQGRYPLIQTLRQELSLPYLPSGTPELEVPKPGQPSEPEHGPSPGQDTFCQGKADGLYPNPRERSSFYSCAAGRLFQQSCPTGLVFSNSCKCCTWN

SEQ ID NO: 5863 - protein, 1208 aa, unidentified; identical to SEQ ID NO: 921

SEQ ID NO: 5864 - protein, 459 aa, unidentified
MALTLFDTDEYRPPVWKSYLYQLQQEAPHPRRITCTCEVENRPKYYGREFHGMISREAADQLLIVAEGSYLIRESQRQPGTYTLALRFGSQTRNFRLYYDGKHFVGEKRFESIHDLVTDGLITLYIETKAAEYIAKMTINPIYEHVGYTTLNREPAYKKHMPVLKETHDERDSTGQDGVSEKRLTSLVRRATLKENEQIPKYEKIHNFKVHTFRGPHWCEYCANFMWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITGALKLYFRDLPIPLITYDAYPKFIESAKIMDPDEQLETLHEALKLLPPAHCETLRYLMAHLKRVTLHEKENLMNAENLGIVFGPTLMRSPELDAMAALNDIRYQRLVVELLIKNEDILF

SEQ ID NO: 5865 - protein, 775 aa, unidentified
MRASLLLSVLRPAGPVAVGISLGFTLSLLSVTWVEEPCGPGPPQPGDSELPPRGNTNAARRPNSVQPGAEREKPGAGEGAGENWEPRVLPYHPAQPGQAAKKAVRTRYISTELGIRQRLLVAVLTSQTTLPTLGVAVNRTLGHRLERVVFLTGARGRRAPPGMAVVTLGEERPIGHLHLALRHLLEQHGDDFDWFFLVPDTTYTEAHGLARLTGHLSLASAAHLYLGRPQDFIGGEPTPGRYCHGGFGVLLSRMLLQQLRPHLEGCRNDIVSARPDEWLGRCILDATGVGCTGDHEGVHYSHLELSPGEPVQEGDPHFRSALTAHPVRDPVHMYQLHKAFARAELERTYQEIQELQWEIQNTSHLAVDGDQAAAWPVGIPAPSRPASRFEVLRWDYFTEQHAFSCADGSPRCPLRGADRADVADVLGTALEELNRRYHPALRLQKQQLVNGYRRFDPARGMEYTLDLQLEALTPQGGRRPLTRRVQLLRPLSRVEILPVPYVTEASRLTVLLPLAAAERDLAPGFLEAFATAALEPGDAAAALTLLLLYEPRQAQRVAHADVFAPVKAHVAELERRFPGARVPWLSVQTAAPSPLRLMDLLSKKHPLDTLFLLAGPDTVLTPDFLNRCRMHAISGWQAFFPMHFQAFHPAVAPPQGPGPPELGRDTGRFDRQAASEACFYNSDYVAARGRLAAASEQEEELLESLDVYELFLHFSSLHVLRAVEPALLQRYRAQTCSARLSEDLYHRCLQSVLEGLGSRTQLAMLLFEQEQGNST

SEQ ID NO: 5866 - protein, 772 aa, unidentified
MRLSSLLALLRPALPLILGLSLGCSLSLLRVSWIQGEGEDPCVEAVGERGGPQNPDSRARLDQSDEDFKPRIVPYYRDPNKPYKKVLRTRYIQTELGSRERLLVAVLTSRATLSTLAVAVNRTVAHHFPRLLYFTGQRGARAPAGMQVVSHGDERPAWLMSETLRHLHTHFGADYDWFFIMQDDTYVQAPRLAALAGHLSINQDLYLGRAEEFIGAGEQARYCHGGFGYLLSRSLLLRLRPHLDGCRGDILSARPDEWLGRCLIDSLGVGCVSQHQGQQYRSFELAKNRDPEKEGSSAFLSAFAVHPVSEGTLMYRLHKRFSALELERAYSEIEQLQAQIRNLTVLTPEGEAGLSWPVGLPAPFTPHSRFEVLGWDYFTEQHTFSCADGAPKCPLQGASRADVGDALETALEQLNRRYQPRLRFQKQRLLNGYRRFDPARGMEYTLDLLLECVTQRGHRRALARRVSLLRPLSRVEILPMPYVTEATRVQLVLPLLVAEAAAAPAFLEAFAANVLEPREHALLTLLLVYGPREGGRGAPDPFLGVKAAAAELERRYPGTRLAWLAVRAEAPSQVRLMDVVSKKHPVDTLFFLTTVWTRPGPEVLNRCRMNAISGWQAFFPVHFQEFNPALSPQRSPPGPPGAGPDPPSPPGADPSRGAPIGGRFDRQASAEGCFYNADYLAARARLAGELAGQEEEEALEGLEVMDVFLRFSGLHLFRAVEPGLVQKFSLRDCSPRLSEELYHRCRLSNLEGLGGRAQLAMALFEQEQANST

SEQ ID NO: 5867 - protein, 955 aa, unidentified
MPSLPAPPAPLLLLGLLLLGSRPARGAGPEPPVLPIRSEKEPLPVRGAAGCTFGGKVYALDETWHPDLGEPFGVMRCVLCACEAPQWGRRTRGPGRVSCKNIKPECPTPACGQPRQLPGHCCQTCPQERSSSERQPSGLSFEYPRDPEHRSYSDRGEPGAEERARGDGHTDFVALLTGPRSQAVARARVSLLRSSLRFSISYRRLDRPTRIRFSDSNGSVLFEHPAAPTQDGLVCGVWRAVPRLSLRLLRAEQLHVALVTLTHPSGEVWGPLIRHRALAAETFSAILTLEGPPQQGVGGITLLTLSDTEDSLHFLLLFRGLLEPRSGGLTQVPLRLQILHQGQLLRELQANVSAQEPGFAEVLPNLTVQEMDWLVLGELQMALEWAGRPGLRISGHIAARKSCDVLQSVLCGADALIPVQTGAAGSASLTLLGNGSLIYQVQVVGTSSEVVAMTLETKPQRRDQRTVLCHMAGLQPGGHTAVGICPGLGARGAHMLLQNELFLNVGTKDFPDGELRGHVAALPYCGHSARHDTLPVPLAGALVLPPVKSQAAGHAWLSLDTHCHLHYEVLLAGLGGSEQGTVTAHLLGPPGTPGPRRLLKGFYGSEAQGVVKDLEPELLRHLAKGMASLMITTKGSPRGELRGQVHIANQCEVGGLRLEAAGAEGVRALGAPDTASAAPPVVPGLPALAPAKPGGPGRPRDPNTCFFEGQQRPHGARWAPNYDPLCSLCTCQRRTVICDPVVCPPPSCPHPVQAPDQCCPVCPEKQDVRDLPGLPRSRDPGEGCYFDGDRSWRAAGTRWHPVVPPFGLIKCAVCTCKGGTGEVHCEKVQCPRLACAQPVRVNPTDCCKQCPVGSGAHPQLGDPMQADGPRGCRFAGQWFPESQSWHPSVPPFGEMSCITCRCGAGVPHCERDDCSLPLSCGSGKESRCCSRCTAHRRPAPETRTDPELEKEAEGS

SEQ ID NO: 5868 - protein, 456 aa, unidentified
MRKKWKMGGMKYIFSLLFFLLLEGGKTEQVKHSETYCMFQDKKYRVGERWHPYLEPYGLVYCVNCICSENGNVLCSRVRCPNVHCLSPVHIPHLCCPRCPDSLPPVNNKVTSKSCEYNGTTYQHGELFVAEGLFQNRQPNQCTQCSCSEGNVYCGLKTCPKLTCAFPVSVPDSCCRVCRGDGELSWEHSDGDIFRQPANREARHSYHRSHYDPPPSRQAGGLSRFPGARSHRGALMDSQQASGTIVQIVINNKHKHGQVCVSNGKTYSHGESWHPNLRAFGIVECVLCTCNVTKQECKKIHCPNRYPCKYPQKIDGKCCKVCPGKKAKELPGQSFDNKGYFCGEETMPVYESVFMEDGETTRKIALETERPPQVEVHVWTIRKGILQHFHIEKISKRMFEELPHFKLVTRTTLSQWKIFTEGEAQISQMCSSRVCRTELEDLVKVLYLERSEKGHC

SEQ ID NO: 5869 - protein, 429 aa, unidentified
MVPEVRVLSSLLGLALLWFPLDSHARARPDMFCLFHGKRYSPGESWHPYLEPQGLMYCLRCTCSEGAHVSCYRLHCPPVHCPQPVTEPQQCCPKCVEPHTPSGLRAPPKSCQHNGTMYQHGEIFSAHELFPSRLPNQCVLCSCTEGQIYCGLTTCPEPGCPAPLPLPDSCCQACKDEASEQSDEEDSVQSLHGVRHPQDPCSSDAGRKRGPGTPAPTGLSAPLSFIPRHFRPKGAGSTTVKIVLKEKHKKACVHGGKTYSHGEVWHPAFRAFGPLPCILCTCEDGRQDCQRVTCPTEYPCRHPEKVAGKCCKICPEDKADPGHSEISSTRCPKAPGRVLVHTSVSPSPDNLRRFALEHEASDLVEIYLWKLVKGIFHLTQIKKVRKQDFQKEAQHFRLLAGPHEGHWNVFLAQTLELKVTASPDKVTKT

SEQ ID NO: 5870 - protein, 529 aa, unidentified; identical to SEQ ID NO: 933

SEQ ID NO: 5871 - protein, 468 aa, unidentified; identical to SEQ ID NO: 936

SEQ ID NO: 5872 - protein, 501 aa, unidentified; identical to SEQ ID NO: 940

SEQ ID NO: 5873 - protein, 517 aa, unidentified; identical to SEQ ID NO: 944

SEQ ID NO: 5874 - protein, 411 aa, unidentified
MQCSWKAVLLLALASIAIQYTAIRTFTAKSFHTCPGLAEAGLAERLCEESPTFAYNLSRKTHILILATTRSGSSFVGQLFNQHLDVFYLFEPLYHVQNTLIPRFTQGKSPADRRVMLGASRDLLRSLYDCDLYFLENYIKPPPVNHTTDRIFRRGASRVLCSRPVCDPPGPADLVLEEGDCVRKCGLLNLTVAAEACRERSHVAIKTVRVPEVNDLRALVEDPRLNLKVIQLVRDPRGILASRSETFRDTYRLWRLWYGTGRKPYNLDVTQLTTVCEDFSNSVSTGLMRPPWLKGKYMLVRYEDLARNPMKKTEEIYGFLGIPLDSHVARWIQNNTRGDPTLGKHKYGTVRNSAATAEKWRFRLSYDIVAFAQNACQQVLAQLGYKIAASEEELKNPSVSLVEERDFRPFS

SEQ ID NO: 5875 - protein, 356 aa, unidentified; identical to SEQ ID NO: 947

SEQ ID NO: 5876 - protein, 352 aa, unidentified
MKPALLEVMRMNRICRMVLATCLGSFILVIFYFQSMLHPVMRRNPFGVDICCRKGSRSPLQELYNPIQLELSNTAVLHQMRRDQVTDTCRANSATSRKRRVLTPNDLKHLVVDEDHELIYCYVPKVACTNWKRLMMVLTGRGKYSDPMEIPANEAHVSANLKTLNQYSIPEINHRLKSYMKFLFVREPFERLVSAYRNKFTQKYNISFHKRYGTKIIKRQRKNATQEALRKGDDVKFEEFVAYLIDPHTQREEPFNEHWQTVYSLCHPCHIHYDLVGKYETLEEDSNYVLQLAGVGSYLKFPTYAKSTRTTDEMTTEFFQNISSEHQTQLYEVYKLDFLMFNYSVPSYLKLE

SEQ ID NO: 5877 - protein, 341 aa, unidentified
MGRRCCRRRVLAAACLGAALLLLCAAPRSLRPAFGNRALGSSWLGGEKRSPLQKLYDLDQDPRSTLAKVHRQRRDLLNSACSRHSRRQRLLQPEDLRHVLVDDAHGLLYCYVPKVACTNWKRVLLALSGQARGDPRAISAQEAHAPGRLPSLADFSPAEINRRLRAYLAFLFVREPFERLASAYRNKLARPYSAAFQRRYGARIVQRLRPRALPDARARGHDVRFAEFLAYLLDPRTRREEPFNEHWERAHALCHPCRLRYDVVGKFETLAEDAAFVLGLAGASDLSFPGPPRPRGAAASRDLAARLFRDISPFYQRRLFDLYKMDFLLFNYSAPSYLRLL

SEQ ID NO: 5878 - protein, 386 aa, unidentified
MLLPKKMKLLLFLVSQMAILALFFHMYSHNISSLSMKAQPERMHVLVLSSWRSGSSFVGQLFGQHPDVFYLMEPAWHVWMTFKQSTAWMLHMAVRDLIRAVFLCDMSVFDAYMEPGPRRQSSLFQWENSRALCSAPACDIIPQDEIIPRAHCRLLCSQQPFEVVEKACRSYSHVVLKEVRFFNLQSLYPLLKDPSLNLHIVHLVRDPRAVFRSRERTKGDLMIDSRIVMGQHEQKLKKEDQPYYVMQVICQSQLEIYKTIQSLPKALQERYLLVRYEDLARAPVAQTSRMYEFVGLEFLPHLQTWVHNITRGKGMGDHAFHTNARDALNVSQAWRWSLPYEKVSRLQKACGDAMNLLGYRHVRSEQEQRNLLLDLLSTWTVPEQIH

SEQ ID NO: 5879 - protein, 411 aa, unidentified; identical to SEQ ID NO: 953

SEQ ID NO: 5880 - protein, 395 aa, unidentified
MWLPRVSSTAVTALLLAQTFLLLFLVSRPGPSSPAGGEARVHVLVLSSWRSGSSFVGQLFNQHPDVFYLMEPAWHVWTTLSQGSAATLHMAVRDLVRSVFLCDMDVFDAYLPWRRNLSDLFQWAVSRALCSPPACSAFPRGAISSEAVCKPLCARQSFTLAREACRSYSHVVLKEVRFFNLQVLYPLLSDPALNLRIVHLVRDPRAVLRSREQTAKALARDNGIVLGTNGTWVEADPGLRVVREVCRSHVRIAEAATLKPPPFLRGRYRLVRFEDLAREPLAEIRALYAFTGLSLTPQLEAWIHNITHGSGPGARREAFKTSSRNALNVSQAWRHALPFAKIRRVQELCAGALQLLGYRPVYSEDEQRNLALDLVLPRGLNGFTWASSTASHPRN

SEQ ID NO: 5881 - protein, 486 aa, unidentified
MKGRRRRRREYCKFALLLVLYTLVLLLVPSVLDGGRDGDKGAEHCPGLQRSLGVWSLEAAAAGEREQGAEARAAEEGGANQSPRFPSNLSGAVGEAVSREKQHIYVHATWRTGSSFLGELFNQHPDVFYLYEPMWHLWQALYPGDAESLQGALRDMLRSLFRCDFSVLRLYAPPGDPAARAPDTANLTTAALFRWRTNKVICSPPLCPGAPRARAEVGLVEDTACERSCPPVAIRALEAECRKYPVVVIKDVRLLDLGVLVPLLRDPGLNLKVVQLFRDPRAVHNSRLKSRQGLLRESIQVLRTRQRGDRFHRVLLAHGVGARPGGQSRALPAAPRADFFLTGALEVICEAWLRDLLFARGAPAWLRRRYLRLRYEDLVRQPRAQLRRLLRFSGLRALAALDAFALNMTRGAAYGADRPFHLSARDAREAVHAWRERLSREQVRQVEAACAPAMRLLAYPRSGEEGDAEQPREGETPLEMDADGAT

SEQ ID NO: 5882 - protein, 424 aa, unidentified
MTLRPGTMRLACMFSSILLFGAAGLLLFISLQDPTELAPQQVPGIKFNIRPRQPHHDLPPGGSQDGDLKEPTERVTRDLSSGAPRGRNLPAPDQPQPPLQRGTRLRLRQRRRRLLIKKMPAAATIPANSSDAPFIRPGPGTLDGRWVSLHRSQQERKRVMQEACAKYRASSSRRAVTPRHVSRIFVEDRHRVLYCEVPKAGCSNWKRVLMVLAGLASSTADIQHNTVHYGSALKRLDTFDRQGILHRLSTYTKMLFVREPFERLVSAFRDKFEHPNSYYHPVFGKAILARYRANASREALRTGSGVRFPEFVQYLLDVHRPVGMDIHWDHVSRLCSPCLIDYDFVGKFESMEDDANFFLSLIRAPRNLTFPRFKDRHSQEARTTARIAHQYFAQLSALQRQRTYDFYYMDYLMFNYSKPFADLY

SEQ ID NO: 5883 - protein, 802 aa, unidentified
MAARGRRAWLSVLLGLVLGFVLASRLVLPRASELKRAGPRRRASPEGCRSGQAAASQAGGARGDARGAQLWPPGSDPDGGPRDRNFLFVGVMTAQKYLQTRAVAAYRTWSKTIPGKVQFFSSEGSDTSVPIPVVPLRGVDDSYPPQKKSFMMLKYMHDHYLDKYEWFMRADDDVYIKGDRLENFLRSLNSSEPLFLGQTGLGTTEEMGKLALEPGENFCMGGPGVIMSREVLRRMVPHIGKCLREMYTTHEDVEVGRCVRRFAGVQCVWSYEMQQLFYENYEQNKKGYIRDLHNSKIHQAITLHPNKNPPYQYRLHSYMLSRKISELRHRTIQLHREIVLMSKYSNTEIHKEDLQLGIPPSFMRFQPRQREEILEWEFLTGKYLYSAVDGQPPRRGMDSAQREALDDIVMQVMEMINANAKTRGRIIDFKEIQYGYRRVNPMYGAEYILDLLLLYKKHKGKKMTVPVRRHAYLQQTFSKIQFVEHEELDAQELAKRINQESGSLSFLSNSLKKLVPFQLPGSKSEHKEPKDKKINILIPLSGRFDMFVRFMGNFEKTCLIPNQNVKLVVLLFNSDSNPDKAKQVELMRDYRIKYPKADMQILPVSGEFSRALALEVGSSQFNNESLLFFCDVDLVFTTEFLQRCRANTVLGQQIYFPIIFSQYDPKIVYSGKVPSDNHFAFTQKTGFWRNYGFGITCIYKGDLVRVGGFDVSIQGWGLEDVDLFNKVVQAGLKTFRSQEVGVVHVHHPVFCDPNLDPKQYKMCLGSKASTYGSTQQLAEMWLEKNDPSYSKSSNNNGSVRTA

SEQ ID NO: 5884 - protein, 882 aa, unidentified
MAVRSRRPWMSVALGLVLGFTAASWLIAPRVAELSERKRRGSSLCSYYGRSAAGPRAGAQQPLPQPQSRPRQEQSPPPARQDLQGPPLPEAAPGITSFRSSPWQQPPPLQQRRRGREPEGATGLPGAPAAEGEPEEEDGGAAGQRRDGRPGSSHNGSGDGGAAAPSARPRDFLYVGVMTAQKYLGSRALAAQRTWARFIPGRVEFFSSQQPPNAGQPPPPLPVIALPGVDDSYPPQKKSFMMIKYMHDHYLDKYEWFMRADDDVYIKGDKLEEFLRSLNSSKPLYLGQTGLGNIEELGKLGLEPGENFCMGGPGMIFSREVLRRMVPHIGECLREMYTTHEDVEVGRCVRRFGGTQCVWSYEMQQLFHENYEHNRKGYIQDLHNSKIHAAITLHPNKRPAYQYRLHNYMLSRKISELRYRTIQLHRESALMSKLSNTEVSKEDQQLGVIPSFNHFQPRERNEVIEWEFLTGKLLYSAAENQPPRQSLSSILRTALDDTVLQVMEMINENAKSRGRLIDFKEIQYGYRRVNPMHGVEYILDLLLLYKRHKGRKLTVPVRRHAYLQQLFSKPFFRETEELDVNSLVESINSETQSFSFISNSLKILSSFQGAKEMGGHNEKKVHILVPLIGRYDIFLRFMENFENMCLIPKQNVKLVIILFSRDSGQDSSKHIELIKGYQNKYPKAEMTLIPMKGEFSRGLGLEMASAQFDNDTLLLFCDVDLIFREDFLQRCRDNTIQGQQVYYPIIFSQYDPKVTNGGNPPTDDYFIFSKKTGFWRDYGYGITCIYKSDLLGAGGFDTSIQGWGLEDVDLYNKVILSGLRPFRSQEVGVVHIFHPVHCDPNLDPKQYKMCLGSKASTFASTMQLAELWLEKHLGVRYNRTLS

SEQ ID NO: 5885 - protein, 121 aa, unidentified
MVQIVISSARAGGLAEWVLMELQGEIEARYSTGLAGNLLGDLHYTTEGIPVLIVGHHILYGKIIHLEKPFAVLVKHTPGDQDCDELGRETGTRYLVTALIKDKILFKTRPKPIITSVPKKV

SEQ ID NO: 5886 - protein, 1184 aa, unidentified
MVGTKAWVFSFLVLEVTSVLGRQTMLTQSVRRVQPGKKNPSIFAKPADTLESPGEWTTWFNIDYPGGKGDYERLDAIRFYYGDRVCARPLRLEARTTDWTPAGSTGQVVHGSPREGFWCLNREQRPGQNCSNYTVRFLCPPGSLRRDTERIWSPWSPWSKCSAACGQTGVQTRTRICLAEMVSLCSEASEEGQHCMGQDCTACDLTCPMGQVNADCDACMCQDFMLHGAVSLPGGAPASGAAIYLLTKTPKLLTQTDSDGRFRIPGLCPDGKSILKITKVKFAPIVLTMPKTSLKAATIKAEFVRAETPYMVMNPETKARRAGQSVSLCCKATGKPRPDKYFWYHNDTLLDPSLYKHESKLVLRKLQQHQAGEYFCKAQSDAGAVKSKVAQLIVIASDETPCNPVPESYLIRLPHDCFQNATNSFYYDVGRCPVKTCAGQQDNGIRCRDAVQNCCGISKTEEREIQCSGYTLPTKVAKECSCQRCTETRSIVRGRVSAADNGEPMRFGHVYMGNSRVSMTGYKGTFTLHVPQDTERLVLTFVDRLQKFVNTTKVLPFNKKGSAVFHEIKMLRRKKPITLEAMETNIIPLGEVVGEDPMAELEIPSRSFYRQNGEPYIGKVKASVTFLDPRNISTATAAQTDLNFINDEGDTFPLRTYGMFSVDFRDEVTSEPLNAGKVKVHLDSTQVKMPEHISTVKLWSLNPDTGLWEEEGDFKFENQRRNKREDRTFLVGNLEIRERRLFNLDVPESRRCFVKVRAYRSERFLPSEQIQGVVISVINLEPRTGFLSNPRAWGRFDSVITGPNGACVPAFCDDQSPDAYSAYVLASLAGEELQAVESSPKFNPNAIGVPQPYLNKLNYRRTDHEDPRVKKTAFQISMAKPRPNSAEESNGPIYAFENLRACEEAPPSAAHFRFYQIEGDRYDYNTVPFNEDDPMSWTEDYLAWWPKPMEFRACYIKVKIVGPLEVNVRSRNMGGTHRQTVGKLYGIRDVRSTRDRDQPNVSAACLEFKCSGMLYDQDRVDRTLVKVIPQGSCRRASVNPMLHEYLVNHLPLAVNNDTSEYTMLAPLDPLGHNYGIYTVTDQDPRTAKEIALGRCFDGTSDGSSRIMKSNVGVALTFNCVERQVGRQSAFQYLQSTPAQSPAAGTVQGRVPSRRQQRASRGGQRQGGVVASLRFPRVAQQPLIN

SEQ ID NO: 5887 - protein, 1162 aa, unidentified
MASLLPLLCLCVVAAHLAGARDATPTEEPMATALGLERRSVYTGQPSPALEDWEARAVPAEASEWTSWFNVDHPGGDGDFESLAAIRFYYGPARVCPRPLALEARTTDWALPSAVGERVHLNPTRGFWCLNREQPRGRRCSNYHVRFRCPLEASWGAWGPWGPCSGSCGPGRRLRRRHCPSPAGDACPGRPLEAQKCVRPRCPGCSLDTCECPDHILLGSVVTPSGQPLLGARVSLRDQPGTVATSDAHGTFRVPGVCADSRANIRAQMDGFSAGEAQAQANGSISVVTIILDKLEKPYLVKHPESRVREAGQNVTFCCKASGTPMPKKYSWFHNGTLLDRRAHGYGAHLELRGLRPDQAGIYHCKAWNEAGAVRSGTARLTVLAPGQPACDPRPREYLIKLPEDCGQPGSGPAYLDVGLCPDTRCPSLAGSSPRCGDASSRCCSVRRLERREIHCPGYVLPVKVVAECGCQKCLPPRGLVRGRVVAADSGEPLRFARILLGQEPIGFTAYQGDFTIEVPPSTQRLVVTFVDPSGEFMDAVRVLPFDPRGAGVYHEVKAMRKKAPVILHTSQSNTIPLGELEDEAPLGELVLPSGAFRRADGKPYSGPVEARVTFVDPRDLTSAASAPSDLRFVDSDGELAPLRTYGMFSVDLRAPGSAEQLQVGPVAVRVAASQIHMPGHVEALKLWSLNPETGLWEEESGFRREGSSGPRVRREERVFLVGNVEIRERRLFNLDVPERRRCFVKVRAYANDKFTPSEQVEGVVVTLVNLEPAPGFSANPRAWGRFDSAVTGPNGACLPAFCDADRPDAYTALVTATLGGEELEPAPSLPRPLPATVGVTQPYLDRLGYRRTDHDDPAFKRNGFRINLAKPRPGDPAEANGPVYPWRSLRECQGAPVTASHFRFARVEADKYEYNVVPFREGTPASWTGDLLAWWPNPQEFRACFLKVKIQGPQEYMVRSHNAGGSHPRTRGQLYGLRDARSVRDPERPGTSAACVEFKCSGMLFDQRQVDRTLVTIMPQGSCRRVAVNGLLRDYLTRHPPPVPAEDPAAFSMLAPLDPLGHNYGVYTVTDQSPRLAKEIAIGRCFDGSSDGFSREMKADAGTAVTFQCREPPAGRPSLFQRLLESPATALGDIRREMSEAAQAQARASGPLRTRRGRVRQ

SEQ ID NO: 5888 - protein, 152 aa, unidentified; identical to SEQ ID NO: 958

SEQ ID NO: 5889 - protein, 417 aa, unidentified
MAGPFSRLLSARPGLRLLALAGAGSLAAGFLLRPEPVRAASERRRLYPPSAEYPDLRKHNNCMASHLTPAVYARLCDKTTPTGWTLDQCIQTGVDNPGHPFIKTVGMVAGDEETYEVFADLFDPVIQERHNGYDPRTMKHTTDLDASKIRSGYFDERYVLSSRVRTGRSIRGLSLPPACTRAERREVERVVVDALSGLKGDLAGRYYRLSEMTEAEQQQLIDDHFLFDKPVSPLLTAAGMARDWPDARGIWHNNEKSFLIWVNEEDHTRVISMEKGGNMKRVFERFCRGLKEVERLIQERGWEFMWNERLGYILTCPSNLGTGLRAGVHIKLPLLSKDSRFPKILENLRLQKRGTGGVDTAATGGVFDISNLDRLGKSEVELVQLVIDGVNYLIDCERRLERGQDIRIPTPVIHTKH

SEQ ID NO: 5890 - protein, 417 aa, unidentified; identical to SEQ ID NO: 5889

SEQ ID NO: 5891 - protein, 914 aa, unidentified
MGPFKSSVFILILHLLEGALSNSLIQLNNNGYEGIVVAIDPNVPEDETLIQQIKDMVTQASLYLLEATGKRFYFKNVAILIPETWKTKADYVRPKLETYKNADVLVAESTPPGNDEPYTEQMGNCGEKGERIHLTPDFIAGKKLAEYGPQGRAFVHEWAHLRWGVFDEYNNDEKFYLSNGRIQAVRCSAGITGTNVVKKCQGGSCYTKRCTFNKVTGLYEKGCEFVLQSRQTEKASIMFAQHVDSIVEFCTEQNHNKEAPNKQNQKCNLRSTWEVIRDSEDFKKTTPMTTQPPNPTFSLLQIGQRIVCLVLDKSGSMATGNRLNRLNQAGQLFLLQTVELGSWVGMVTFDSAAHVQNELIQINSGSDRDTLAKRLPAAASGGTSICSGLRSAFTVIRKKYPTDGSEIVLLTDGEDNTISGCFNEVKQSGAIIHTVALGPSAAQELEELSKMTGGLQTYASDQVQNNGLIDAFGALSSGNGAVSQRSIQLESKGLTLQNSQWMNGTVIVDSTVGKDTLFLITWTMQPPQILLWDPSGQKQGGFVVDKNTKMAYLQIPGIAKVGTWKYSLQASSQTLTLTVTSRASNATLPPITVTSKTNKDTSKFPSPLVVYANIRQGASPILRASVTALIESVNGKTVTLELLDNGAGADATKDDGVYSRYFTTYDTNGRYSVKVRALGGVNAARRRVIPQQSGALYIPGWIENDEIQWNPPRPEINKDDVQHKQVCFSRTSSGGSFVASDVPNAPIPDLFPPGQITDLKAEIHGGSLINLTWTAPGDDYDHGTAHKYIIRISTSILDLRDKFNESLQVNTTALIPKEANSEEVFLFKPENITFENGTDLFIAIQAVDKVDLKSEISNIARVSLFIPPQTPPETPSPDETSAPCPNIHINSTIPGIHILKIMWKWIGELQLSIA

SEQ ID NO: 5892 - protein, 225 aa, unidentified
MDLRAGDSWGMLACLCTVLWHLPAVPALNRTGDPGPGPSIQKTYDLTRYLEHQLRSLAGTYLNYLGPPFNEPDFNPPRLGAETLPRATVDLEVWRSLNDKLRLTQNYEAYSHLLCYLRGLNRQAATAELRRSLAHFCTSLQGLLGSIAGVMAALGYPLPQPLPGTEPTWTPGPAHSDFLQKMDDFWLLKELQTWLWRSAKDFNRLKKKMQPPAAAVTLHLGAHGF

SEQ ID NO: 5893 - protein, 228 aa, unidentified; identical to SEQ ID NO: 977

SEQ ID NO: 5894 - protein, 211 aa, unidentified; identical to SEQ ID NO: 992

SEQ ID NO: 5895 - protein, 253 aa, unidentified; identical to SEQ ID NO: 995

SEQ ID NO: 5896 - protein, 323 aa, unidentified
MQAAWLLGALVVPQLLGFGHGARGAEREWEGGWGGAQEEEREREALMLKHLQEALGLPAGRGDENPAGTVEGKEDWEMEEDQGEEEEEEATPTPSSGPSPSPTPEDIVTYILGRLAGLDAGLHQLHVRLHALDTRVVELTQGLRQLRNAAGDTRDAVQALQEAQGRAEREHGRLEGCLKGLRLGHKCFLLSRDFEAQAAAQARCTARGGSLAQPADRQQMEALTRYLRAALAPYNWPVWLGVHDRRAEGLYLFENGQRVSFFAWHRSPRPELGAQPSASPHPLSPDQPNGGTLENCVAQASDDGSWWDHDCQRRLYYVCEFPF

SEQ ID NO: 5897 - protein, 1053 aa, unidentified
MFGRSRSWVGGGHGKTSRNIHSLDHLKYLYHVLTKNTTVTEQNRNLLVETIRSITEILIWGDQNDSSVFDFFLEKNMFVFFLNILRQKSGRYVCVQLLQTLNILFENISHETSLYYLLSNNYVNSIIVHKFDFSDEEIMAYYISFLKTLSLKLNNHTVHFFYNEHTNDFALYTEAIKFFNHPESMVRIAVRTITLNVYKVSLDNQAMLHYIRDKTAVPYFSNLVWFIGSHVIELDDCVQTDEEHRNRGKLSDLVAEHLDHLHYLNDILIINCEFLNDVLTDHLLNRLFLPLYVYSLENQDKGGERPKISLPVSLYLLSQVFLIIHHAPLVNSLAEVILNGDLSEMYAKTEQDIQRSSAKPSIRCFIKPTETLERSLEMNKHKGKRRVQKRPNYKNVGEEEDEEKGPTEDAQEDAEKAKGTEGGSKGIKTSGESEEIEMVIMERSKLSELAASTSVQEQNTTDEEKSAAATCSESTQWSRPFLDMVYHALDSPDDDYHALFVLCLLYAMSHNKGMDPEKLERIQLPVPNAAEKTTYNHPLAERLIRIMNNAAQPDGKIRLATLELSCLLLKQQVLMSAGCIMKDVHLACLEGAREESVHLVRHFYKGEDIFLDMFEDEYRSMTMKPMNVEYLMMDASILLPPTGTPLTGIDFVKRLPCGDVEKTRRAIRVFFMLRSLSLQLRGEPETQLPLTREEDLIKTDDVLDLNNSDLIACTVITKDGGMVQRFLAVDIYQMSLVEPDVSRLGWGVVKFAGLLQDMQVTGVEDDSRALNITIHKPASSPHSKPFPILQATFIFSDHIRCIIAKQRLAKGRIQARRMKMQRIAALLDLPIQPTTEVLGFGLGSSTSTQHLPFRFYDQGRRGSSDPTVQRSVFASVDKVPGFAVAQCINQHSSPSLSSQSPPSASGSPSGSGSTSHCDSGGTSSSSTPSTAQSPADAPMSPELPKPHLPDQLVIVNETEADSKPSKNVARSAAVETASLSPSLVPARQPTISLLCEDTADTLSVESLTLVPPVDPHSLRSLTGMPPLSTPAAACTEPVGEEAACAEPVGTAED

SEQ ID NO: 5898 - protein, 446 aa, unidentified
MLHPETSPGRGHLLAVLLALLGTAWAEVWPPQLQEQAPMAGALNRKESFLLLSLHNRLRSWVQPPAADMRRLDWSDSLAQLAQARAALCGTPTPSLASGLWRTLQVGWNMQLLPAGLVSFVEVVSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCSLQCVHGRFREEECSCVCDIGYGGAQCATKVHFPFHTCDLRIDGDCFMVSSEADTYYRARMKCQRKGGVLAQIKSQKVQDILAFYLGRLETTNEVIDSDFETRNFWIGLTYKTAKDSFRWATGEHQAFTSFAFGQPDNHGFGNCVELQASAAFNWNDQRCKTRNRYICQFAQEHISRWGPGS

SEQ ID NO: 5899 - protein, 455 aa, unidentified
MLHPETSPGRGHLLAVLLALLGTTWAEVWPPQLQEQAPMAGALNRKESFLLLSLHNRLRSWVQPPAADMRRLDWSDSLAQLAQARAALCGIPTPSLASGLWRTLQVGWNMQLLPAGLASFVEVVSLWFAEGQRYSHAAGECARNATCTHYTQLVWATSSQLGCGRHLCSAGQTAIEAFVCAYSPGGNWEVNGKTIIPYKKGAWCSLCTASVSGCFKAWDHAGGLCEVPRNPCRMSCQNHGRLNISTCHCHCPPGYTGRYCQVRCSLQCVHGRFREEECSCVCDIGYGGAQCATKVHFPFHTCDLRIDGDCFMVSSEADTYYRARMKCQRKGGVLAQIKSQKVQDILAFYLGRLETTNEVIDSDFETRNFWIGLTYKTAKDSFRWATGEHQAFTSFAFGQPDNHGLVWLSAAMGFGNCVELQASAAFNWNDQRCKTRNRYICQFAQEHISRWGPGS

SEQ ID NO: 5900 - protein, 446 aa, unidentified
MLHPETSPGRGHLLAVLLALLGTAWAEVWPPQLQEQAPMAGALNRKESFLLLSLHNRLRSWVQPPAADMRRLDWSDSLAQLAQARAALCGIPTPSLASGLWRTLQVGWNMQLLPAGLASFVEVVSLWFAEGQRYSHAAGECARNATCTHYTQLVWATSSQLGCGRHLCSAGQAAIEAFVCAYSPRGNWEVNGKTIVPYKKGAWCSLCTASVSGCFKAWDHAGGLCEVPRNPCRMSCQNHGRLNISTCHCHCPPGYTGRYCQVRCSLQCVHGRFREEECSCVCDIGYGGAQCATKVHFPFHTCDLRIDGDCFMVSSEADTYYRARMKCQRKGGVLAQIKSQKVQDILAFYLGRLETTNEVIDSDFETRNFWIGLTYKTAKDSFRWATGEHQAFTSFAFGQPDNHGFGNCVELQASAAFNWNNQRCKTRNRYICQFAQEHISRWGPGS

SEQ ID NO: 5901 - protein, 149 aa, unidentified
MMTKHKKCFIIVGVLITTNIITLIVKLTRDSQSLCPYDWIGFQNKCYYFSKEEGDWNSSKYNCSTQHADLTIIDNIEEMNFLRRYKCSSDHWIGLKMAKNRTGQWVDGATFTKSFGMRGSEGCAYLSDDGAATARCYTERKWICRKRIH

SEQ ID NO: 5902 - protein, 197 aa, unidentified
MAKNGLVICILVITLLLDQTTSHTSRLKARKHSKRRVRDKDGDLKTQIEKLWTEVNALKEIQALQTVCLRGTKVHKKCYLASEGLKHFHEANEDCISKGGILVIPRNSDEINALQDYGKRSLPGVNDFWLGINDMVTEGKFVDVNGIAISFLNWDRAQPNGGKRENCVLFSQSAQGKWSDEACRSSKRYICEFTIPQ

SEQ ID NO: 5903 - protein, 202 aa, unidentified
MELWGAYLLLCLFSLLTQVTTEPPTQKPKKIVNAKKDVVNTKMFEELKSRLDTLAQEVALLKEQQALQTVCLKGTKVHMKCFLAFTQTKTFHEASEDCISRGGTLGTPQTGSENDALYEYLRQSVGNEAEIWLGLNDMAAEGTWVDMTGARIAYKNWETEITAQPDGGKTENCAVLSGAANGKWFDKRCRDQLPYICQFGIV

SEQ ID NO: 5904 - protein, 610 aa, unidentified; identical to SEQ ID NO: 1018

SEQ ID NO: 5905 - protein, 358 aa, unidentified; identical to SEQ ID NO: 1024

SEQ ID NO: 5906 - protein, 112 aa, unidentified
MEKILILLLVALSVAYAAPGPRGIIINLENGELCMNSAQCKSNCCQHSSALGLARCTSMASENSECSVKTLYGIYYKCPCERGLTCEGDKTIVGSITNTNFGICHDAGRSKQ

SEQ ID NO: 5907 - protein, 121 aa, unidentified
MMLPQWLLLLFLLFFFLFLLTRGSLSPTKYNLLELKESCIRNQDCETGCCQRAPDNCESHCAEKGSEGSLCQTQVFFGQYRACPCLRNLTCIYSKNEKWLSIAYGRCQKIGRQKLAKKMFF

SEQ ID NO: 5908 - protein, 100 aa, unidentified
MAAALALVAGVLSGAVLPLWSALPQYKKKITDRCFHHSECYSGCCLMDLDSGGAFCAPRARITMICLPQTKGATNIICPCRMGLTCISKDLMCSRRCHMI

SEQ ID NO: 5909 - protein, 633 aa, unidentified
MPSCGACTCGAAAVRLITSSLASAQRGISGGRIHMSVLGRLGTFETQILQRAPLRSFTETPAYFASKDGISKDGSGDGNKKSASEGSSKKSGSGNSGKGGNQLRCPKCGDLCTHVETFVSSTRFVKCEKCHHFFVVLSEADSKKSIIKEPESAAEAVKLAFQQKPPPPPKKIYNYLDKYVVGQSFAKKVLSVAVYNHYKRIYNNIPANLRQQAEVEKQTSLTPRELEIRRREDEYRFTKLLQIAGISPHGNALGASMQQQVNQQIPQEKRGGEVLDSSHDDIKLEKSNILLLGPTGSGKTLLAQTLAKCLDVPFAICDCTTLTQAGYVGEDIESVIAKLLQDANYNVEKAQQGIVFLDEVDKIGSVPGIHQLRDVGGEGVQQGLLKLLEGTIVNVPEKNSRKLRGETVQVDTTNILFVASGAFNGLDRIISRRKNEKYLGFGTPSNLGKGRRAAAAADLANRSGESNTHQDIEEKDRLLRHVEARDLIEFGMIPEFVGRLPVVVPLHSLDEKTLVQILTEPRNAVIPQYQALFSMDKCELNVTEDALKAIARLALERKTGARGLRSIMEKLLLEPMFEVPNSDIVCVEVDKEVVEGKKEPGYIRAPTKESSEEEYDSGVEEEGWPRQADAANS

SEQ ID NO: 5910 - protein, 956 aa, unidentified; identical to SEQ ID NO: 1033

SEQ ID NO: 5911 - protein, 449 aa, unidentified
MMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVCRSGSGLVGRQLEEFLNQSSPFYFWMNGDRIDSLLENDRQQTHMLDVMQDHFSRASSIIDELFQDRFFTREPQDTYHYLPFSLPHRRPHFFFPKSRIVRSLMPFSPYEPLNFHAMFQPFLEMIHEAQQAMDIHFHSPAFQHPPTEFIREGDDDRTVCREIRHNSTGCLRMKDQCDKCREILSVDCSTNNPSQAKLRRELDESLQVAERLTRKYNELLKSYQWKMLNTSSLLEQLNEQFNWVSRLANLTQGEDQYYLRVTTVASHTSDSDVPSGVTEVVVKLFDSDPITVTVPVEVSRKNPKFMETVAEKALQEYRKKHREE

SEQ ID NO: 5912 - protein, 466 aa, unidentified
MKPPLLVFIVCLLWLKDSHCAPTWKDKTAISENLKSFSEVGEIDADEEVKKALTGIKQMKIMMERKEKEHTNLMSTLKKCREEKQEALKLLNEVQEHLEEEERLCRESLADSWGECRSCLENNCMRIYTTCQPSWSSVKNKIERFFRKIYQFLFPFHEDNEKDLPISEKLIEEDAQLTQMEDVFSQLTVDVNSLFNRSFNVFRQMQQEFDQTFQSHFISDTDLTEPYFFPAFSKEPMTKADLEQCWDIPNFFQLFCNFSVSIYESVSETITKMLKAIEDLPKQDKAPDHGGLISKMLPGQDRGLCGELDQNLSRCFKFHEKCQKCQAHLSEDCPDVPALHTELDEAIRLVNVSNQQYGQILQMTRKHLEDTAYLVEKMRGQFGWVSELANQAPETEIIFNSIQVVPRIHEGNISKQDETMMTDLSILPSSNFTLKIPLEESAESSNFIGYVVAKALQHFKEHFKTW

SEQ ID NO: 5913 - protein, 247 aa, unidentified
MLLLPLPLLLFLLCSRAEAGEIIGGTECKPHSRPYMAYLEIVTSNGPSKFCGGFLIRRNFVLTAAHCAGRSITVTLGAHNITEEEDTWQKLEVIKQFRHPKYNTSTLHHDIMLLKLKEKASLTLAVGTLPFPSQFNFVPPGRMCRVAGWGRTGVLKPGSDTLQEVKLRLMDPQACSHFRDFDHNLQLCVGNPRKTKSAFKGDSGGPLLCAGVAQGIVSYGRSDAKPPAVFTRISHYRPWINQILQAN

SEQ ID NO: 5914 - protein, 196 aa, unidentified [sequence omitted]

SEQ ID NO: 5915 - protein, 436 aa, unidentified
MPMSSLPAAILSHMTAINNVPPPPLHSIPNLKKSKHINYGQLNALCHIRGQHSRSMSNILSAHDTFMKQYPKVFLHQKPRLPKLFKQEEQRELNEGKEESQHQQPDDSNNIAVHVQRAHGGHILYRPKRATEKFEEFLAILKKLPIHRTPYEHKTVWKFLKTIPDLTFQLNDKHLKTLSKTVFSETWLKGSTVVANDGFYVILKGLARPQTNVYKNLIEGSDSPDSFISQSFHSFIWSEEFKNSTLAEMYLPSYDSMLSKWSTFGTLEVMPQNESETQMFSVVTEDDCEILKIPAKGYAKIKEEKIKLENMQKLKLIRMCPYYEEWPTLSIYELIALLKWKKFPPGHVIVESGNIISFVGYINSGCCNIYRSIIGFVKLRSNKVKRSQKLVYMGKLKEKESFGEISVLLQVPFTCTIITKKEVEMAIIEDKDLFVA

SEQ ID NO: 5916 - protein, 507 aa, unidentified
MDPKLGRMAASLLAVLLLLLERGMFSSPSPPPALLEKVFQYIDLHQDEFVQTLKEWVAIESDSVQPVPRFRQELFRMMAVAADTLQRLGARVASVDMGPQQLPDGQSLPIPPIILAELGSDPTKGTVCFYGHLDVQPADRGDGWLTDPYVLTEVDGKLYGRGATDNKGPVLAWINAVSAFRALEQDLPVNIKFIIEGMEEAGSVALEELVEKEKDRFFSGVDYIVISDNLWISQRKPAITYGTRGNSYFMVEVKCRDQDFHSGTFGGILHEPMADLVALLGSLVDSSGHILVPGIYDEVVPLTEEEINTYKAIHLDLEEYRNSSRVEKFLFDTKEEILMHLWRYPSLSIHGIEGAFDEPGTKTVIPGRVIGKFSIRLVPHMNVSAVEKQVTRHLEDVFSKRNSSNKMVVSMTLGLHPWIANIDDTQYLAAKRAIRTVFGTEPDMIRDGSTIPIAKMFQEIVHKSVVLIPLGAVDDGEHSQNEKINRWNYIEGTKLFAAFFLEMAQLH

SEQ ID NO: 5917 - protein, 299 aa, unidentified
MHSLATAAPVPTTLAQVDREKIYQWINELSSPETRENALLELSKKRESVPDLAPMLWHSFGTIAALLQEIVNIYPSINPPTLTAHQSNRVCNALALLQCVASHPETRSAFLAAHIPLFLYPFLHTVSKTRPFEYLRLTSLGVIGALVKTDEQEVINFLLTTEIIPLCLRIMESGSELSKTVATFILQKILLDDTGLAYICQTYERFSHVAMILGKMVLQLSKEPSARLLKHVVRCYLRLSDNPRAREALRQCLPDQLKDTTFAQVLKDDTTTKRWLAQLVKNLQEGQVTDPRGIPLPPQ

SEQ ID NO: 5918 - protein, 182 aa, unidentified
MKGWGWLALLLGALLGTAWARRSQDLHCGACRALVDELEWEIAQVDPKKTIQMGSFRINPDGSQSVVEVPYARSEAHLTELLEEICDRMKEYGEQIDPSTHRKNYVRVVGRNGESSELDLQGIRIDSDISGTLKFACESIVEEYEDELIEFFSREADNVKDKLCSKRTDLCDHALHISHDEL

SEQ ID NO: 5919 - protein, 278 aa, unidentified [sequence omitted]

SEQ ID NO: 5920 - protein, 248 aa, unidentified
MGPVRLGILLFLFLAVHEAWAGMLKEEDDDTERLPSKCEVCKLLSTELQAELSRTGRSREVLELGQVLDTGKRKRHVPYSVSETRLEEALENLCERILDYSVHAERKGSLRYAKGQSQTMATLKGLVQKGVKVDLGIPLELWDEPSVEVTYLKKQCETMLEEFEDIVGDWYFHHQEQPLQNFLCEGHVLPAAETACLQETWTGKEITDGEEKTEGEEEQEEEEEEEEEEGGDKMTKTGSHPKLDREDL

SEQ ID NO: 5921 - protein, 372 aa, unidentified; identical to SEQ ID NO: 1067

SEQ ID NO: 5922 - protein, 1018 aa, unidentified
MKMWLLVSHLVIISITTCLAEFTWYRRYGHGVSEEDKGFGPIFEEQPINTIYPEESLEGKVSLNCRARASPFPVYKWRMNNGDVDLTSDRYSMVGGNLVINNPDKQKDAGIYYCLASNNYGMVRSTEATLSFGYLDPFPPEERPEVRVKEGKGMVLLCDPPYHFPDDLSYRWLLNEFPVFITMDKRRFVSQTNGNLYIANVEASDKGNYSCFVSSPSITKSVFSKFIPLIPIPERTTKPYPADIVVQFKDVYALMGQNVTLECFALGNPVPDIRWRKVLEPMPSTAEISTSGAVLKIFNIQLEDEGIYECEAENIRGKDKHQARIYVQAFPEWVEHINDTEVDIGSDLYWPCVATGKPIPTIRWLKNGYAYHKGELRLYDVTFENAGMYQCIAENTYGAIYANAELKILALAPTFEMNPMKKKILAAKGGRVIIECKPKAAPKPKFSWSKGTEWLVNSSRILIWEDGSLEINNITRNDGGIYTCFAENNRGKANSTGTLVITDPTRIILAPINADITVGENATMQCAASFDPALDLTFVWSFNGYVIDFNKENIHYQRNFMLDSNGELLIRNAQLKHAGRYTCTAQTIVDNSSASADLVVRGPPGPPGGLRIEDIRATSVALTWSRGSDNHSPISKYTIQTKTILSDDWKDAKTDPPIIEGNMEAARAVDLIPWMEYEFRVVATNTLGRGEPSIPSNRIKTDGAAPNVAPSDVGGGGGRNRELTITWAPLSREYHYGNNFGYIVAFKPFDGEEWKKVTVTNPDTGRYVHKDETMSPSTAFQVKVKAFNNKGDGPYSLVAVINSAQDAPSEAPTEVGVKVLSSSEISVHWEHVLEKIVESYQIRYWAAHDKEEAANRVQVTSQEYSARLENLLPDTQYFIEVGACNSAGCGPPSDMIEAFTKKAPPSQPPRIISSVRSGSRYIITWDHVVALSNESTVTGYKVLYRPDGQHDGKLYSTHKHSIEVPIPRDGEYVVEVRAHSDGGDGVVSQVKISGAPTLSPSLLGLLLPAFGILVYLEF

SEQ ID NO: 5923 - protein, 1040 aa, unidentified
MGTATRRKPHLLLVAAVALVSSSAWSSALGSQTTFGPVFEDQPLSVLFPEESTEEQVLLACRARASPPATYRWKMNGTEMKLEPGSRHQLVGGNLVIMNPTKAQDAGVYQCLASNPVGTVVSREAILRFGFLQEFSKEERDPVKAHEGWGVMLPCNPPAHYPGLSYRWLLNEFPNFIPTDGRHFVSQTTGNLYIARTNASDLGNYSCLATSHMDFSTKSVFSKFAQLNLAAEDTRLFAPSIKARFPAETYALVGQQVTLECFAFGNPVPRIKWRKVDGSLSPQWTTAEPTLQIPSVSFEDEGTYECEAENSKGRDTVQGRIIVQAQPEWLKVISDTEADIGSNLRWGCAAAGKPRPTVRWLRNGEPLASQNRVEVLAGDLRFSKLSLEDSGMYQCVAENKHGTIYASAELAVQALAPDFRLNPVRRLIPAARGGEILIPCQPRAAPKAVVLWSKGTEILVNSSRVTVTPDGTLIIRNISRSDEGKYTCFAENFMGKANSTGILSVRDATKITLAPSSADINLGDNLTLQCHASHDPTMDLTFTWTLDDFPIDFDKPGGHYRRTNVKETIGDLTILNAQLRHGGKYTCMAQTVVDSASKEATVLVRGPPGPPGGVVVRDIGDTTIQLSWSRGFDNHSPIAKYTLQARTPPAGKWKQVRTNPANIEGNAETAQVLGLTPWMDYEFRVIASNILGTGEPSGPSSKIRTREAAPSVAPSGLSGGGGAPGELIVNWTPMSREYQNGDGFGYLLSFRRQGSTHWQTARVPGADAQYFVYSNESVRPYTPFEVKIRSYNRRGDGPESLTALVYSAEEEPRVAPTKVWAKGVSSSEMNVTWEPVQQDMNGILLGYEIRYWKAGDKEAAADRVRTAGLDTSARVSGLHPNTKYHVTVRAYNRAGTGPASPSANATTMKPPPRRPPGNISWTFSSSSLSIKWDPVVPFRNESAVTGYKMLYQNDLHLTPTLHLTGKNWIEIPVPEDIGHALVQIRTTGPGGDGIPAEVHIVRNGGTSMMVENMAVRPAPHPGTVISHSVAMLILIGSLEL

SEQ ID NO: 5924 - protein, 1028 aa, unidentified
MMFPWKQLILLSFIGCLGGELLLQGPVFIKEPSNSIFPVGSEDKKITLHCEARGNPSPHYRWQLNGSDIDMSMEHRYKLNGGNLVVINPNRNWDTGTYQCFATNSLGTIVSREAKLQFAYLENFKTKMRSTVSVREGQGVVLLCGPPPHSGELSYAWIFNEYPSFVEEDSRRFVSQETGHLYISKVEPSDVGNYTCVVTSMVTNARVLGSPTPLVLRSDGVMGEYEPKIEVQFPETLPAAKGSTVKLECFALGNPIPQINWRRSDGLPFSSKIKLRKFSGVLEIPNFQQEDAGSYECIAENSRGKNVARGRLTYYAKPHWVQLIKDVEIAVEDSLYWECRASGKPKPSYRWLKNGAALVLEERTQIENGALTISNLSVTDSGMFQCIAENKHGLVYSSAELKVVASAPDFSKNPMKKLVQVQVGSLVSLDCKPRASPRALSSWKKGDVSVQEHERISLLNDGGLKIANVTKADAGTYTCMAENQFGKANGTTHLVVTEPTRITLAPSNMDVSVGESVILPCQVQHDPLLDIIFTWYFNGALADFKKDGSHFEKVGGSSSGDLMIRNIQLKHSGKYVCMVQTGVDSVSSAADLIVRGSPGPPENVKVDEITDTTAQLSWKEGKDNHSPVISYSIQARTPFSVGWQTVTTVPEVIDGKTHTATVVELNPWVEYEFRVVASNKIGGGEPSLPSEKVRTEEAVPEVPPSEVNGGGGSRSELVITWDPVPEELQNGEGFGYVVAFRPLGVTTWIQTVVTSPDTPRYVFRNESIVPYSPYEVKVGVYNNKGEGPFSPVTTVFSAEEEPTVAPSQVSANSLSSSEIEVSWNTIPWKLSNGHLLGYEVRYWNGGGKEESSSKMKVAGNETSARLRGLKSNLAYYTAVRAYNSAGAGPFSATVNVTTKKTPPSQPPGNVVWNATDTKVLLNWEQVKAMENESEVTGYKVFYRTSSQNNVQVLNTNKTSAELVLPIKEDYIIEVKATTDGGDGTSSEQIRIPRITSMDARGSTSAISNVHPMSSYMPIVLFLIVYVLW

SEQ ID NO: 5925 - protein, 1100 aa, unidentified
MASSWKLMLFLSVTMCLSEYSKSLPGLSTSYAALLRIKKSSSSSLFGSKTRPRYSSPSLGTLSASSPSWLGAAQNYYSPINLYHSSDAFKQDESVDYGPVFVQEPDDIIFPTDSDEKKVALNCEVRGNPVPSYRWLRNGTEIDLESDYRYSLIDGTFIISNPSEAKDSGHYQCLATNTVGSILSREATLQFAYLGNFSGRTRSAVSVREGQGVVLMCSPPPHSPEIIYSWVFNEFPSFVAEDSRRFISQETGNLYISKVQTSDVGSYICLVKNTVTNARVLSPPTPLTLRNDGVMGEYEPKIEVHFPFTVTAAKGTTVKMECFALGNPVPTITWMKVNGYIPSKARLRKSQAVLEIPNVQLDDAGIYECRAENSRGKNSFRGQLQVYTYPHWVEKLNDTQLDSGSPLRWECKATGKPRPTYRWLKNGVPLSPQSRVEMVNGVLMIHNVNQSDAGMYQCLAENKYGAIYASAELKILASAPTFALNQLKKTIIVTKDQEVVIECKPQGSPKPTISWKKGDRAVRENKRIAILPDGSLRILNASKSDEGKYVCRGENVFGSAEIIASLSVKEPTRIELTPKRTELTVGESIVLNCKAIHDASLDVTFYWTLKGQPIDFEEEGGHFESIRAQASSADLMIRNILLMHAGRYGCRVQTTADSVSDEAELLVRGPPGPPGIVIVEEITESTATLSWSPAADNHSPISSYNLQARSPFSLGWQTVKTVPEIITGDMESAMAVDLNPWVEYEFRVVATNPIGTGDPSTPSRMIRTNEAVPKTAPTNVSGRSGRRHELVIAWEPVSEEFQNGEGFGYIVAFRPNGTRGWKEKMVTSSEASKFIYRDESVPPLTPFEVKVGVYNNKGDGPFSQIVVICSAEGEPSAAPTDVKATSVSVSEILVAWKHIKESLGRPQGFEVGYWKDMEQEDTAETVKTRGNESFVILTGLEGNTLYHFTVRAYNGAGYGPPSSEVSATTKKSPPSQAPSNLRWEQQGSQVSLGWEPVIPLANESEVVGYKVFYRQEGHSNSQVIETQKLQAVVPLPDAGVYIIEVRAYSEGGDGTASSQIRVPSYSGGKITSAQSTLHSLSTSSSSVTLLLALMIPSTSW

SEQ ID NO: 5926 - protein, 1331 aa, unidentified; identical to SEQ ID NO: 1070

SEQ ID NO: 5927 - protein, 1288 aa, unidentified; identical to SEQ ID NO: 1071

SEQ ID NO: 5928 - protein, 1288 aa, unidentified; identical to SEQ ID NO: 1072

SEQ ID NO: 5929 - protein, 564 aa, unidentified
MAVFRSGLLVLTTPLASLAPRLASILTSAARLVNHTLYVHLQPGMSLEGPAQPQSSPVQATFEVLDFITHLYAGADVHRHLDVRILLTNIRTKSTFLPPLPTSVQNLAHPPEVVLTDFQTLDGSQYNPVKQQLVRYATSCYSCCPRLASVLLYSDYGIGEVPVEPLDVPLPSTIRPASPVAGSPKQPVRGYYRGAVGGTFDRLHNAHKVLLSVACILAQEQLVVGVADKDLLKSKLLPELLQPYTERVEHLSEFLVDIKPSLTFDVIPLLDPYGPAGSDPSLEFLVVSEETYRGGMAINRFRLENDLEELALYQIQLLKDLRHTENEEDKVSSSSFRQRMLGNLLRPPYERPELPTCLYVIGLTGISGSGKSSIAQRLKGLGAFVIDSDHLGHRAYAPGGPAYQPVVEAFGTDILHKDGIINRKVLGSRVFGNKKQLKILTDIMWPIIAKLAREEMDRAVAEGKRVCVIDAAVLLEAGWQNLVHEVWTAVIPETEAVRRIVERDGLSEAAAQSRLQSQMSGQQLVEQSHVVLSTLWEPHITQRQVEKAWALLQKRIPKTHQALD

SEQ ID NO: 5930 - protein, 550 aa, unidentified
MSAAWIPALGLGVCLLLLPGPAGSEGAAPIAITCFTRGLDIRKEKADVLCPGGCPLEEFSVYGNIVYASVSSICGAAVHRGVISNSGGPVRVYSLPGRENYSSVDANGIQSQMLSRWSASFTVTKGKSSTQEATGQAVSTAHPPTGKRLKKTPEKKTGNKDCKADIAFLIDGSFNIGQRRFNLQKNFVGKVALMLGIGTEGPHVGLVQASEHPKIEFYLKNFTSAKDVLFAIKEVGFRGGNSNTGKALKHTAQKFFTVDAGVRKGIPKVVVVFIDGWPSDDIEEAGIVAREFGVNVFIVSVAKPIPEELGMVQDVTFVDKAVCRNNGFFSYHMPNWFGTTKYVKPLVQKLCTHEQMMCSKTCYNSVNIAFLIDGSSSVGDSNFRLMLEFVSNIAKTFEISDIGAKIAAVQFTYDQRTEFSFTDYSTKENVLAVIRNIRYMSGGTATGDAISFTVRNVFGPIRESPNKNFLVIVTDGQSYDDVQGPAAAAHDAGITIFSVGVAWAPLDDLKDMASKPKESHAFFTREFTGLEPIVSDVIRGICRDFLESQQ

SEQ ID NO: 5931 - protein, 828 aa, unidentified
MAEAALLLLPEAAAERDAREKLALWDRRPDTTAPLTDRQTDSVLELKAAAENLPVPAELPIEDLCSLTSQSLPIELTSVVPESTEDILLKGFTSLGMEEERIETAQQFFSWFAKLQTQMDQDEGTKYRQMRDYLSGFQEQCDAILNDVNSALQHLESLQKQYLFVSNKTGTLHEACEQLLKEQSELVDLAENIQQKLSYFNELETINTKLNSPTLSVNSDGFIPMLAKLDDCITYISSHPNFKDYPIYLLKFKQCLSKALHLMKTYTVNTLQTLTSQLLKRDPSSVPNADNAFTLFYVKFRAAAPKVRTLIEQIELRSEKIPEYQQLLNDIHQCYLDQRELLLGPSIACTVAELTSQNNRDHCALVRSGCAFMVHVCQDEHQLYNEFFTKPTSKLDELLEKLCVSLYDVFRPLIIHVIHLETLSELCGILKNEVLEDHVQNNAEQLGAFAAGVKQMLEDVQERLVYRTHIYIQTDITGYKPAPGDLAYPDKLVMMEQIAQSLKDEQKKVPSEASFSDVHLEEGESNSLTKSGSTESLNPRPQTTISPADLHGMWYPTVRRTLVCLSKLYRCIDRAVFQGLSQEALSACIQSLLGASESISKNKTQIDGQLFLIKHLLILREQIAPFHTEFTIKEISLDLKKTRDAAFKILNPMTVPRFFRLNSNNALIEFLLEGTPEIREHYLDSKKDVDRHLKSACEQFIQQQTKLFVEQLEEFMTKVSALKTMASQGGPKYTLSQQPWAQPAKVNDLAATAYKTIKTKLPVTLRSMSLYLSNKDTEFILFKPVRNNIQQVFQKFHALLKEEFSPEDIQIIACPSMEQLSLLLLVSK

SEQ ID NO: 5932 - protein, 680 aa, unidentified
MLPQIPFLLLVSLNLVHGVFYAERYQMPTGIKGPLPNTKTQFFIPYTIKSKGIAVRGEQGTPGPPGPAGPRGHPGPSGPPGKPGYGSPGLQGEPGLPGPPGPSAVGKPGVPGLPGKPGERGPYGPKGDVGPAGLPGPRGPPGPPGIPGPAGISVPGKPGQQGPTGAPGPRGFPGEKGAPGVPGMNGQKGEMGYGAPGRPGERGLPGPQGPTGPSGPPGVGKRGENGVPGQPGIKGDRGFPGEMGPIGPPGPQGPPGERGPEGIGKPGAAGAPGQPGIPGTKGLPGAPGIAGPPGPPGFGKPGLPGLKGERGPAGLPGGPGAKGEQGPAGLPGKPGLTGPPGNMGPQGPKGIPGSHGLPGPKGETGPAGPAGYPGAKGERGSPGSDGKPGYPGKPGLDGPKGNPGLPGPKGDPGVGGPPGLPGPVGPAGAKGMPGHNGEAGPRGAPGIPGTRGPIGPPGIPGFPGSKGDPGSPGPPGPAGIATKGLNGPTGPPGPPGPRGHSGEPGLPGPPGPPGPPGQAVMPEGFIKAGQRPSLSGTPLVSANQGVTGMPVSAFTVILSKAYPAIGTPIPFDKILYNRQQHYDPRTGIFTCQIPGIYYFSYHVHVKGTHVWVGLYKNGTPVMYTYDEYTKGYLDQASGSAIIDLTENDQVWLQLPNAESNGLYSSEYVHSSFSGFLVAPM

SEQ ID NO: 5933 - protein, 1806 aa, unidentified
MEPWSSRWKTKRWLWDFTVTTLALTFLFQAREVRGAAPVDVLKALDFHNSPEGISKTTGFCTNRKNSKGSDTAYRVSKQAQLSAPTKQLFPGGTFPEDFSILFTVKPKKGIQSFLLSIYNEHGIQQIGVEVGRSPVFLFEDHTGKPAPEDYPLFRTVNIADGKWHRVAISVEKKTVTMIVDCKKKTTKPLDRSERAIVDTNGITVFGTRILDEEVFEGDIQQFLITGDPKAAYDYCEHYSPDCDSSAPKAAQAQEPQIDEYAPEDIIEYDYEYGEAEYKEAESVTEGPTVTEETIAQTEANIVDDFQEYNYGTMESYQTEAPRHVSGTNEPNPVEEIFTEEYLTGEDYDSQRKNSEDTLYENKEIDGRDSDLLVDGDLGEYDFYEYKEYEDKPTSPPNEEFGPGVPAETDITETSINGHGAYGEKGQKGEPAVVEPGMLVEGPPGPAGPAGIMGPPGLQGPTGPPGDPGDRGPPGRPGLPGADGLPGPPGTMLMLPFRYGGDGSKGPTISAQEAQAQAILQQARIALRGPPGPMGLTGRPGPVGGPGSSGAKGESGDPGPQGPRGVQGPPGPTGKPGKRGRPGADGGRGMPGEPGAKGDRGFDGLPGLPGDKGHRGERGPQGPPGPPGDDGMRGEDGEIGPRGLPGEAGPRGLLGPRGTPGAPGQPGMAGVDGPPGPKGNMGPQGEPGPPGQQGNPGPQGLPGPQGPIGPPGEKGPQGKPGLAGLPGADGPPGHPGKEGQSGEKGALGPPGPQGPIGYPGPRGVKGADGVRGLKGSKGEKGEDGFPGFKGDMGLKGDRGEVGQIGPRGEDGPEGPKGRAGPTGDPGPSGQAGEKGKLGVPGLPGYPGRQGPKGSTGFPGFPGANGEKGARGVAGKPGPRGQRGPTGPRGSRGARGPTGKPGPKGTSGGDGPPGPPGERGPQGPQGPVGFPGPKGPPGPPGKDGLPGHPGQRGETGFQGKTGPPGPGGVVGPQGPTGETGPIGERGHPGPPGPPGEQGLPGAAGKEGAKGDPGPQGISGKDGPAGLRGFPGERGLPGAQGAPGLKGGEGPQGPPGPVGSPGERGSAGTAGPIGLPGRPGPQGPPGPAGEKGAPGEKGPQGPAGRDGVQGPVGLPGPAGPAGSPGEDGDKGEIGEPGQKGSKGDKGENGPPGPPGLQGPVGAPGIAGGDGEPGPRGQQGMFGQKGDEGARGFPGPPGPIGLQGLPGPPGEKGENGDVGPMGPPGPPGPRGPQGPNGADGPQGPPGSVGSVGGVGEKGEPGEAGNPGPPGEAGVGGPKGERGEKGEAGPPGAAGPPGAKGPPGDDGPKGNPGPVGFPGDPGPPGEPGPAGQDGVGGDKGEDGDPGQPGPPGPSGEAGPPGPPGKRGPPGAAGAEGRQGEKGAKGEAGAEGPPGKTGPVGPQGPAGKPGPEGLRGIPGPVGEQGLPGAAGQDGPPGPMGPPGLPGLKGDPGSKGEKGHPGLIGLIGPPGEQGEKGDRGLPGTQGSPGAKGDGGIPGPAGPLGPPGPPGLPGPQGPKGNKGSTGPAGQKGDSGLPGPPGSPGPPGEVIQPLPILSSKKTRRHTEGMQADADDNILDYSDGMEEIFGSLNSLKQDIEHMKFPMGTQTNPARTCKDLQLSHPDFPDGEYWIDPNQGCSGDSFKVYCNFTSGGETCIYPDKKSEGVRISSWPKEKPGSWFSEFKRGKLLSYLDVEGNSINMVQMTFLKLLTASARQNFTYHCHQSAAWYDVSSGSYDKALRFLGSNDEEMSYDNNPFIKTLYDGCASRKGYEKTVIEINTPKIDQVPIVDVMINDFGDQNQKFGFEVGPVCFLG

SEQ ID NO: 5934 - protein, 1629 aa, unidentified
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 5935 - protein, 3063 aa, unidentified
MRSRLPPALAALGAALLLSSIEAEVDPPSDLNFKIIDENTVHMSWAKPVDPIVGYRITVDPTTDGPTKEFTLSASTTETLLSELVPETEYVVTITSYDEVEESVPVIGQLTIQTGSSTKPVEKKPGKTEIQKCSVSAWTDLVFLVDGSWSVGRNNFKYILDFIAALVSAFDIGEEKTRVGVVQYSSDTRTEFNLNQYYQRDELLAAIKKIPYKGGNTMTGDAIDYLVKNTFTESAGARVGFPKVAIIITDGKSQDEVEIPARELRNVGVEVFSLGIKAADAKELKQIASTPSLNHVFNVANFDAIVDIQNEIISQVCSGVDEQLGELVSGEEVVEPPSNLIAMEVSSKYVKLNWNPSPSPVTGYKVILTPMTAGSRQHALSVGPQTTTLSVRDLSADTEYQISVSAMKGMTSSEPISIMEKTQPMKVQVECSRGVDIKADIVFLVDGSYSIGIANFVKVRAFLEVLVKSFEISPNRVQISLVQYSRDPHTEFTLKKFTKVEDIIEAINTFPYRGGSTNTGKAMTYVREKIFVPSKGSRSNVPKVMILITDGKSSDAFRDPAIKLRNSDVEIFAVGVKDAVRSELEAIASPPAETHVFTVEDFDAFQRISFELTQSICLRIEQELAAIKKKAYVPPKDLSFSEVTSYGFKTNWSPAGENVFSYHITYKEAAGDDEVTVVEPASSTSVVLSSLKPETLYLVNVTAEYEDGFSIPLAGEETTEEVKGAPRNLKVTDETTDSFKITWTQAPGRVLRYRIIYRPVAGGESREVTTPPNQRRRTLENLIPDTKYEVSVIPEYFSGPGTPLTGNAATEEVRGNPRDLRVSDPTTSTMKLSWSGAPGKVKQYLVTYTPVAGGETQEVTVRGDTTNTVLQGLKEGTQYALSVTALYASGAGDALFGEGTTLEERGSPQDLVTKDITDTSIGAYWTSAPGMVRGYRVSWKSLYDDVDTGEKNLPEDAIHTMIENLQPETKYRISVFATYSSGEGEPLTGDATTELSQDSKTLKVDEETENTMRVTWKPAPGKVVNYRVVYRPHGRGKQMVAKVPPTVTSTVLKRLQPQTTYDITVLPIYKMGEGKLRQGSGTTASRFKSPRNLKTSDPTMSSFRVTWEPAPGEVKGYKVTFHPTGDDRRLGELVVGPYDNTVVLEELRAGTTYKVNVFGMFDGGESSPLVGQEMTTLSDTTVMPILSSGMECLTRAEADIVLLVDGSWSIGRANFRTVRSFISRIVEVFDIGPKRVQIALAQYSGDPRTEWQLNAHRDKKSLLQAVANLPYKGGNTLTGMALNFIRQQNFRTQAGMRPRARKIGVLITDGKSQDDVEAPSKKLKDEGVELFAIGIKNADEVELKMIATDPDDTHAYNVADFESLSRIVDDLTINLCNSVKGPGDLEAPSNLVISERTHRSFRVSWTPPSDSVDRYKVEYYPVSGGKRQEFYVSRMETSTVLKDLKPETEYVVNVYSVVEDEYSEPLKGTEKTLPVPVVSLNIYDVGPTTMHVQWQPVGGATGYILSYKPVKDTEPTRPKEVRLGPTVNDMQLTDLVPNTEYAVTVQAVLHDLTSEPVTVREVTLPLPRPQDLKLRDVTHSTMNVFWEPVPGKVRKYIVRYKTPEEDVKEVEVDRSETSTSLKDLFSQTLYTVSVSAVHDEGESPPVTAQETTRPVPAPTNLKITEVTSEGFRGTWDHGASDVSLYRITWAPFGSSDKMETILNGDENTLVFENLNPNTIYEVSITAIYPDESESDDLIGSERTLPILTTQAPKSGPRNLQVYNATSNSLTVKWDPASGRVQKYRITYQPSTGEGNEQTTTIGGRQNSVVLQKLKPDTPYTITVSSLYPDGEGGRMTGRGKTKPLNTVRNLRVYDPSTSTLNVRWDHAEGNPRQYKLFYAPAAGGPEELVPIPGNTNYAILRNLQPDTSYTVTVVPVYTEGDGGRTSDTGRTLMRGLARNVQVYNPTPNSLDVRWDPAPGPVLQYRVVYSPVDGTRPSESIVVPGNTRMVHLERLIPDTLYSVNLVALYSDGEGNPSPAQGRTLPRSGPRNLRVFGETTNSLSVAWDHADGPVQQYRIIYSPTVGDPIDEYTTVPGRRNNVILQPLQPDTPYKITVIAVYEDGDGGHLTGNGRTVGLLPPQNIHISDEWYTRFRVSWDPSPSPVLGYKIVYKPVGSNEPMEAFVGEMTSYTLHNLNPSTTYDVNVYAQYDSGLSVPLTDQGTTLYLNVTDLKTYQIGWDTFCVKWSPHRAATSYRLKLSPADGTRGQEITVRGSETSHCFTGLSPDTDYGVTVFVQTPNLEGPGVSVKEHTTVKPTEAPTEPPTPPPPPTIPPARDVCKGAKADIVFLTDASWSIGDDNFNKVVKFIFNTVGGFDEISPAGIQVSFVQYSDEVKSEFKLNTYNDKALALGALQNIRYRGGNTRTGKALTFIKEKVLTWESGMRKNVPKVLVVVTDGRSQDEVKKAALVIQQSGFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKVHIVVTSKSVKIYIDCYEIIEKDIKEAGNITTDGYEILGKLLKGERKSAAFQIQSFDIVCSPVWTSRDRCCDIPSRRDEGKCPAFPNSCTCTQDSVGPPGPPGPAGGPGAKGPRGERGISGAIGPPGPRGDIGPPGPQGPPGPQGPNGLSIPGEQGRQGMKGDAGEPGLPGRTGTPGLPGPPGPMGPPGDRGFTGKDGAMGPRGPPGPPGSPGSPGVTGPSGKPGKPGDHGRPGPSGLKGEKGDRGDIASQNMMRAVARQVCEQLISGQMNRFNQMLNQIPNDYQSSRNQPGPPGPPGPPGSAGARGEPGPGGRPGFPGTPGMQGPPGERGLPGEKGERGTGSSGPRGLPGPPGPQGESRTGPPGSTGSRGPPGPPGRPGNSGIRGPPGPPGYCDSSQCASIPYNGQGYPGSG

SEQ ID NO: 5936 - protein, 1796 aa, unidentified
MKIFQRKMRYWLLPPFLAIVYFCTIVQGQVAPPTRLRYNVISHDSIQISWKAPRGKFGGYKLLVTPTSGGKTNQLNLQNTATKAIIQGLMPDQNYTVQIIAYNKDKESKPAQGQFRIKDLEKRKDPKPRVKVVDRGNGSRPSSPEEVKFVCQTPAIADIVILVDGSWSIGRFNFRLVRHFLENLVTAFDVGSEKTRIGLAQYSGDPRIEWHLNAFSTKDEVIEAVRNLPYKGGNTLTGLALNYIFENSFKPEAGSRTGVSKIGILITDGKSQDDIIPPSRNLRESGVELFAIGVKNADVNELQEIASEPDSTHVYNVAEFDLMHTVVESLTRTLCSRVEEQDREIKASAHAITGPPTELITSEVTARSFMVNWTHAPGNVEKYRVVYYPTRGGKPDEVVVDGTVSSTVLKNLMSLTEYQIAVFAIYAHTASEGLRGTETTLALPMASDLLLYDVTENSMRVKWDAVPGASGYLILYAPLTEGLAGDEKEMKIGETHTDIELSGLLPNTEYTVTVYAMFGEEASDPVTGQETTLALSPPRNLRISNVGSNSARLTWDPTSRQINGYRIVYNNADGTEINEVEVDPITTFPLKGLTPLTEYTIAIFSIYDEGQSEPLTGVFTTEEVPAQQYLEIDEVTTDSFRVTWHPLSADEGLHKLMWIPVYGGKTEEVVLKEEQDSHVIEGLEPGTEYEVSLLAVLDDGSESEVVTAVGTTLDSFWTEPATTIVPTTSVTSVFQTGIRNLVVGDETTSSLRVKWDISDSDVQQFRVTYMTAQGDPEEEVIGTVMVPGSQNNLLLKPLLPDTEYKVTVTPIYTDGEGVSVSAPGKTLPSSGPQNLRVSEEWYNRLRITWDPPSSPVKGYRIVYKPVSVPGPTLETFVGADINTILITNLLSGMDYNVKIFASQASGFSDALTGMVKTLFLGVTNLQAKHVEMTSLCAHWQVHRHATAYRVVIESLQDRQKQESTVGGGTTRHCFYGLQPDSEYKISVYTKLQEIEGPSVSIMEKTQSLPTRPPTFPPTIPPAKEVCKAAKADLVFMVDGSWSIGDENFNKIISFLYSTVGALNKIGTDGTQVAMVQFTDDPRTEFKLNAYKTKETLLDAIKHISYKGGNTKTGKAIKYVRDTLFTAESGTRRGIPKVIVVITDGRSQDDVNKISREMQLDGYSIFAIGVADADYSELVSIGSKPSARHVFFVDDFDAFKKIEDELITFVCETASATCPVVHKDGIDLAGFKMMEMFGLVEKDFSSVEGVSMEPGTFNVFPCYQLHKDALVSQPTRYLHPEGLPSDYTISFLFRILPDTPQEPFALWEILNKNSDPLVGVILDNGGKTLTYFNYDQSGDFQTVTFEGPEIRKIFYGSFHKLHIVVSETLVKVVIDCKQVGEKAMNASANITSDGVEVLGKMVRSRGPGGNSAPFQLQMFDIVCSTSWANTDKCCELPGLRDDESCPDLPHSCSCSETNEVALGPAGPPGGPGLRGPKGQQGEPGPKGPDGPRGEIGLPGPQGPPGPQGPSGLSIQGMPGMPGEKGEKGDTGLPGPQGIPGGVGSPGRDGSPGQRGLPGKDGSSGPPGPPGPIGIPGTPGVPGITGSMGPQGALGPPGVPGAKGERGERGDLQSQAMVRSVARQVCEQLIQSHMARYTAILNQIPSHSSSIRTVQGPPGEPGRPGSPGAPGEQGPPGTPGFPGNAGVPGTPGERGLTGIKGEKGNPGVGTQGPRGPPGPAGPSGESRPGSPGPPGSPGPRGPPGHLGVPGPQGPSGQPGYCDPSSCSAYGVRAPHPDQPEFTPVQDELEAMELWGPGV

SEQ ID NO: 5937 - protein, 1388 aa, unidentified
MAPRRNNGQCWCLLMLLSVSTPLPAVTQTRGATETASQGHLDLTQLIGVPLPSSVSFVTGYGGFPAYSFGPGANVGRPARTLIPSTFFRDFAISVVVKPSSTRGGVLFAITDAFQKVIYLGLRLSGVEDGHQRIILYYTEPGSHVSQEAAAFSVPVMTHRWNRFAMIVQGEEVTLLVNCEEHSRIPFQRSSQALAFESSAGIFMGNAGATGLERFTGSLQQLTVHPDPRTPEELCDPEESSASGETSGLQEADGVAEILEAVTYTQASPKEAKVEPINTPPTPSSPFEDMELSGEPVPEGTLETTNMSIIQHSSPKQGSGEILNDTLEGVHSVDGDPITDSGSGAGAFLDIAEEKNLAATAAGLAEVPISTAGEAEASSVPTGGPTLSMSTENPEEGVTPGPDNEERLAATAAGEAEALASMPGEVEASGVAPGELDLSMSAQSLGEEATVGPSSEDSLTTAAAATEVSLSTFEDEEASGVPTDGLAPLTATMAPERAVTSGPGDEEDLAAATTEEPLITAGGEESGSPPPDGPPLPLPTVAPERWITPAQREHVGMKGQAGPKGEKGDAGEELPGPPEPSGPVGPTAGAEAEGSGLGWGSDVGSGSGDLVGSEQLLRGPPGPPGPPGLPGIPGKPGTDVFMGPPGSPGEDGPAGEPGPPGPEGQPGVDGATGLPGMKGEKGARGPNGSVGEKGDPGNRGLPGPPGKKGQAGPPGVMGPPGPPGPPGPPGPGCTMGLGFEDTEGSGSTQLLNEPKLSRPTAAIGLKGEKGDRGPKGERGMDGASIVGPPGPRGPPGHIKVLSNSLINITHGFMNFSDIPELVGPPGPDGLPGLPGFPGPRGPKGDTGLPGFPGLKGEQGEKGEPGAILTEDIPLERLMGKKGEPGMHGAPGPMGPKGPPGHKGEFGLPGRPGRPGLNGLKGTKGDPGVIMQGPPGLPGPPGPPGPPGAVINIKGAIFPIPVRPHCKMPVDTAHPGSPELITFHGVKGEKGSWGLPGSKGEKGDQGAQGPPGPPLDLAYLRHFLNNLKGENGDKGFKGEKGEKGDINGSFLMSGPPGLPGNPGPAGQKGETVVGPQGPPGAPGLPGPPGFGRPGDPGPPGPPGPPGPPAILGAAVALPGPPGPPGQPGLPGSRNLVTAFSNMDDMLQKAHLVIEGTFIYLRDSTEFFIRVRDGWKKLQLGELIPIPADSPPPPALSSNPHQLLPPPNPISSANYEKPALHLAALNMPFSGDIRADFQCFKQARAAGLLSTYRAFLSSHLQDLSTIVRKAERYSLPIVNLKGQVLFNNWDSIFSGHGGQFNMHIPIYSFDGRDIMTDPSWPQKVIWHGSSPHGVRLVDNYCEAWRTADTAVTGLASPLSTGKILDQKAYSCANRLIVLCIENSFMTDARK

SEQ ID NO: 5938 - protein, 1604 aa, unidentified
MWVSWAPGLWLLGLWATFGHGANTGAQCPPSQQEGLKLEHSSSLPANVTGFNLIHRLSLMKTSAIKKIRNPKGPLILRLGAAPVTQPTRRVFPRGLPEEFALVLTLLLKKHTHQKTWYLFQVTDANGYPQISLEVNSQERSLELRAQGQDGDFVSCIFPVPQLFDLRWHKLMLSVAGRVASVHVDCSSASSQPLGPRRPMRPVGHVFLGLDAEQGKPVSFDLQQVHIYCDPELVLEEGCCEILPAGCPPETSKARRDTQSNELIEINPQSEGKVYTRCFCLEEPQNSEVDAQLTGRISQKAERGAKVHQETAADECPPCVHGARDSNVTLAPSGPKGGKGERGLPGPPGSKGEKGARGNDCVRISPDAPLQCAEGPKGEKGESGALGPSGLPGSTGEKGQKGEKGDGGIKGVPGKPGRDGRPGEICVIGPKGQKGDPGFVGPEGLAGEPGPPGLPGPPGIGLPGTPGDPGGPPGPKGDKGSSGIPGKEGPGGKPGKPGVKGEKGDPCEVCPTLPEGFQNFVGLPGKPGPKGEPGDPVPARGDPGIQGIKGEKGEPCLSCSSVVGAQHLVSSTGASGDVGSPGFGLPGLPGRAGVPGLKGEKGNFGEAGPAGSPGPPGPVGPAGIKGAKGEPCEPCPALSNLQDGDVRVVALPGPSGEKGEPGPPGFGLPGKQGKAGERGLKGQKGDAGNPGDPGTPGTTGRPGLSGEPGVQGPAGPKGEKGDGCTACPSLQGTVTDMAGRPGQPGPKGEQGPEGVGRPGKPGQPGLPGVQGPPGLKGVQGEPGPPGRGVQGPQGEPGAPGLPGIQGLPGPRGPPGPTGEKGAQGSPGVKGATGPVGPPGASVSGPPGRDGQQGQTGLRGTPGEKGPRGEKGEPGECSCPSQGDLIFSGMPGAPGLWMGSSWQPGPQGPPGIPGPPGPPGVPGLQGVPGNNGLPGQPGLTAELGSLPIEQHLLKSICGDCVQGQRAHPGYLVEKGEKGDQGIPGVPGLDNCAQCFLSLERPRAEEARGDNSEGDPGCVGSPGLPGPPGLPGQRGEEGPPGMRGSPGPPGPIGPPGFPGAVGSPGLPGLQGERGLTGLTGDKGEPGPPGQPGYPGATGPPGLPGIKGERGYTGSAGEKGEPGPPGSEGLPGPPGPAGPRGERGPQGNSGEKGDQGFQGQPGFPGPPGPPGFPGKVGSPGPPGPQAEKGSEGIRGPSGLPGSPGPPGPPGIQGPAGLDGLDGKDGKPGLRGDPGPAGPPGLMGPPGFKGKTGHPGLPGPKGDCGKPGPPGSTGRPGAEGEPGAMGPQGRPGPPGHVGPPGPPGQPGPAGISAVGLKGDRGATGERGLAGLPGQPGPPGHPGPPGEPGTDGAAGKEGPPGKQGFYGPPGPKGDPGAAGQKGQAGEKGRAGMPGGPGKSGSMGPVGPPGPAGERGHPGAPGPSGSPGLPGVPGSMGDMVNYDEIKRFIRQEIIKMFDERMAYYTSRMQFPMEMAAAPGRPGPPGKDGAPGRPGAPGSPGLPGQIGREGRQGLPGVRGLPGTKGEKGDIGIGIAGENGLPGPPGPQGPPGYGKMGATGPMGQQGIPGIPGPPGPMGQPGKAGHCNPSDCFGAMPMEQQYPPMKTMKGPFG

SEQ ID NO: 5939 - protein, 1754 aa, unidentified
MAPYPCGCHILLLLFCCLAAARANLLNLNWLWFNNEDTSHAATTIPEPQGPLPVQPTADTTTHVTPRNGSTEPATAPGSPEPPSELLEDGQDTPTSAESPDAPEENIAGVGAEILNVAKGIRSFVQLWNDTVPTESLARAETLVLETPVGPLALAGPSSTPQENGTTLWPSRGIPSSPGAHTTEAGTLPAPTPSPPSLGRPWAPLTGPSVPPPSSGRASLSSLLGGAPPWGSLQDPDSQGLSPAAAAPSQQLQRPDVRLRTPLLHPLVMGSLGKHAAPSAFSSGLPGALSQVAVTTLTRDSGAWVSHVANSVGPGLANNSALLGADPEAPAGRCLPLPPSLPVCGHLGISRFWLPNHLHHESGEQVRAGARAWGGLLQTHCHPFLAWFFCLLLVPPCGSVPPPAPPPCCQFCEALQDACWSRLGGGRLPVACASLPTQEDGYCVLIGPAAERISEEVGLLQLLGDPPPQQVTQTDDPDVGLAYVFGPDANSGQVARYHFPSLFFRDFSLLFHIRPATEGPGVLFAITDSAQAMVLLGVKLSGVQDGHQDISLLYTEPGAGQTHTAASFRLPAFVGQWTHLALSVAGGFVALYVDCEEFQRMPLARSSRGLELEPGAGLFVAQAGGADPDKFQGVIAELKVRRDPQVSPMHCLDEEGDDSDGASGDSGSGLGDARELLREETGAALKPRLPAPPPVTTPPLAGGSSTEDSRSEEVEEQTTVASLGAQTLPGSDSVSTWDGSVRTPGGRVKEGGLKGQKGEPGVPGPPGRAGPPGSPCLPGPPGLPCPVSPLGPAGPALQTVPGPQGPPGPPGRDGTPGRDGEPGDPGEDGKPGDTGPQGFPGTPGDVGPKGDKGDPGVGERGPPGPQGPPGPPGPSFRHDKLTFIDMEGSGFGGDLEALRGPRGFPGPPGPPGVPGLPGEPGRFGVNSSDVPGPAGLPGVPGREGPPGFPGLPGPPGPPGREGPPGRTGQKGSLGEAGAPGHKGSKGAPGPAGARGESGLAGAPGPAGPPGPPGPPGPPGPGLPAGFDDMEGSGGPFWSTARSADGPQGPPGLPGLKGDPGVPGLPGAKGEVGADGVPGFPGLPGREGIAGPQGPKGDRGSRGEKGDPGKDGVGQPGLPGPPGPPGPVVYVSEQDGSVLSVPGPEGRPGFAGFPGPAGPKGNLGSKGERGSPGPKGEKGEPGSIFSPDGGALGPAQKGAKGEPGFRGPPGPYGRPGYKGEIGFPGRPGRPGMNGLKGEKGEPGDASLGFGMRGMPGPPGPPGPPGPPGTPVYDSNVFAESSRPGPPGLPGNQGPPGPKGAKGEVGPPGPPGQFPFDFLQLEAEMKGEKGDRGDAGQKGERGEPGGGGFFGSSLPGPPGPPGPPGPRGYPGIPGPKGESIRGQPGPPGPQGPPGIGYEGRQGPPGPPGPPGPPSFPGPHRQTISVPGPPGPPGPPGPPGTMGASSGVRLWATRQAMLGQVHEVPEGWLIFVAEQEELYVRVQNGFRKVQLEARTPLPRGTDNEVAALQPPVVQLHDSNPYPRREHPHPTARPWRADDILASPPRLPEPQPYPGAPHHSSYVHLRPARPTSPPAHSHRDFQPVLHLVALNSPLSGGMRGIRGADFQCFQQARAVGLAGTFRAFLSSRLQDLYSIVRRADRAAVPIVNLKDELLFPSWEALFSGSEGPLKPGARIFSFDGKDVLRHPTWPQKSVWHGSDPNGRRLTESYCETWRTEAPSATGQASSLLGGRLLGQSAASCHHAYIVLCIENSFMTASK

SEQ ID NO: 5940 - protein, 1142 aa, unidentified
MRLTGPWKLWLWMSIFLLPASTSVTVRDKTEESCPILRIEGHQLTYDNINKLEVSGFDLGDSFSLRRAFCESDKTCFKLGSALLIRDTIKIFPKGLPEEYSVAAMFRVRRNAKKERWFLWQVLNQQNIPQISIVVDGGKKVVEFMFQATEGDVLNYIFRNRELRPLFDRQWHKLGISIQSQVISLYMDCNLIARRQTDEKDTVDFHGRTVIATRASDGKPVDIELHQLKIYCSANLIAQETCCEISDTKCPEQDGFGNIASSWVTAHASKMSSYLPAKQELKDQCQCIPNKGEAGLPGAPGSPGQKGHKGEPGENGLHGAPGFPGQKGEQGFEGSKGETGEKGEQGEKGDPALAGLNGENGLKGDLGPHGPPGPKGEKGDTGPPGPPALPGSLGIQGPQGPPGKEGQRGRRGKTGPPGKPGPPGPPGPPGIQGIHQTLGGYYNKDNKGNDEHEAGGLKGDKGETGLPGFPGSVGPKGQKGEPGEPFTKGEKGDRGEPGVIGSQGVKGEPGDPGPPGLIGSPGLKGQQGSAGSMGPRGPPGDVGLPGEHGIPGKQGIKGEKGDPGGIIGPPGLPGPKGEAGPPGKSLPGEPGLDGNPGAPGPRGPKGERGLPGVHGSPGDIGPQGIGIPGRTGAQGPAGEPGIQGPRGLPGLPGTPGTPGNDGVPGRDGKPGLPGPPGDPIALPLLGDIGALLKNFCGNCQASVPGLKSNKGEEGGAGEPGKYDSMARKGDIGPRGPPGIPGREGPKGSKGERGYPGIPGEKGDEGLQGIPGIPGAPGPTGPPGLMGRTGHPGPTGAKGEKGSDGPPGKPGPPGPPGIPFNERNGMSSLYKIKGGVNVPSYPGPPGPPGPKGDPGPVGEPGAMGLPGLEGFPGVKGDRGPAGPPGIAGMSGKPGAPGPPGVPGEPGERGPVGDIGFPGPEGPSGKPGINGKDGIPGAQGIMGKPGDRGPKGERGDQGIPGDRGSQGERGKPGLTGMKGAIGPMGPPGNKGSMGSPGHQGPPGSPGIPGIPADAVSFEEIKKYINQEVLRIFEERMAVFLSQLKLPAAMLAAQAYGRPGPPGKDGLPGPPGDPGPQGYRGQKGERGEPGIGLPGSPGLPGTSALGLPGSPGAPGPQGPPGPSGRCNPEDCLYPVSHAHQRTGGN

SEQ ID NO: 5941 - protein, 1464 aa, unidentified
MFSFVDLRLLLLLAATALLTHGQEEGQVEGQDEDIPPITCVQNGLRYHDRDVWKPEPCRICVCDNGKVLCDDVICDETKNCPGAEVPEGECCPVCPDGSESPTDQETTGVEGPKGDTGPRGPRGPAGPPGRDGIPGQPGLPGPPGPPGPPGPPGLGGNFAPQLSYGYDEKSTGGISVPGPMGPSGPRGLPGPPGAPGPQGFQGPPGEPGEPGASGPMGPRGPPGPPGKNGDDGEAGKPGRPGERGPPGPQGARGLPGTAGLPGMKGHRGFSGLDGAKGDAGPAGPKGEPGSPGENGAPGQMGPRGLPGERGRPGAPGPAGARGNDGATGAAGPPGPTGPAGPPGFPGAVGAKGEAGPQGPRGSEGPQGVRGEPGPPGPAGAAGPAGNPGADGQPGAKGANGAPGIAGAPGFPGARGPSGPQGPGGPPGPKGNSGEPGAPGSKGDTGAKGEPGPVGVQGPPGPAGEEGKRGARGEPGPTGLPGPPGERGGPGSRGFPGADGVAGPKGPAGERGSPGPAGPKGSPGEAGRPGEAGLPGAKGLTGSPGSPGPDGKTGPPGPAGQDGRPGPPGPPGARGQAGVMGFPGPKGAAGEPGKAGERGVPGPPGAVGPAGKDGEAGAQGPPGPAGPAGERGEQGPAGSPGFQGLPGPAGPPGEAGKPGEQGVPGDLGAPGPSGARGERGFPGERGVQGPPGPAGPRGANGAPGNDGAKGDAGAPGAPGSQGAPGLQGMPGERGAAGLPGPKGDRGDAGPKGADGSPGKDGVRGLTGPIGPPGPAGAPGDKGESGPSGPAGPTGARGAPGDRGEPGPPGPAGFAGPPGADGQPGAKGEPGDAGAKGDAGPPGPAGPAGPPGPIGNVGAPGAKGARGSAGPPGATGFPGAAGRVGPPGPSGNAGPPGPPGPAGKEGGKGPRGETGPAGRPGEVGPPGPPGPAGEKGSPGADGPAGAPGTPGPQGIAGQRGVVGLPGQRGERGFPGLPGPSGEPGKQGPSGASGERGPPGPMGPPGLAGPPGESGREGAPGAEGSPGRDGSPGAKGDRGETGPAGPPGAPGAPGAPGPVGPAGKSGDRGETGPAGPTGPVGPVGARGPAGPQGPRGDKGETGEQGDRGIKGHRGFSGLQGPPGPPGSPGEQGPSGASGPAGPRGPPGSAGAPGKDGLNGLPGPIGPPGPRGRTGDAGPVGPPGPPGPPGPPGPPSAGFDFSFLPQPPQEKAHDGGRYYRADDANVVRDRDLEVDTTLKSLSQQIENIRSPEGSRKNPARTCRDLKMCHSDWKSGEYWIDPNQGCNLDAIKVFCNMETGETCVYPTQPSVAQKNWYISKNPKDKRHVWFGESMTDGFQFEYGGQGSDPADVAIQLTFLRLMSTEASQNITYHCKNSVAYMDQQTGNLKKALLLQGSNEIEIRAEGNSRFTYSVTVDGCTSHTGAWGKTVIEYKTTKTSRLPIIDVAPLDVGAPDQEFGFDVGPVCFL

SEQ ID NO: 5942 - protein, 1366 aa, unidentified
MLSFVDTRTLLLLAVTLCLATCQSLQEETVRKGPAGDRGPRGERGPPGPPGRDGEDGPTGPPGPPGPPGPPGLGGNFAAQYDGKGVGLGPGPMGLMGPRGPPGAAGAPGPQGFQGPAGEPGEPGQTGPAGARGPAGPPGKAGEDGHPGKPGRPGERGVVGPQGARGFPGTPGLPGFKGIRGHNGLDGLKGQPGAPGVKGEPGAPGENGTPGQTGARGLPGERGRVGAPGPAGARGSDGSVGPVGPAGPIGSAGPPGFPGAPGPKGEIGAVGNAGPAGPAGPRGEVGLPGLSGPVGPPGNPGANGLTGAKGAAGLPGVAGAPGLPGPRGIPGPVGAAGATGARGLVGEPGPAGSKGESGNKGEPGSAGPQGPPGPSGEEGKRGPNGEAGSAGPPGPPGLRGSPGSRGLPGADGRAGVMGPPGSRGASGPAGVRGPNGDAGRPGEPGLMGPRGLPGSPGNIGPAGKEGPVGLPGIDGRPGPIGPAGARGEPGNIGFPGPKGPTGDPGKNGDKGHAGLAGARGAPGPDGNNGAQGPPGPQGVQGGKGEQGPPGPPGFQGLPGPSGPAGEVGKPGERGLHGEFGLPGPAGPRGERGPPGESGAAGPTGPIGSRGPSGPPGPDGNKGEPGVVGAVGTAGPSGPSGLPGERGAAGIPGGKGEKGEPGLRGEIGNPGRDGARGAPGAVGAPGPAGATGDRGEAGAAGPAGPAGPRGSPGERGEVGPAGPNGFAGPAGAAGQPGAKGERGAKGPKGENGVVGPTGPVGAAGPAGPNGPPGPAGSRGDGGPPGMTGFPGAAGRTGPPGPSGISGPPGPPGPAGKEGLRGPRGDQGPVGRTGEVGAVGPPGFAGEKGPSGEAGTAGPPGTPGPQGLLGAPGILGLPGSRGERGLPGVAGAVGEPGPLGIAGPPGARGPPGAVGSPGVNGAPGEAGRDGNPGNDGPPGRDGQPGHKGERGYPGNIGPVGAAGAPGPHGPVGPAGKHGNRGETGPSGPVGPAGAVGPRGPSGPQGIRGDKGEPGEKGPRGLPGLKGHNGLQGLPGIAGHHGDQGAPGSVGPAGPRGPAGPSGPAGKDGRTGHPGTVGPAGIRGPQGHQGPAGPPGPPGPPGPPGVSGGGYDFGYDGDFYRADQPRSAPSLRPKDYEVDATLKSLNNQIETLLTPEGSRKNPARTCRDLRLSHPEWSSGYYWIDPNQGCTMDAIKVYCDFSTGETCIRAQPENIPAKNWYRSSKDKKHVWLGETINAGSQFEYNVEGVTSKEMATQLAFMRLLANYASQNITYHCKNSIAYMDEETGNLKKAVILQGSNDVELVAEGNSRFTYTVLVDGCSKKTNEWGKTIIEYKTNKPSRLPFLDIAPLDIGGADQEFFVDIGPVCFK

SEQ ID NO: 5943 - protein, 1284 aa, unidentified
MSSGDPAHLGLCLWLWLGATLGREQVQASGLLRLAVLPEDRLQMKWRESEGSGLGYLVQVKPMAGDSEQEVILTTKTPKATVGGLSPSKGYTLQIFELTGSGRFLLARREFVIEDLKSSSLDRSSQRPLGSGAPEPTPSHTGSPDPEQASEPQVAFTPSQDPRTPAGPQFRCLPPVPADMVFLVDGSWSIGHSHFQQVKDFLASVIAPFEIGPDKVQVGLTQYSGDAQTEWDLNSLSTKEQVLAAVRRLRYKGGNTFTGLALTHVLGQNLQPAAGLRPEAAKVVILVTDGKSQDDVHTAARVLKDLGVNVFAVGVKNADEAELRLLASPPRDITVHSVLDFLQLGALAGLLSRLICQRLQGGSPRQGPAAAPALDTLPAPTSLVLSQVTSSSIRLSWTPAPRHPLKYLIVWRASRGGTPREVVVEGPAASTELHNLASRTEYLVSVFPIYEGGVGEGLRGLVTTAPLPPPRALTLAAVTPRTVHLTWQPSAGATHYLVRCSPASPKGEEEEREVQVGRPEVLLDGLEPGRDYEVSVQSLRGPEGSEARGIRARTPTLAPPRHLGFSDVSHDAARVFWEGAPRPVRLVRVTYVSSEGGHSGQTEAPGNATSATLGPLSSSTTYTVRVTCLYPGGGSSTLTGRVTTKKAPSPSQLSMTELPGDAVQLAWVAAAPSGVLVYQITWTPLGEGKAHEISVPGNLGTAVLPGLGRHTEYDVTILAYYRDGARSDPVSLRYTPSTVSRSPPSNLALASETPDSLQVSWTPPLGRVLHYWLTYAPASGLGPEKSVSVPGARSHVTLPDLQAATKYRVLVSAIYAAGRSEAVSATGQTACPALRPDGSLPGFDLMVAFSLVEKAYASIRGVAMEPSAFGGTPTFTLFKDAQLTRRVSDVYPAPLPPEHTIVFLVRLLPETPREAFALWQMTAEDFQPLLGVLLDAGKKSLTYFHRDPRAALQEATFDPQEVRKIFFGSFHKVHVAVGRSKVRLYVDCRKVAERPLGEMGSPPAAGFVTLGRLAKARGPRSSSAAFQLQMLQIVCSDTWADEDRCCELPASRDGETCPAFVSACSCSSETPGPPGPQGPPGLPGRNGTPGEQGFPGPRGPPGVKGEKGDHGLPGLQGHPGHQGIPGRVGLQGPKGMRGLEGTAGLPGPPGPRGFQGMAGARGTSGERGPPGTVGPTGLPGPKGERGEKGEPQSLATLYQLVSQASHVSKFDSFHENTRPPMPILEQKLEPGTEPLGSPGTRSKALVPGEWGRGGRHLEGRGEPGAVGQMGSPGQQGASTQGLWE

SEQ ID NO: 5944 - protein, 957 aa, unidentified
MAHYITFLCMVLVLLLQNSVLAEDGEVRSSCRTAPTDLVFILDGSYSVGPENFEIVKKWLVNITKNFDIGPKFIQVGVVQYSDYPVLEIPLGSYDSGEHLTAAVESILYLGGNTKTGKAIQFALDYLFAKSSRFLTKIAVVLTDGKSQDDVKDAAQAARDSKITLFAIGVGSETEDAELRAIANKPSSTYVFYVEDYIAISKIREVMKQKLCEESVCPTRIPVAARDERGFDILLGLDVNKKVKKRIQLSPKKIKGYEVTSKVDLSELTSNVFPEGLPPSYVFVSTQRFKVKKIWDLWRILTIDGRPQIAVTLNGVDKILLFTTTSVINGSQVVTFANPQVKTLFDEGWHQIRLLVTEQDVTLYIDDQQIENKPLHPVLGILINGQTQIGKYSGKEETVQFDVQKLRIYCDPEQNNRETACEIPGFNGECLNGPSDVGSTPAPCICPPGKPGLQGPKGDPGLPGNPGYPGQPGQDGKPGYQGIAGTPGVPGSPGIQGARGLPGYKGEPGRDGDKGDRGLPGFPGLHGMPGSKGEMGAKGDKGSPGFYGKKGAKGEKGNAGFPGLPGPAGEPGRHGKDGLMGSPGFKGEAGSPGAPGQDGTRGEPGIPGFPGNRGLMGQKGEIGPPGQQGKKGAPGMPGLMGSNGSPGQPGTPGSKGSKGEPGIQGMPGASGLKGEPGATGSPGEPGYMGLPGIQGKKGDKGNQGEKGIQGQKGENGRQGIPGQQGIQGHHGAKGERGEKGEPGVRGAIGSKGESGVDGLMGPAGPKGQPGDPGPQGPPGLDGKPGREFSEQFIRQVCTDVIRAQLPVLLQSGRIRNCDHCLSQHGSPGIPGPPGPIGPEGPRGLPGLPGRDGVPGLVGVPGRPGVRGLKGLPGRNGEKGSQGFGYPGEQGPPGPPGPEGPPGISKEGPPGDPGLPGKDGDHGKPGIQGQPGPPGICDPSLCFSVIARRDPFRKGPNY

SEQ ID NO: 5945 - protein, 1626 aa, unidentified
MAGLRGNAVAGLLWMLLLWSGGGGCQAQRAGCKSVHYDLVFLLDTSSSVGKEDFEKVRQWVANLVDTFEVGPDRTRVGVVRYSDRPTTAFELGLFGSQEEVKAAARRLAYHGGNTNTGDALRYITARSFSPHAGGRPRDRAYKQVAILLTDGRSQDLVLDAAAAAHRAGIRIFAVGVGEALKEELEEIASEPKSAHVFHVSDFNAIDKIRGKLRRRLCENVLCPSVRVEGDRFKHTNGGTKEITGFDLMDLFSVKEILGKRENGAQSSYVRMGSFPVVQSTEDVFPQGLPDEYAFVTTFRFRKTSRKEDWYIWQVIDQYSIPQVSIRLDGENKAVEYNAVGAMKDAVRVVFRGSRVNDLFDRDWHKMALSIQAQNVSLHIDCALVQTLPIEERENIDIQGKTVIGKRLYDSVPIDFDLQRIVIYCDSRHAELETCCDIPSGPCQVTVVTEPPPPPPPQRPPTPGSEQIGFLKTINCSCPAGEKGEMGVAGPMGLPGPKGDIGAIGPVGAPGPKGEKGDVGIGPFGQGEKGEKGSLGLPGPPGRDGSKGMRGEPGELGEPGLPGEVGMRGPQGPPGLPGPPGRVGAPGLQGERGEKGTRGEKGERGLDGFPGKPGDTGQQGRPGPSGVAGPQGEKGDVGPAGPPGVPGSVVQQEGLKGEQGAPGPRGHQGAPGPPGARGPIGPEGRDGPPGLQGLRGKKGDMGPPGIPGLLGLQGPPGPPGVPGPPGPGGSPGLPGEIGFPGKPGPPGPTGPPGKDGPNGPPGPPGTKGEPGERGEDGLPGKPGLRGEIGEQGLAGRPGEKGEAGLPGAPGFPGVRGEKGDQGEKGELGLPGLKGDRGEKGEAGPAGPPGLPGTTSLFTPHPRMPGEQGPKGEKGDPGLPGEPGLQGRPGELGPQGPTGPPGAKGQEGAHGAPGAAGNPGAPGHVGAPGPSGPPGSVGAPGLRGTPGKDGERGEKGAAGEEGSPGPVGPRGDPGAPGLPGPPGKGKDGEPGLRGSPGLPGPLGTKAACGKVRGSENCALGGQCVKGDRGAPGIPGSPGSRGDPGIGVAGPPGPSGPPGDKGSPGSRGLPGFPGPQGPAGRDGAPGNPGERGPPGKPGLSSLLSPGDINLLAKDVCNDCPPGPPGLPGLPGFKGDKGVPGKPGREGTEGKKGEAGPPGLPGPPGIAGPQGSQGERGADGEVGQKGDQGHPGVPGFMGPPGNPGPPGADGIAGAAGPPGIQGSPGKEGPPGPQGPSGLPGIPGEEGKEGRDGKPGPPGEPGKAGEPGLPGPEGARGPPGFKGHTGDSGAPGPRGESGAMGLPGQEGLPGKDGDTGPTGPQGPQGPRGPPGKNGSPGSPGEPGPSGTPGQKGSKGENGSPGLPGFLGPRGPPGEPGEKGVPGKEGVPGKPGEPGFKGERGDPGIKGDKGPPGGKGQPGDPGIPGHKGHTGLMGPQGLPGENGPVGPPGPPGQPGFPGLRGESPSMETLRRLIQEELGKQLETRLAYLLAQMPPAYMKSSQGRPGPPGPPGKDGLPGRAGPMGEPGRPGQGGLEGPSGPIGPKGERGAKGDPGAPGVGLRGEMGPPGIPGQPGEPGYAKDGLPGIPGPQGETGPAGHPGLPGPPGPPGQCDPSQCAYFASLAARPGNVKGP

SEQ ID NO: 5946 - protein, 1714 aa, unidentified
MHLRAHRTRRGKVSPTAKTKSLLHFIVLCVAGVVVHAQEQGIDILHQLGLGGKDVRHSSPATAVPSASTPLPQGVHLTESGVIFKNDAYIETPFVKILPVNLGQPFTILTGLQSHRVNNAFLFSIRNKNRLQLGVQLLPKKLVVHIRGKQPAVFNYSVHDEQWHSFAITIRNQSVSMFVECGKKYFSTETIPEVQTFDSNSVFTLGSMNNNSIHFEGIVCQLDIIPSAEASADYCRYVKQQCRQADKYQPETSIPCTTLIPTKIPEHSPPPKLFAEKVLSEDTFTEGKSIPNIIKNDSETVYKRQEHQISRSQLSSLQSGNVSAVDLTNHGIQAKEMITEEDTQTNFSLSVTTHRISEAKMNTKEKFSSLLNMSDNITQHDDRVTGLSLFKKMPSILPQIKQDTITNLKKAITANLHTNELMEMQPILNTSLHRVTNEPSVDNHLDLRKEGEFYPDATYPIENSYETELYDYYYYEDLNTMLEMEYLRGPKGDTGPPGPPGPAGIPGPSGKRGPRGIPGPHGNPGLPGLPGPKGPKGDPGFSPGQPVPGEKGDQGLSGLMGPPGMQGDKGLKGHPGLPGLPGEQGIPGFAGNIGSPGYPGRQGLAGPEGNPGPKGAQGFIGSPGEAGQLGPEGERGIPGIRGKKGFKGRQGFPGDFGDRGPAGLDGSPGLVGGTGPPGFPGLRGSVGPVGPIGPAGIPGPMGLSGNKGLPGIKGDKGEQGTAGELGEPGYPGDKGAVGLPGPPGMRGKSGPSGQTGDPGLQGPSGPPGPEGFPGDIGIPGQNGPEGPKGLLGNRGPPGPPGLKGTQGEEGPIGAFGELGPRGKPGQKGYAGEPGPEGLKGEVGDQGNIGKIGETGPVGLPGEVGMTGSIGEKGERGSPGPLGPQGEKGVMGYPGPPGVPGPIGPLGLPGHVGARGPPGSQGPKGQRGSRGPDGLLGEQGIQGAKGEKGDQGKRGPHGLIGKTGNPGERGFQGKPGLQGLPGSTGDRGLPGEPGLRGLQGDVGPPGEMGMEGPPGTEGESGLQGEPGAKGDVGTAGSVGGTGEPGLRGEPGAPGEEGLQGKDGLKGVPGGRGLPGEDGEKGEMGLPGIIGPLGRSGQTGLPGPEGIVGIPGQRGRPGKKGDKGQIGPTGEVGSRGPPGKIGKSGPKGARGTRGAVGHLGLMGPDGEPGIPGYRGHQGQPGPSGLPGPKGEKGYPGEDSTVLGPPGPRGEPGPVGDQGERGEPGAEGYKGHVGVPGLRGATGQQGPPGEPGDQGEQGLKGERGSEGNKGKKGAPGPSGKPGIPGLQGLLGPKGIQGYHGADGISGNPGKIGPPGKQGLPGIRGGPGRTGLAGAPGPPGVKGSSGLPGSPGIQGPKGEQGLPGQPGIQGKRGHRGAQGDQGPCGDPGLKGQPGEYGVQGLTGFQGFPGPKGPEGDAGIVGISGPKGPIGHRGNTGPLGREGIIGPTGRTGPRGEKGFRGETGPQGPRGQPGPPGPPGAPGPRKQMDINAAIQALIESNTALQMESYQNTEVTLIDHSEEIFKTLNYLSNLLHSIKNPLGTRDNPARICKDLLNCEQKVSDGKYWIDPNLGCPSDAIEVFCNFSAGGQTCLPPVSVTKLEFGVGKVQMNFLHLLSSEATHIITIHCLNTPRWTSTQTSGPGLPIGFKGWNGQIFKVNTLLEPKVLSDDCKIQDGSWHKATFLFHTQEPNQLPVIEVQKLPHLKTERKYYIDSSSVCFL

SEQ ID NO: 5947 - protein, 441 aa, unidentified
MKLALLLPWACCCLCGSALATGFLYPFSAAALQQHGYPEPGAGSPGSGYASRRHWCHHTVTRTVSCQVQNGSETVVQRVYQSCRWPGPCANLVSYRTLIRPTYRVSYRTVTVLEWRCCPGFTGSNCDEECMNCTRLSDMSERLTTLEAKVLLLEAAERPSSPDNDLPAPESTPPTWNEDFLPDAIPLAHPVPRQRRPTGPAGPPGQTGPPGPAGPPGSKGDRGQTGEKGPAGPPGLLGPPGPRGLPGEMGRPGPPGPPGPAGNPGPSPNSPQGALYSLQPPTDKDNGDSRLASAIVDTVLAGVPGPRGPPGPPGPPGPRGPPGPPGTPGSQGLAGERGTVGPSGEPGVKGEEGEKAATAEGEGVQQLREALKILAERVLILEHMIGIHDPLASPEGGSGQDAALRANLKMKRGGAQPDGVLAALLGPDPGQKSVDQASSRK

SEQ ID NO: 5948 - protein, 1860 aa, unidentified
MGAGSARGARGTAAAAAARGGGFLFSWILVSFACHLASTQGAPEDVDILQRLGLSWTKAGSPAPPGVIPFQSGFIFTQRARLQAPTGTVIPAALGTELALVLSLCSHRVNHAFLFAVRSQKRKLQLGLQFLPGKTVVHLGSRRSVAFDLDMHDGRWHHLALELRGRTVTLVTACGQRRVPVLLPFHRDPALDPGGSFLFGKMNPHAVQFEGALCQFSIYPVTQVAHNYCTHLRKQCGQADTYQSPLGPLFSQDSGRPFTFQSDLALLGLENLTTATPALGSLPAGRGPRGTVAPATPTKPQRTSPTNPHQHMAVGGPAQTPLLPAKLSASNALDPMLPASVGGSTRTPRPAAAQPSQKITATKIPKSLPTKPSAPSTSIVPIKSPHPTQKTAPSSFTKSALPTQKQVPPTSRPVPARVSRPAEKPIQRNPGMPRPPPPSTRPLPPTTSSSKKPIPTLARTEAKITSHASKPASARTSTHKPPPFTALSSSPAPTPGSTRSTRPPATMVPPTSGTSTPRTAPAVPTPGSAPTGSKKPIGSEASKKAGPKSSPRKPVPLRPGKAARDVPLSDLTTRPSPRQPQPSQQTTPALVLAPAQFLSSSPRPTSSGYSIFHLAGSTPFPLLMGPPGPKGDCGLPGPPGLPGLPGIPGARGPRGPPGPYGNPGLPGPPGAKGQKGDPGLSPGKAHDGAKGDMGLPGLSGNPGPPGRKGHKGYPGPAGHPGEQGQPGPEGSPGAKGYPGRQGLPGPVGDPGPKGSRGYIGLPGLFGLPGSDGERGLPGVPGKRGKMGMPGFPGVFGERGPPGLDGNPGELGLPGPPGVPGLIGDLGVLGPIGYPGPKGMKGLMGSVGEPGLKGDKGEQGVPGVSGDPGFQGDKGSQGLPGFPGARGKPGPLGKVGDKGSIGFPGPPGPEGFPGDIGPPGDNGPEGMKGKPGARGLPGPRGQLGPEGDEGPMGPPGAPGLEGQPGRKGFPGRPGLDGVKGEPGDPGRPGPVGEQGFMGFIGLVGEPGIVGEKGDRGMMGPPGVPGPKGSMGHPGMPGGMGTPGEPGPQGPPGSRGPPGMRGAKGRRGPRGPDGPAGEQGSRGLKGPPGPQGRPGRPGQQGVAGERGHLGSRGFPGIPGPSGPPGTKGLPGEPGPQGPQGPIGPPGEMGPKGPPGAVGEPGLPGEAGMKGDLGPLGTPGEQGLIGQRGEPGLEGDSGPMGPDGLKGDRGDPGPDGEHGEKGQEGLMGEDGPPGPPGVTGVRGPEGKSGKQGEKGRTGAKGAKGYQGQLGEMGVPGDPGPPGTPGPKGSRGSLGPTGAPGRMGAQGEPGLAGYDGHKGIVGPLGPPGPKGEKGEQGEDGKAEGPPGPPGDRGPVGDRGDRGEPGDPGYPGQEGVQGLRGKPGQQGQPGHPGPRGWPGPKGSKGAEGPKGKQGKAGAPGRRGVQGLQGLPGPRGVVGRQGLEGIAGPDGLPGRDGQAGQQGEQGDDGDPGPMGPAGKRGNPGVAGLPGAQGPPGFKGESGLPGQLGPPGKRGTEGRTGLPGNQGEPGSKGQPGDSGEMGFPGMAGLFGPKGPPGDIGFKGIQGPRGPPGLMGKEGIVGPLGILGPSGLPGPKGDKGSRGDWGLQGPRGPPGPRGRPGPPGPPGGPIQLQQDDLGAAFQTWMDTSGALRPESYSYPDRLVLDQGGEIFKTLHYLSNLIQSIKTPLGTKENPARVCRDLMDCEQKMVDGTYWVDPNLGCSSDTIEVSCNFTHGGQTCLKPITASKVEFAISRVQMNFLHLLSSEVTQHITIHCLNMTVWQEGTGQTPAKQAVRFRAWNGQIFEAGGQFRPEVSMDGCKVQDGRWHQTLFTFRTQDPQQLPIISVDNLPPASSGKQYRLEVGPACFL

SEQ ID NO: 5949 - protein, 1125 aa, unidentified
MWNRYFVFYLLLLSAFTSQTVSGQRKKGPKSNLLARKSDVQGSICFIDIVFIVDSSESSKIALFDKQKDFVDSLSDKIFQLTPGRSLEYDIKLAALQFSSSVQIDPPFSSWKDLQTFKQKVKSMNLIGQGTFSYYAISNATRLLKREGRKDGVKVVLLMTDGIDHPKNPDVQSISEDARISGISFITIALSTVVNEAKLRLISGDSSSEPTLLLSDPTLVDKIQDRLDILFEKKCERKICECEKGDPGDPGPPGTHGNPGIKGERGPKGNPGNAQKGEAGERGPGGIPGYKGDKGERGECGKPGIKGDKGSPGPYGPKGPRGIQGITGPPGDPGPKGFQGNKGEPGPPGPYGSPGAPGIGQQGIKGERGQEGRPGAPGPIGVGEPGQPGPRGPEGVPGERGLPGEGFPGPKGEKGSEGPTGPQGLQGLSIKGEKGDIGPVGPQGPMGIPGIGSQGEQGIQGPIGPPGPQGPAGQGLPGSKGEVGQMGPTGPRGPVGIGVQGPKGEPGSIGLPGQPGVPGEDGAAGKKGEAGLPGARGPEGPPGKGQPGPKGDEGKKGSKGNQGQRGLPGPEGPKGEPGIMGPFGMPGTSIPGPPGPKGDRGGPGIPGFKGEPGLSIRGPKGVQGPRGPVGAPGLKGDGYPGVPGPRGLPGPPGPMGLRGVGDTGAKGEPGVRGPPGPSGPRGVGTQGPKGDTGQKGLPGPPGPPGYGSQGIKGEQGPQGFPGPKGTMGHGLPGQKGEHGERGDVGKKGDKGEIGEPGSPGKQGLQGPKGDLGLTKEEIIKLITEICGCGPKCKETPLELVFVIDSSESVGPENFQIIKNFVKTMADRVALDLATARIGIINYSHKVEKVANLKQFSSKDDFKLAVDNMQYLGEGTYTATALQAANDMFEDARPGVKKVALVITDGQTDSRDKEKLTEVVKNASDTNVEIFVIGVVKKNDPNFEIFHKEMNLIATDPEHVYQFDDFFTLQDTLKQKLFQKICEDFDSYLVQIFGSSSPQPGFGMSGEELSESTPEPQKEISESLSVTRDQDEDDKAPEPTWADDLPATTSSEATTTPRPLLSTPVDGAEDPRCLEALKPGNCGEYVVRWYYDKQVNSCARFWFSGCNGSGNRFNSEKECQETCIQG

SEQ ID NO: 5950 - protein, 1487 aa, unidentified
MIRLGAPQTLVLLTLLVAAVLRCQGQDVQEAGSCVQDGQRYNDKDVWKPEPCRICVCDTGTVLCDDIICEDVKDCLSPEIPFGECCPICPTDLATASGQPGPKGQKGEPGDIKDIVGPKGPPGPQGPAGEQGPRGDRGDKGEKGAPGPRGRDGEPGTPGNPGPPGPPGPPGPPGLGGNFAAQMAGGFDEKAGGAQLGVMQGPMGPMGPRGPPGPAGAPGPQGFQGNPGEPGEPGVSGPMGPRGPPGPPGKPGDDGEAGKPGKAGERGPPGPQGARGFPGTPGLPGVKGHRGYPGLDGAKGEAGAPGVKGESGSPGENGSPGPMGPRGLPGERGRTGPAGAAGARGNDGQPGPAGPPGPVGPAGGPGFPGAPGAKGEAGPTGARGPEGAQGPRGEPGTPGSPGPAGASGNPGTDGIPGAKGSAGAPGIAGAPGFPGPRGPPGPQGATGPLGPKGQTGEPGIAGFKGEQGPKGEPGPAGPQGAPGPAGEEGKRGARGEPGGVGPIGPPGERGAPGNRGFPGQDGLAGPKGAPGERGPSGLAGPKGANGDPGRPGEPGLPGARGLTGRPGDAGPQGKVGPSGAPGEDGRPGPPGPQGARGQPGVMGFPGPKGANGEPGKAGEKGLPGAPGLRGLPGKDGETGAAGPPGPAGPAGERGEQGAPGPSGFQGLPGPPGPPGEGGKPGDQGVPGEAGAPGLVGPRGERGFPGERGSPGAQGLQGPRGLPGTPGTDGPKGASGPAGPPGAQGPPGLQGMPGERGAAGIAGPKGDRGDVGEKGPEGAPGKDGGRGLTGPIGPPGPAGANGEKGEVGPPGPAGSAGARGAPGERGETGPPGPAGFAGPPGADGQPGAKGEQGEAGQKGDAGAPGPQGPSGAPGPQGPTGVTGPKGARGAQGPPGATGFPGAAGRVGPPGSNGNPGPPGPPGPSGKDGPKGARGDSGPPGRAGEPGLQGPAGPPGEKGEPGDDGPSGAEGPPGPQGLAGQRGIVGLPGQRGERGFPGLPGPSGEPGKQGAPGASGDRGPPGPVGPPGLTGPAGEPGREGSPGADGPPGRDGAAGVKGDRGETGAVGAPGAPGPPGSPGPAGPTGKQGDRGEAGAQGPMGPSGPAGARGIQGPQGPRGDKGEAGEPGERGLKGHRGFTGLQGLPGPPGPSGDQGASGPAGPSGPRGPPGPVGPSGKDGANGIPGPIGPPGPRGRSGETGPAGPPGNPGPPGPPGPPGPGIDMSAFAGLGPREKGPDPLQYMRADQAAGGLRQHDAEVDATLKSLNNQIESIRSPEGSRKNPARTCRDLKLCHPEWKSGDYWIDPNQGCTLDAMKVFCNMETGETCVYPNPANVPKKNWWSSKSKEKKHIWFGETINGGFHFSYGDDNLAPNTANVQMTFLRLLSTEGSQNITYHCKNSIAYLDEAAGNLKKALLIQGSNDVEIRAEGNSRFTYTALKDGCTKHTGKWGKTVIEYRSQKTSRLPIIDIAPMDIGGPEQEFGVDIGPVCFL

SEQ ID NO: 5951 - protein, 1466 aa, unidentified
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRGPVGPSGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQFSYGNPELPEDVLDVHLAFLRLLSSRASQNITYHCKNSIAYMDQASGNVKKALKLMGSNEGEFKAEGNSKFTYTVLEDGCTKHTGEWSKTVFEYRTRKAVRLPIVDIAPYDIGGPDQEFGVDVGPVCFL

SEQ ID NO: 5952 - protein, 1669 aa, unidentified
MGPRLSVWLLLLPAALLLHEEHSRAAAKGGCAGSGCGKCDCHGVKGQKGERGLPGLQGVIGFPGMQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRGKPGKDGDKGEKGSPGFPGEPGYPGLIGRQGPQGEKGEAGPPGPPGIVIGTGPLGEKGERGYPGTPGPRGEPGPKGFPGLPGQPGPPGLPVPGQAGAPGFPGERGEKGDRGFPGTSLPGPSGRDGLPGPPGSPGPPGQPGYTNGIVECQPGPPGDQGPPGIPGQPGFIGEIGEKGQKGESCLICDIDGYRGPPGPQGPPGEIGFPGQPGAKGDRGLPGRDGVAGVPGPQGTPGLIGQPGAKGEPGEFYFDLRLKGDKGDPGFPGQPGMPGRAGSPGRDGHPGLPGPKGSPGSVGLKGERGPPGGVGFPGSRGDTGPPGPPGYGPAGPIGDKGQAGFPGGPGSPGLPGPKGEPGKIVPLPGPPGAEGLPGSPGFPGPQGDRGFPGTPGRPGLPGEKGAVGQPGIGFPGPPGPKGVDGLPGDMGPPGTPGRPGFNGLPGNPGVQGQKGEPGVGLPGLKGLPGLPGIPGTPGEKGSIGVPGVPGEHGAIGPPGLQGIRGEPGPPGLPGSVGSPGVPGIGPPGARGPPGGQGPPGLSGPPGIKGEKGFPGFPGLDMPGPKGDKGAQGLPGITGQSGLPGLPGQQGAPGIPGFPGSKGEMGVMGTPGQPGSPGPVGAPGLPGEKGDHGFPGSSGPRGDPGLKGDKGDVGLPGKPGSMDKVDMGSMKGQKGDQGEKGQIGPIGEKGSRGDPGTPGVPGKDGQAGQPGQPGPKGDPGISGTPGAPGLPGPKGSVGGMGLPGTPGEKGVPGIPGPQGSPGLPGDKGAKGEKGQAGPPGIGIPGLRGEKGDQGIAGFPGSPGEKGEKGSIGIPGMPGSPGLKGSPGSVGYPGSPGLPGEKGDKGLPGLDGIPGVKGEAGLPGTPGPTGPAGQKGEPGSDGIPGSAGEKGEPGLPGRGFPGFPGAKGDKGSKGEVGFPGLAGSPGIPGSKGEQGFMGPPGPQGQPGLPGSPGHATEGPKGDRGPQGQPGLPGLPGPMGPPGLPGIDGVKGDKGNPGWPGAPGVPGPKGDPGFQGMPGIGGSPGITGSKGDMGPPGVPGFQGPKGLPGLQGIKGDQGDQGVPGAKGLPGPPGPPGPYDIIKGEPGLPGPEGPPGLKGLQGLPGPKGQQGVTGLVGIPGPPGIPGFDGAPGQKGEMGPAGPTGPRGFPGPPGPDGLPGSMGPPGTPSVDHGFLVTRHSQTIDDPQCPSGTKILYHGYSLLYVQGNERAHGQDLGTAGSCLRKFSTMPFLFCNINNVCNFASRNDYSYWLSTPEPMPMSMAPITGENIRPFISRCAVCEAPAMVMAVHSQTIQIPPCPSGWSSLWIGYSFVMHTSAGAEGSGQALASPGSCLEEFRSAPFIECHGRGTCNYYANAYSFWLATIERSEMFKKPTPSTLKAGELRTHVSRCQVCMRRT

SEQ ID NO: 5953 - protein, 1712 aa, unidentified
MGRDQRAVAGPALRRWLLLGTVTVGFLAQSVLAGVKKFDVPCGGRDCSGGCQCYPEKGGRGQPGPVGPQGYNGPPGLQGFPGLQGRKGDKGERGAPGVTGPKGDVGARGVSGFPGADGIPGHPGQGGPRGRPGYDGCNGTQGDSGPQGPPGSEGFTGPPGPQGPKGQKGEPYALPKEERDRYRGEPGEPGLVGFQGPPGRPGHVGQMGPVGAPGRPGPPGPPGPKGQQGNRGLGFYGVKGEKGDVGQPGPNGIPSDTLHPIIAPTGVTFHPDQYKGEKGSEGEPGIRGISLKGEEGIMGFPGLRGYPGLSGEKGSPGQKGSRGLDGYQGPDGPRGPKGEAGDPGPPGLPAYSPHPSLAKGARGDPGFPGAQGEPGSQGEPGDPGLPGPPGLSIGDGDQRRGLPGEMGPKGFIGDPGIPALYGGPPGPDGKRGPPGPPGLPGPPGPDGFLFGLKGAKGRAGFPGLPGSPGARGPKGWKGDAGECRCTEGDEAIKGLPGLPGPKGFAGINGEPGRKGDRGDPGQHGLPGFPGLKGVPGNIGAPGPKGAKGDSRTITTKGERGQPGVPGVPGMKGDDGSPGRDGLDGFPGLPGPPGDGIKGPPGDPGYPGIPGTKGTPGEMGPPGLGLPGLKGQRGFPGDAGLPGPPGFLGPPGPAGTPGQIDCDTDVKRAVGGDRQEAIQPGCIGGPKGLPGLPGPPGPTGAKGLRGIPGFAGADGGPGPRGLPGDAGREGFPGPPGFIGPRGSKGAVGLPGPDGSPGPIGLPGPDGPPGERGLPGEVLGAQPGPRGDAGVPGQPGLKGLPGDRGPPGFRGSQGMPGMPGLKGQPGLPGPSGQPGLYGPPGLHGFPGAPGQEGPLGLPGIPGREGLPGDRGDPGDTGAPGPVGMKGLSGDRGDAGFTGEQGHPGSPGFKGIDGMPGTPGLKGDRGSPGMDGFQGMPGLKGRPGFPGSKGEAGFFGIPGLKGLAGEPGFKGSRGDPGPPGPPPVILPGMKDIKGEKGDEGPMGLKGYLGAKGIQGMPGIPGLSGIPGLPGRPGHIKGVKGDIGVPGIPGLPGFPGVAGPPGITGFPGFIGSRGDKGAPGRAGLYGEIGATGDFGDIGDTINLPGRPGLKGERGTTGIPGLKGFFGEKGTEGDIGFPGITGVTGVQGPPGLKGQTGFPGLTGPPGSQGELGRIGLPGGKGDDGWPGAPGLPGFPGLRGIRGLHGLPGTKGFPGSPGSDIHGDPGFPGPPGERGDPGEANTLPGPVGVPGQKGDQGAPGERGPPGSPGLQGFPGITPPSNISGAPGDKGAPGIFGLKGYRGPPGPPGSAALPGSKGDTGNPGAPGTPGTKGWAGDSGPQGRPGVFGLPGEKGPRGEQGFMGNTGPTGAVGDRGPKGPKGDPGFPGAPGTVGAPGIAGIPQKIAVQPGTVGPQGRRGPPGAPGEMGPQGPPGEPGFRGAPGKAGPQGRGGVSAVPGFRGDEGPIGHQGPIGQEGAPGRPGSPGLPGMPGRSVSIGYLLVKHSQTDQEPMCPVGMNKLWSGYSLLYFEGQEKAHNQDLGLAGSCLARFSTMPFLYCNPGDVCYYASRNDKSYWLSTTAPLPMMPVAEDEIKPYISRCSVCEAPAIAIAVHSQDVSIPHCPAGWRSLWIGYSFLMHTAAGDEGGGQSLVSPGSCLEDFRATPFIECNGGRGTCHYYANKYSFWLTTIPEQSFQGSPSADTLKAGLIRTHISRCQVCMKNL

SEQ ID NO: 5954 - protein, 1670 aa, unidentified
MSARTAPRPQVLLLPLLLVLLAAAPAASKGCVCKDKGQCFCDGAKGEKGEKGFPGPPGSPGQKGFTGPEGLPGPQGPKGFPGLPGLTGSKGVRGISGLPGFSGSPGLPGTPGNTGPYGLVGVPGCSGSKGEQGFPGLPGTLGYPGIPGAAGLKGQKGAPAKEEDIELDAKGDPGLPGAPGPQGLPGPPGFPGPVGPPGPPGFFGFPGAMGPRGPKGHMGERVIGHKGERGVKGLTGPPGPPGTVIVTLTGPDNRTDLKGEKGDKGAMGEPGPPGPSGLPGESYGSEKGAPGDPGLQGKPGKDGVPGFPGSEGVKGNRGFPGLMGEDGIKGQKGDIGPPGFRGPTEYYDTYQEKGDEGTPGPPGPRGARGPQGPSGPPGVPGSPGSSRPGLRGAPGWPGLKGSKGERGRPGKDAMGTPGSPGCAGSPGLPGSPGPPGPPGDIVFRKGPPGDHGLPGYLGSPGIPGVDGPKGEPGLLCTQCPYIPGPPGLPGLPGLHGVKGIPGRQGAAGLKGSPGSPGNTGLPGFPGFPGAQGDPGLKGEKGETLQPEGQVGVPGDPGLRGQPGRKGLDGIPGTPGVKGLPGPKGELALSGEKGDQGPPGDPGSPGSPGPAGPAGPPGYGPQGEPGLQGTQGVPGAPGPPGEAGPRGELSVSTPVPGPPGPPGPPGHPGPQGPPGIPGSLGKCGDPGLPGPDGEPGIPGIGFPGPPGPKGDQGFPGTKGSLGCPGKMGEPGLPGKPGLPGAKGEPAVAMPGGPGTPGFPGERGNSGEHGEIGLPGLPGLPGTPGNEGLDGPRGDPGQPGPPGEQGPPGRCIEGPRGAQGLPGLNGLKGQQGRRGKTGPKGDPGIPGLDRSGFPGETGSPGIPGHQGEMGPLGQRGYPGNPGILGPPGEDGVIGMMGFPGAIGPPGPPGNPGTPGQRGSPGIPGVKGQRGTPGAKGEQGDKGNPGPSEISHVIGDKGEPGLKGFAGNPGEKGNRGVPGMPGLKGLKGLPGPAGPPGPRGDLGSTGNPGEPGLRGIPGSMGNMGMPGSKGKRGTLGFPGRAGRPGLPGIHGLQGDKGEPGYSEGTRPGPPGPTGDPGLPGDMGKKGEMGQPGPPGHLGPAGPEGAPGSPGSPGLPGKPGPHGDLGFKGIKGLLGPPGIRGPPGLPGFPGSPGPMGIRGDQGRDGIPGPAGEKGETGLLRAPPGPRGNPGAQGAKGDRGAPGFPGLPGRKGAMGDAGPRGPTGIEGFPGPPGLPGAIIPGQTGNRGPPGSRGSPGAPGPPGPPGSHVIGIKGDKGSMGHPGPKGPPGTAGDMGPPGRLGAPGTPGLPGPRGDPGFQGFPGVKGEKGNPGFLGSIGPPGPIGPKGPPGVRGDPGTLKIISLPGSPGPPGTPGEPGMQGEPGPPGPPGNLGPCGPRGKPGKDGKPGTPGPAGEKGNKGSKGEPGPAGSDGLPGLKGKRGDSGSPATWTTRGFVFTRHSQTTAIPSCPEGTVPLYSGFSFLFVQGNQRAHGQDLGTLGSCLQRFTTMPFLFCNVNDVCNFASRNDYSYWLSTPALMPMNMAPITGRALEPYISRCTVCEGPAIAIAVHSQTTDIPPCPHGWISLWKGFSFIMFTSAGSEGTGQALASPGSCLEEFRASPFLECHGRGTCNYYSNSYSFWLASLNPERMFRKPIPSTVKAGELEKIISRCQVCMKKRH

SEQ ID NO: 5955 - protein, 1690 aa, unidentified
MWSLHIVLMRCSFRLTKSLATGPWSLILILFSVQYVYGSGKKYIGPCGGRDCSVCHCVPEKGSRGPPGPPGPQGPIGPLGAPGPIGLSGEKGMRGDRGPPGAAGDKGDKGPTGVPGFPGLDGIPGHPGPPGPRGKPGMSGHNGSRGDPGFPGGRGALGPGGPLGHPGEKGEKGNSVFILGAVKGIQGDRGDPGLPGLPGSWGAGGPAGPTGYPGEPGLVGPPGQPGRPGLKGNPGVGVKGQMGDPGEVGQQGSPGPTLLVEPPDFCLYKGEKGIKGIPGMVGLPGPPGRKGESGIGAKGEKGIPGFPGPRGDPGSYGSPGFPGLKGELGLVGDPGLFGLIGPKGDPGNRGHPGPPGVLVTPPLPLKGPPGDPGFPGRYGETGDVGPPGPPGLLGRPGEACAGMIGPPGPQGFPGLPGLPGEAGIPGRPDSAPGKPGKPGSPGLPGAPGLQGLPGSSVIYCSVGNPGPQGIKGKVGPPGGRGPKGEKGNEGLCACEPGPMGPPGPPGLPGRQGSKGDLGLPGWLGTKGDPGPPGAEGPPGLPGKHGASGPPGNKGAKGDMVVSRVKGHKGERGPDGPPGFPGQPGSHGRDGHAGEKGDPGPPGDHEDATPGGKGFPGPLGPPGKAGPVGPPGLGFPGPPGERGHPGVPGHPGVRGPDGLKGQKGDTISCNVTYPGRHGPPGFDGPPGPKGFPGPQGAPGLSGSDGHKGRPGTPGTAEIPGPPGFRGDMGDPGFGGEKGSSPVGPPGPPGSPGVNGQKGIPGDPAFGHLGPPGKRGLSGVPGIKGPRGDPGCPGAEGPAGIPGFLGLKGPKGREGHAGFPGVPGPPGHSCERGAPGIPGQPGLPGYPGSPGAPGGKGQPGDVGPPGPAGMKGLPGLPGRPGAHGPPGLPGIPGPFGDDGLPGPPGPKGPRGLPGFPGFPGERGKPGAEGCPGAKGEPGEKGMSGLPGDRGLRGAKGAIGPPGDEGEMAIISQKGTPGEPGPPGDDGFPGERGDKGTPGMQGRRGEPGRYGPPGFHRGEPGEKGQPGPPGPPGPPGSTGLRGFIGFPGLPGDQGEPGSPGPPGFSGIDGARGPKGNKGDPASHFGPPGPKGEPGSPGCPGHFGASGEQGLPGIQGPRGSPGRPGPPGSSGPPGCPGDHGMPGLRGQPGEMGDPGPRGLQGDPGIPGPPGIKGPSGSPGLNGLHGLKGQKGTKGASGLHDVGPPGPVGIPGLKGERGDPGSPGISPPGPRGKKGPPGPPGSSGPPGPAGATGRAPKDIPDPGPPGDQGPPGPDGPRGAPGPPGLPGSVDLLRGEPGDCGLPGPPGPPGPPGPPGYKGFPGCDGKDGQKGPVGFPGPQGPHGFPGPPGEKGLPGPPGRKGPTGLPGPRGEPGPPADVDDCPRIPGLPGAPGMRGPEGAMGLPGMRGPSGPGCKGEPGLDGRRGVDGVPGSPGPPGRKGDTGEDGYPGGPGPPGPIGDPGPKGFGPGYLGGFLLVLHSQTDQEPTCPLGMPRLWTGYSLLYLEGQEKAHNQDLGLAGSCLPVFSTLPFAYCNIHQVCHYAQRNDRSYWLASAAPLPMMPLSEEAIRPYVSRCAVCEAPAQAVAVHSQDQSIPPCPQTWRSLWIGYSFLMHTGAGDQGGGQALMSPGSCLEDFRAAPFLECQGRQGTCHFFANKYSFWLTTVKADLQFSSAPAPDTLKESQAQRQKISRCQVCVKYS

SEQ ID NO: 5956 - protein, 1685 aa, unidentified
MKLRGVSLAAGLFLLALSLWGQPAEAAACYGCSPGSKCDCSGIKGEKGERGFPGLEGHPGLPGFPGPEGPPGPRGQKGDDGIPGPPGPKGIRGPPGLPGFPGTPGLPGMPGHDGAPGPQGIPGCNGTKGERGFPGSPGFPGLQGPPGPPGIPGMKGEPGSIIMSSLPGPKGNPGYPGPPGIQGLPGPTGIPGPIGPPGPPGLMGPPGPPGLPGPKGNMGLNFQGPKGEKGEQGLQGPPGPPGQISEQKRPIDVEFQKGDQGLPGDRGPPGPPGIRGPPGPPGGEKGEKGEQGEPGKRGKPGKDGENGQPGIPGLPGDPGYPGEPGRDGEKGQKGDTGPPGPPGLVIPRPGTGITIGEKGNIGLPGLPGEKGERGFPGIQGPPGLPGPPGAAVMGPPGPPGFPGERGQKGDEGPPGISIPGPPGLDGQPGAPGLPGPPGPAGPHIPPSDEICEPGPPGPPGSPGDKGLQGEQGVKGDKGDTCFNCIGTGISGPPGQPGLPGLPGPPGSLGFPGQKGEKGQAGATGPKGLPGIPGAPGAPGFPGSKGEPGDILTFPGMKGDKGELGSPGAPGLPGLPGTPGQDGLPGLPGPKGEPGGITFKGERGPPGNPGLPGLPGNIGPMGPPGFGPPGPVGEKGIQGVAGNPGQPGIPGPKGDPGQTITQPGKPGLPGNPGRDGDVGLPGDPGLPGQPGLPGIPGSKGEPGIPGIGLPGPPGPKGFPGIPGPPGAPGTPGRIGLEGPPGPPGFPGPKGEPGFALPGPPGPPGLPGFKGALGPKGDRGFPGPPGPPGRTGLDGLPGPKGDVGPNGQPGPMGPPGLPGIGVQGPPGPPGIPGPIGQPGLHGIPGEKGDPGPPGLDVPGPPGERGSPGIPGAPGPIGPPGSPGLPGKAGASGFPGTKGEMGMMGPPGPPGPLGIPGRSGVPGLKGDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKGEPGLPGYPGNPGIKGSVGDPGLPGLPGTPGAKGQPGLPGFPGTPGPPGPKGISGPPGNPGLPGEPGPVGGGGHPGQPGPPGEKGKPGQDGIPGPAGQKGEPGQPGFGNPGPPGLPGLSGQKGDGGLPGIPGNPGLPGPKGEPGFHGFPGVQGPPGPPGSPGPALEGPKGNPGPQGPPGRPGLPGPEGPPGLPGNGGIKGEKGNPGQPGLPGLPGLKGDQGPPGLQGNPGRPGLNGMKGDPGLPGVPGFPGMKGPSGVPGSAGPEGEPGLIGPPGPPGLPGPSGQSIIIKGDAGPPGIPGQPGLKGLPGPQGPQGLPGPTGPPGDPGRNGLPGFDGAGGRKGDPGLPGQPGTRGLDGPPGPDGLQGPPGPPGTSSVAHGFLITRHSQTTDAPQCPQGTLQVYEGFSLLYVQGNKRAHGQDLGTAGSCLRRFSTMPFMFCNINNVCNFASRNDYSYWLSTPEPMPMSMQPLKGQSIQPFISRCAVCEAPAVVIAVHSQTIQIPHCPQGWDSLWIGYSFMMHTSAGAEGSGQALASPGSCLEEFRSAPFIECHGRGTCNYYANSYSFWLATVDVSDMFSKPQSETLKAGDLRTRISRCQVCMKRT

SEQ ID NO: 5957 - protein, 1691 aa, unidentified
MLINKLWLLLVTLCLTEELAAAGEKSYGKPCGGQDCSGSCQCFPEKGARGRPGPIGIQGPTGPQGFTGSTGLSGLKGERGFPGLLGPYGPKGDKGPMGVPGFLGINGIPGHPGQPGPRGPPGLDGCNGTQGAVGFPGPDGYPGLLGPPGLPGQKGSKGDPVLAPGSFKGMKGDPGLPGLDGITGPQGAPGFPGAVGPAGPPGLQGPPGPPGPLGPDGNMGLGFQGEKGVKGDVGLPGPAGPPPSTGELEFMGFPKGKKGSKGEPGPKGFPGISGPPGFPGLGTTGEKGEKGEKGIPGLPGPRGPMGSEGVQGPPGQQGKKGTLGFPGLNGFQGIEGQKGDIGLPGPDVFIDIDGAVISGNPGDPGVPGLPGLKGDEGIQGLRGPSGVPGLPALSGVPGALGPQGFPGLKGDQGNPGRTTIGAAGLPGRDGLPGPPGPPGPPSPEFETETLHNKESGFPGLRGEQGPKGNLGLKGIKGDSGFCACDGGVPNTGPPGEPGPPGPWGLIGLPGLKGARGDRGSGGAQGPAGAPGLVGPLGPSGPKGKKGEPILSTIQGMPGDRGDSGSQGFRGVIGEPGKDGVPGLPGLPGLPGDGGQGFPGEKGLPGLPGEKGHPGPPGLPGNGLPGLPGPRGLPGDKGKDGLPGQQGLPGSKGITLPCIIPGSYGPSGFPGTPGFPGPKGSRGLPGTPGQPGSSGSKGEPGSPGLVHLPELPGFPGPRGEKGLPGFPGLPGKDGLPGMIGSPGLPGSKGATGDIFGAENGAPGEQGLQGLTGHKGFLGDSGLPGLKGVHGKPGLLGPKGERGSPGTPGQVGQPGTPGSSGPYGIKGKSGLPGAPGFPGISGHPGKKGTRGKKGPPGSIVKKGLPGLKGLPGNPGLVGLKGSPGSPGVAGLPALSGPKGEKGSVGFVGFPGIPGLPGIPGTRGLKGIPGSTGKMGPSGRAGTPGEKGDRGNPGPVGIPSPRRPMSNLWLKGDKGSQGSAGSNGFPGPRGDKGEAGRPGPPGLPGAPGLPGIIKGVSGKPGPPGFMGIRGLPGLKGSSGITGFPGMPGESGSQGIRGSPGLPGASGLPGLKGDNGQTVEISGSPGPKGQPGESGFKGTKGRDGLIGNIGFPGNKGEDGKVGVSGDVGLPGAPGFPGVAGMRGEPGLPGSSGHQGAIGPLGSPGLIGPKGFPGFPGLHGLNGLPGTKGTHGTPGPSITGVPGPAGLPGPKGEKGYPGIGIGAPGKPGLRGQKGDRGFPGLQGPAGLPGAPGISLPSLIAGQPGDPGRPGLDGERGRPGPAGPPGPPGPSSNQGDTGDPGFPGIPGPKGPKGDQGIPGFSGLPGELGLKGMRGEPGFMGTPGKVGPPGDPGFPGMKGKAGPRGSSGLQGDPGQTPTAEAVQVPPGPLGLPGIDGIPGLTGDPGAQGPVGLQGSKGLPGIPGKDGPSGLPGPPGALGDPGLPGLQGPPGFEGAPGQQGPFGMPGMPGQSMRVGYTLVKHSQSEQVPPCPIGMSQLWVGYSLLFVEGQEKAHNQDLGFAGSCLPRFSTMPFIYCNINEVCHYARRNDKSYWLSTTAPIPMMPVSQTQIPQYISRCSVCEAPSQAIAVHSQDITIPQCPLGWRSLWIGYSFLMHTAAGAEGGGQSLVSPGSCLEDFRATPFIECSGARGTCHYFANKYSFWLTTVEERQQFGELPVSETLKAGQLHTRVSRCQVCMKSL

SEQ ID NO: 5958 - protein, 1838 aa, unidentified
MDVHTRWKARSALRPGAPLLPPLLLLLLWAPPPSRAAQPADLLKVLDFHNLPDGITKTTGFCATRRSSKGPDVAYRVTKDAQLSAPTKQLYPASAFPEDFSILTTVKAKKGSQAFLVSIYNEQGIQQIGLELGRSPVFLYEDHTGKPGPEDYPLFRGINLSDGKWHRIALSVHKKNVTLILDCKKKTTKFLDRSDHPMIDINGIIVFGTRILDEEVFEGDIQQLLFVSDHRAAYDYCEHYSPDCDTAVPDTPQSQDPNPDEYYTEGDGEGETYYYEYPYYEDPEDLGKEPTPSKKPVEAAKETTEVPEELTPTPTEAAPMPETSEGAGKEEDVGIGDYDYVPSEDYYTPSPYDDLTYGEGEENPDQPTDPGAGAEIPTSTADTSNSSNPAPPPGEGADDLEGEFTEETIRNLDENYYDPYYDPTSSPSEIGPGMPANQDTIYEGIGGPRGEKGQKGEPAIIEPGMLIEGPPGPEGPAGLPGPPGTMGPTGQVGDPGERGPPGRPGLPGADGLPGPPGTMLMLPFRFGGGGDAGSKGPMVSAQESQAQAILQQARLALRGPAGPMGLTGRPGPVGPPGSGGLKGEPGDVGPQGPRGVQGPPGPAGKPGRRGRAGSDGARGMPGQTGPKGDRGFDGLAGLPGEKGHRGDPGPSGPPGPPGDDGERGDDGEVGPRGLPGEPGPRGLLGPKGPPGPPGPPGVTGMDGQPGPKGNVGPQGEPGPPGQQGNPGAQGLPGPQGAIGPPGEKGPLGKPGLPGMPGADGPPGHPGKEGPPGEKGGQGPPGPQGPIGYPGPRGVKGADGIRGLKGTKGEKGEDGFPGFKGDMGIKGDRGEIGPPGPRGEDGPEGPKGRGGPNGDPGPLGPPGEKGKLGVPGLPGYPGRQGPKGSIGFPGFPGANGEKGGRGTPGKPGPRGQRGPTGPRGERGPRGITGKPGPKGNSGGDGPAGPPGERGPNGPQGPTGFPGPKGPPGPPGKDGLPGHPGQRGETGFQGKTGPPGPPGVVGPQGPTGETGPMGERGHPGPPGPPGEQGLPGLAGKEGTKGDPGPAGLPGKDGPPGLRGFPGDRGLPGPVGALGLKGNEGPPGPPGPAGSPGERGPAGAAGPIGIPGRPGPQGPPGPAGEKGAPGEKGPQGPAGRDGLQGPVGLPGPAGPVGPPGEDGDKGEIGEPGQKGSKGDKGEQGPPGPTGPQGPIGQPGPSGADGEPGPRGQQGLFGQKGDEGPRGFPGPPGPVGLQGLPGPPGEKGETGDVGQMGPPGPPGPRGPSGAPGADGPQGPPGGIGNPGAVGEKGEPGEAGEPGLPGEGGPPGPKGERGEKGESGPSGAAGPPGPKGPPGDDGPKGSPGPVGFPGDPGPPGEPGPAGQDGPPGDKGDDGEPGQTGSPGPTGEPGPSGPPGKRGPPGPAGPEGRQGEKGAKGEAGLEGPPGKTGPIGPQGAPGKPGPDGLRGIPGPVGEQGLPGSPGPDGPPGPMGPPGLPGLKGDSGPKGEKGHPGLIGLIGPPGEQGEKGDRGLPGPQGSSGPKGEQGITGPSGPIGPPGPPGLPGPPGPKGAKGSSGPTGPKGEAGHPGPPGPPGPPGEVIQPLPIQASRTRRNIDASQLLDDGNGENYVDYADGMEEIFGSLNSLKLEIEQMKRPLGTQQNPARTCKDLQLCHPDFPDGEYWVDPNQGCSRDSFKVYCNFTAGGSTCVFPDKKSEGARITSWPKENPGSWFSEFKRGKLLSYVDAEGNPVGVVQMTFLRLLSASAHQNVTYHCYQSVAWQDAATGSYDKALRFLGSNDEEMSYDNNPYIRALVDGCATKKGYQKTVLEIDTPKVEQVPIVDIMFNDFGEASQKFGFEVGPACFMG

SEQ ID NO: 5959 - protein, 1499 aa, unidentified
MMANWAEARPLLILIVLLGQFVSIKAQEEDEDEGYGEEIACTQNGQMYLNRDIWKPAPCQICVCDNGAILCDKIECQDVLDCADPVTPPGECCPVCSQTPGGGNTNFGRGRKGQKGEPGLVPVVTGIRGRPGPAGPPGSQGPRGERGPKGRPGPRGPQGIDGEPGVPGQPGAPGPPGHPSHPGPDGLSRPFSAQMAGLDEKSGLGSQVGLMPGSVGPVGPRGPQGLQGQQGGAGPTGPPGEPGDPGPMGPIGSRGPEGPPGKPGEDGEPGRNGNPGEVGFAGSPGARGFPGAPGLPGLKGHRGHKGLEGPKGEVGAPGSKGEAGPTGPMGAMGPLGPRGMPGERGRLGPQGAPGQRGAHGMPGKPGPMGPLGIPGSSGFPGNPGMKGEAGPTGARGPEGPQGQRGETGPPGPVGSPGLPGAIGTDGTPGAKGPTGSPGTSGPPGSAGPPGSPGPQGSTGPQGIRGQPGDPGVPGFKGEAGPKGEPGPHGIQGPIGPPGEEGKRGPRGDPGTVGPPGPVGERGAPGNRGFPGSDGLPGPKGAQGERGPVGSSGPKGSQGDPGRPGEPGLPGARGLTGNPGVQGPEGKLGPLGAPGEDGRPGPPGSIGIRGQPGSMGLPGPKGSSGDPGKPGEAGNAGVPGQRGAPGKDGEVGPSGPVGPPGLAGERGEQGPPGPTGFQGLPGPPGPPGEGGKPGDQGVPGDPGAVGPLGPRGERGNPGERGEPGITGLPGEKGMAGGHGPDGPKGSPGPSGTPGDTGPPGLQGMPGERGIAGTPGPKGDRGGIGEKGAEGTAGNDGARGLPGPLGPPGPAGPTGEKGEPGPRGLVGPPGSRGNPGSRGENGPTGAVGFAGPQGPDGQPGVKGEPGEPGQKGDAGSPGPQGLAGSPGPHGPNGVPGLKGGRGTQGPPGATGFPGSAGRVGPPGPAGAPGPAGPLGEPGKEGPPGLRGDPGSHGRVGDRGPAGPPGGPGDKGDPGEDGQPGPDGPPGPAGTTGQRGIVGMPGQRGERGMPGLPGPAGTPGKVGPTGATGDKGPPGPVGPPGSNGPVGEPGPEGPAGNDGTPGRDGAVGERGDRGDPGPAGLPGSQGAPGTPGPVGAPGDAGQRGDPGSRGPIGPPGRAGKRGLPGPQGPRGDKGDHGDRGDRGQKGHRGFTGLQGLPGPPGPNGEQGSAGIPGPFGPRGPPGPVGPSGKEGNPGPLGPIGPPGVRGSVGEAGPEGPPGEPGPPGPPGPPGHLTAALGDIMGHYDESMPDPLPEFTEDQAAPDDKNKTDPGVHATLKSLSSQIETMRSPDGSKKHPARTCDDLKLCHSAKQSGEYWIDPNQGSVEDAIKVYCNMETGETCISANPSSVPRKTWWASKSPDNKPVWYGLDMNRGSQFAYGDHQSPNTAITQMTFLRLLSKEASQNITYICKNSVGYMDDQAKNLKKAVVLKGANDLDIKAEGNIRFRYIVLQDTCSKRNGNVGKTVFEYRTQNVARLPIIDLAPVDVGGTDQEFGVEIGPVCFV

SEQ ID NO: 5960 - protein, 1745 aa, unidentified
MGNRRDLGQPRAGLCLLLAALQLLPGTQADPVDVLKALGVQGGQAGVPEGPGFCPQRTPEGDRAFRIGQASTLGIPTWELFPEGHFPENFSLLITLRGQPANQSVLLSIYDERGARQLGLALGPALGLLGDPFRPLPQQVNLTDGRWHRVAVSIDGEMVTLVADCEAQPPVLGHGPRFISIAGLTVLGTQDLGEKTFEGDIQELLISPDPQAAFQACERYLPDCDNLAPAATVAPQGEPETPRPRRKGKGKGRKKGRGRKGKGRKKNKEIWTSSPPPDSAENQTSTDIPKTETPAPNLPPTPTPLVVTSTVTTGLNATILERSLDPDSGTELGTLETKAAREDEEGDDSTMGPDFRAAEYPSRTQFQIFPGAGEKGAKGEPAVIEKGQQFEGPPGAPGPQGVVGPSGPPGPPGFPGDPGPPGPAGLPGIPGIDGIRGPPGTVIMMPFQFAGGSFKGPPVSFQQAQAQAVLQQTQLSMKGPPGPVGLTGRPGPVGLPGHPGLKGEEGAEGPQGPRGLQGPHGPPGRVGKMGRPGADGARGLPGDTGPKGDRGFDGLPGLPGEKGQRGDFGHVGQPGPPGEDGERGAEGPPGPTGQAGEPGPRGLLGPRGSPGPTGRPGVTGIDGAPGAKGNVGPPGEPGPPGQQGNHGSQGLPGPQGLIGTPGEKGPPGNPGIPGLPGSDGPLGHPGHEGPTGEKGAQGPPGSAGPPGYPGPRGVKGTSGNRGLQGEKGEKGEDGFPGFKGDVGLKGDQGKPGAPGPRGEDGPEGPKGQAGQAGEEGPPGSAGEKGKLGVPGLPGYPGRPGPKGSIGFPGPLGPIGEKGKSGKTGQPGLEGERGPPGSRGERGQPGATGQPGPKGDVGQDGAPGIPGEKGLPGLQGPPGFPGPKGPPGHQGKDGRPGHPGQRGELGFQGQTGPPGPAGVLGPQGKTGEVGPLGERGPPGPPGPPGEQGLPGLEGREGAKGELGPPGPLGKEGPAGLRGFPGPKGGPGDPGPTGLKGDKGPPGPVGANGSPGERGPLGPAGGIGLPGQSGSEGPVGPAGKKGSRGERGPPGPTGKDGIPGPLGPLGPPGAAGPSGEEGDKGDVGAPGHKGSKGDKGDAGPPGQPGIRGPAGHPGPPGADGAQGRRGPPGLFGQKGDDGVRGFVGVIGPPGLQGLPGPPGEKGEVGDVGSMGPHGAPGPRGPQGPTGSEGTPGLPGGVGQPGAVGEKGERGDAGDPGPPGAPGIPGPKGDIGEKGDSGPSGAAGPPGKKGPPGEDGAKGSVGPTGLPGDLGPPGDPGVSGIDGSPGEKGDPGDVGGPGPPGASGEPGAPGPPGKRGPSGHMGREGREGEKGAKGEPGPDGPPGRTGPMGARGPPGRVGPEGLRGIPGPVGEPGLLGAPGQMGPPGPLGPSGLPGLKGDTGPKGEKGHIGLIGLIGPPGEAGEKGDQGLPGVQGPPGPKGDPGPPGPIGSLGHPGPPGVAGPLGQKGSKGSPGSMGPRGDTGPAGPPGPPGAPAELHGLRRRRRFVPVPLPVVEGGLEEVLASLTSLSLELEQLRRPPGTAERPGLVCHELHRNHPHLPDGEYWIDPNQGCARDSFRVFCNFTAGGETCLYPDKKFEIVKLASWSKEKPGGWYSTFRRGKKFSYVDADGSPVNVVQLNFLKLLSATARQNFTYSCQNAAAWLDEATGDYSHSARFLGTNGEELSFNQTTAATVSVPQDGCRLRKGQTKTLFEFSSSRAGFLPLWDVAATDFGQTNQKFGFELGPVCFSS

SEQ ID NO: 5961 - protein, 1028 aa, unidentified
MRAARALLPLLLQACWTAAQDEPETPRAVAFQDCPVDLFFVLDTSESVALRLKPYGALVDKVKSFTKRFIDNLRDRYYRCDRNLVWNAGALHYSDEVEIIQGLTRMPGGRDALKSSVDAVKYFGKGTYTDCAIKKGLEQLLVGGSHLKENKYLIVVTDGHPLEGYKEPCGGLEDAVNEAKHLGVKVFSVAITPDHLEPRLSIIATDHTYRRNFTAADWGQSRDAEEAISQTIDTIVDMIKNNVEQVCCSFECQPARGPPGLRGDPGFEGERGKPGLPGEKGEAGDPGRPGDLGPVGYQGMKGEKGSRGEKGSRGPKGYKGEKGKRGIDGVDGVKGEMGYPGLPGCKGSPGFDGIQGPPGPKGDPGAFGLKGEKGEPGADGEAGRPGSSGPSGDEGQPGEPGPPGEKGEAGDEGNPGPDGAPGERGGPGERGPRGTPGTRGPRGDPGEAGPQGDQGREGPVGVPGDPGEAGPIGPKGYRGDEGPPGSEGARGAPGPAGPPGDPGLMGERGEDGPAGNGTEGFPGFPGYPGNRGAPGINGTKGYPGLKGDEGEAGDPGDDNNDIAPRGVKGAKGYRGPEGPQGPPGHQGPPGPDECEILDIIMKMCSCCECKCGPIDLLFVLDSSESIGLQNFEIAKDFVVKVIDRLSRDELVKFEPGQSYAGVVQYSHSQMQEHVSLRSPSIRNVQELKEAIKSLQWMAGGTFTGEALQYTRDQLLPPSPNNRIALVITDGRSDTQRDTTPLNVLCSPGIQVVSVGIKDVFDFIPGSDQLNVISCQGLAPSQGRPGLSLVKENYAELLEDAFLKNVTAQICIDKKCPDYTCPITFSSPADITILLDGSASVGSHNFDTTKRFAKRLAERFLTAGRTDPAHDVRVAVVQYSGTGQQRPERASLQFLQNYTALASAVDAMDFINDATDVNDALGYVTRFYREASSGAAKKRLLLFSDGNSQGATPAAIEKAVQEAQRAGIEIFVVVVGRQVNEPHIRVLVTGKTAEYDVAYGESHLFRVPSYQALLRGVFHQTVSRKVALG

SEQ ID NO: 5962 - protein, 1019 aa, unidentified
MLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNSGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIAKDPKSETGTRVGVVQYSHEGTFEAIQLDDERIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPDPQIVCPDLPCQTELSVAQCTQRPVDIVFLLDGSERLGEQNFHKARRFVEQVARRLTLARRDDDPLNARVALLQFGGPGEQQVAFPLSHNLTAIHEALETTQYLNSFSHVGAGVVHAINAIVRSPRGGARRHAELSFVFLTDGVTGNDSLHESAHSMRKQNVVPTVLALGSDVDMDVLTTLSLGDRAAVFHEKDYDSLAQPGFFDRFIRWIC

SEQ ID NO: 5963 - protein, 3177 aa, unidentified
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPCCYGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKMATVRPPVAVKPATAAKPVAAKPAAVRPPAAAAAKPVATKPEVPRPQAAKPAATKPATTKPMVKMSREVQVFEITENSAKLHWERAEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 5964 - protein, 2615 aa, unidentified
MKILLIIFVLIIWTETLADQSPGPGPVYADVVFLVDSSDHLGPKSFPFVKTFINKMINSLPIEANKYRVALAQYSDEFHSEFHLSTFKGRSPMLNHLKKNFQFIGGSLQIGKALQEAHRTYFSAPINGRDRKQFPPILVVLASAESEDEVEEASKALQKDGVKIISVGVQKASEENLKAMATSHFHFNLRTIRDLSTFSQNMTQIIKDVTKYKEGAVDADMQVHFPISCQKDSLADLVFLVDESLGTGGNLRHLQTFLENITSSMDVKENCMRLGLMSYSNSAKTISFLKSSTTQSEFQQQIKNLSIQVGKSNTGAAIDQMRRDGFSESYGSRRAQGVPQIAVLVTHRPSDDEVHDAALNLRLEDVNVFALSIQGANNTQLEEIVSYPPEQTISTLKSYADLETYSTKFLKKLQNEIWSQISTYAEQRNLDKTGCVDTKEADIHFLIDGSSSIQEKQFEQIKRFMLEVTEMFSIGPDKVRVGVVQYSDDTEVEFYITDYSNDIDLRKAIFNIKQLTGGTYTGKALDYILQIIKNGMKDRMSKVPCYLIVLTDGMSTDRVVEPAKRLRAEQITVHAVGIGAANKIELQEIAGKEERVSFGQNFDALKSIKNEVVREICAEKGCEDMKADIMFLVDSSWSIGNENFRKMKIFMKNLLTKIQIGADKTQIGVVQFSDKTKEEFQLNRYFTQQEISDAIDRMSLINEGTLTGKALNFVGQYFTHSKGARLGAKKFLILITDGVAQDDVRDPARILRGKDVTIFSVGVYNANRSQLEEISGDSSLVFHVENFDHLKALERKLIFRVCALHDCKRITLLDVVFVLDHSGSIKKQYQDHMINLTIHLVKKADVGRDRVQFGALKYSDQPNILFYLNTYSNRSAIIENLRKRRDTGGNTYTAKALKHANALFTEEHGSRIKQNVKQMLIVITDGESHDHDQLNDTALELRNKGITIFAVGVGKANQKELEGMAGNKNNTIYVDNFDKLKDVFTLVQERMCTEAPEVCHLQEADVIFLCDGSDRVSNSDFVTMTTFLSDLIDNFDIQSQRMKIGMAQFGSNYQSIIELKNSLTKTQWKTQIQNVSKSGGFPRIDFALKKVSNMFNLHAGGRRNAGVPQTLVVITSGDPRYDVADAVKTLKDLGICVLVLGIGDVYKEHLLPITGNSEKIITFQDFDKLKNVDVKKRIIREICQSCGKTNCFMDIVVGFDISTHVQGQPLFQGHPQLESYLPGILEDISSIKGVSCGAGTEAQVSLAFKVNSDQGFPAKFQIYQKAVFDSLLQVNVSGPTHLNAQFLRSLWDTFKDKSASRGQVLLIFSDGLQSESNIMLENQSDRLREAGLDALLVVSLNTTAHHEFSSFEFGKRFDYRTHLTIGMRELGKKLSQYLGNIAERTCCCTFCKCPGIPGPHGTRGLQAMKGSQGLKGSRGHRGEDGNPGVRGDTGPQGDKGIAGCPGAWGQKGLKGFSGPKGGHGDDGIDGLDGEEGCHGFPGIKGEKGDPGSQGSPGSRGAPGQYGEKGFPGDPGNPGQNNNIKGQKGSKGEQGRQGRSGQKGVQGSPSSRGSRGREGQRGLRGVSGEPGNPGPTGTLGAEGLQGPQGSQGNPGRKGEKGSQGQKGPQGSPGLMGAKGSTGRPGLLGKKGEPGLPGDLGPVGQTGQRGRQGDSGIPGYGQMGRKGVKGPRGFPGDAGQKGDIGNPGIPGGPGPKGFRGLALTVGLKGEEGSRGLPGPPGQRGIKGMAGQPVYSQCDLIRFLREHSPCWKEKCPAYPTELVFALDNSYDVTEESFNKTRDIITSIVNDLNIRENNCPVGARVAMVSYNSGTSYLIRWSDYNRKKQLLQQLSQIKYQDTTEPRDVGNAMRFVTRNVFKRTYAGANVRRVAVFFSNGQTASRSSIITATMEFSALDISPTVFAFDERVFLEAFGFDNTGTFQVIPVPPNGENQTLERLRRCALCYDKCFPNACIREAFLPEDSYMDVVFLIDNSRNIAKDEFKAVKALVSSVIDNFNIASDPLISDSGDRIALLSYSPWESSRRKMGTVKTEFDFITYDNQLLMKNHIQTSFQQLNGEATIGRALLWTTENLFPETPYLRKHKVIFVVSAGENYERKEFVKMMALRAKCQGYVIFVISLGSTRKDDMEELASYPLDQHLIQLGRIHKPDLNYIAKFLKPFLYSVRRGFNQYPPPMLEDACRLINLGGENIQNDGFQFVTELQEDFLGGNGFIGQELNSGRESPFVKTEDNGSDYLVYLPSQMFEPQKLMINYEKDQKSAEIASLTSGHENYGRKEEPDHTYEPGDVSLQEYYMDVAFLIDASQRVGSDEFKEVKAFITSVLDYFHIAPTPLTSTLGDRVAVLSYSPPGYMPNTEECPVYLEFDLVTYNSIHQMKHHLQDSQQLNGDVFIGHALQWTIDNVFVGTPNLRKNKVIFVISAGETNSLDKDVLRNVSLRAKCQGYSIFVFSFGPKHNDKELEELASHPLDHHLVQLGRTHKPDWNYIIKFVKPFVHLIRRAINKYPTEDMKATCVNMTSPNPENGGTENTVLLLPGIYEIKTENGDLFDEFDSQAQHLLVLGNNHSSGSETATDLMQKLYLLFSTEKLAMKDKEKAHLEEISALVVDKQQEKEDKEMEATDI

SEQ ID NO: 5965 - protein, 2263 aa, unidentified
MMLLILFLVIICSHISVNQDSGPEYADVVFLVDSSDRLGSKSFPFVKMFITKMISSLPIEADKYRVALAQYSDKLHSEFHLSTFKGRSPMLNHLRKNFGFIGGSLQIGKALQEAHRTYFSAPANGRDKKQFPPILVVLASSESEDNVEEASKALRKDGVKIISVGVQKASEENLKAMATSQFHFNLRTVRDLSMFSQNMTHIIKDVIKYKEGAVDDIFVEACQGPSMADVVFLLDMSINGSEENFDYLKGFLEESVSALDIKENCMRVGLVAYSNETKVINSLSMGINKSEVLQHIQNLSPRTGKAYTGAAIKKLRKEVFSARNGSRKNQGVPQIAVLVTHRDSEDNVTKAAVNLRREGVTIFTLGIEGASDTQLEKIASHPAEQYVSKLKTFADLAAHNQTFLKKLRNQITHTVSVFSERTETLKSGCVDTEEADIYLLIDGSGSTQATDFHEMKTFLSEVVGMFNIAPHKVRVGAVQYADSWDLEFEINKYSNKQDLGKAIENIRQMGGNTNTGAALNFTLSLLQKAKKQRGNKVPCHLVVLTNGMSKDSILEPANRLREEHIRVYAIGIKEANQTQLREIAGEEKRVYYVHDFDALKDIRNQVVQEICTEEACKEMKADIMFLVDSSGSIGPENFSKMKTFMKNLVSKSQIGPDRVQIGVVQFSDINKEEFQLNRFMSQSDISNAIDQMAHIGQTTLTGSALSFVSQYFSPTKGARPNIRKFLILITDGEAQDIVKEPAVVLRQEGVIIYSVGVFGSNVTQLEEISGRPEMVFYVENFDILQRIEDDLVFGICSPREECKRIEVLDVVFVIDSSGSIDYDEYNIMKDFMIGLVKKADVGKNQVRFGALKYADDPEVLFYLDDFGTKLEVISVLQNDQAMGGSTYTAEALGFSDHMFTEARGSRLNKGVPQVLIVITDGESHDADKLNATAKALRDKGILVLAVGIDGANPVELLAMAGSSDKYFFVETFGGLKGIFSDVTASVCNSSKVDCEIDKVDLVFLMDGSTSIQPNDFKKMKEFLASVVQDFDVSLNRVRIGAAQFSDTYHPEFPLGTFIGEKEISFQIENIKQIFGNTHIGAALREVEHYFRPDMGSRINTGTPQVLLVLTDGQSQDEVAQAAEALRHRGIDIYSVGIGDVDDQQLIQITGTAEKKLTVHNFDELKKVNKRIVRNICTTAGESNCFVDVVVGFDVSTQEKGQTLLEGQPWMETYLQDILRAISSLNGVSCEVGTETQVSVAFQVTNAMEKYSPKFEIYSENILNSLKDITVKGPSLLNANLLDSLWDTFQNKSAARGKVVLLFSDGLDDDVEKLEQKSDELRKEGLNALITVALDGPADSSDLADLPYIEFGKGFEYRTQLSIGMRELGSRLSKQLVNVAERTCCCLFCKCIGGDGTMGDPGPPGKRGPPGFKGSEGYLGEEGIAGERGAPGPVGEQGTKGCYGTKGPKGNRGLNGQEGEVGENGIDGLNGEQGDNGLPGRKGEKGDEGSQGSPGKRGTPGDRGAKGLRGDPGAPGVDSSIEGPTGLKGERGRQGRRGWPGPPGTPGSRRKTAAHGRRGHTGPQGTAGIPGPDGLEGSLGLKGPQGPRGEAGVKGEKGGVGSKGPQGPPGPGGEAGNQGRLGSQGNKGEPGDLGEKGAVGFPGPRGLQGNDGSPGYGSVGRKGAKGQEGFPGESGPKGEIGDPGGPGETGLKGARGKMISAGLPGEMGSPGEPGPPGRKGVKGAKGLASFSTCELIQYVRDRSPGRHGKPECPVHPTELVFALDHSRDVTEQEFERMKEMMAFLVRDIKVRENSCPVGAHIAILSYNSHARHLVRFSDAYKKSQLLREIETIPYERSSASREIGRAMRFISRNVFKRTLPGAHTRKIATFFSSGQSADAHSITTAAMEFGALEIIPVVITFSNVPSVRRAFAIDDTGTFQVIVVPSGADYIPALERLQRCTFCYDVCKPDASCDQARPPPVQSYMDAAFLLDASRNMGSAEFEDIRAFLGALLDHFEITPEPETSVTGDRVALLSHAPPDFLPNTQKSPVRAEFNLTTYRSKRLMKRHVHESVKQLNGDAFIGHALQWTLDNVFLSTPNLRRNKVIFVISAGETSHLDGEILKKESLRAKCQGYALFVFSLGPIWDDKELEDLASHPLDHHLVQLGRIHKPDHSYGVKFVKSFINSIRRAINKYPPINLKIKCNRLNSIDPKQPPRPFRSFVPGPLKATLKEDVLQKAKFFQDKKYLSRVARSGRDDAIQNFMRSTSHTFKNGRMIESAPKQHD

SEQ ID NO: 5966 - protein, 2944 aa, unidentified
MTLRLLVAALCAGILAEAPRVRAQHRERVTCTRLYAADIVFLLDGSSSIGRSNFREVRSFLEGLVLPFSGAASAQGVRFATVQYSDDPRTEFGLDALGSGGDVIRAIRELSYKGGNTRTGAAILHVADHVFLPQLARPGVPKVCILITDGKSQDLVDTAAQRLKGQGVKLFAVGIKNADPEELKRVASQPTSDFFFFVNDFSILRTLLPLVSRRVCTTAGGVPVTRPPDDSTSAPRDLVLSEPSSQSLRVQWTAASGPVTGYKVQYTPLTGLGQPLPSERQEVNVPAGETSVRLRGLRPLTEYQVTVIALYANSIGEAVSGTARTTALEGPELTIQNTTAHSLLVAWRSVPGATGYRVTWRVLSGGPTQQQELGPGQGSVLLRDLEPGTDYEVTVSTLFGRSVGPATSLMARTDASVEQTLRPVILGPTSILLSWNLVPEARGYRLEWRRETGLEPPQKVVLPSDVTRYQLDGLQPGTEYRLTLYTLLEGHEVATPATVVPTGPELPVSPVTDLQATELPGQRVRVSWSPVPGATQYRIIVRSTQGVERTLVLPGSQTAFDLDDVQAGLSYTVRVSARVGPREGSASVLTVRREPETPLAVPGLRVVVSDATRVRVAWGPVPGASGFRISWSTGSGPESSQTLPPDSTATDITGLQPGTTYQVAVSVLRGREEGPAAVIVARTDPLGPVRTVHVTQASSSSVTITWTRVPGATGYRVSWHSAHGPEKSQLVSGEATVAELDGLEPDTEYTVHVRAHVAGVDGPPASVVVRTAPEPVGRVSRLQILNASSDVLRITWVGVTGATAYRLAWGRSEGGPMRHQILPGNTDSAEIRGLEGGVSYSVRVTALVGDREGTPVSIVVTTPPEAPPALGTLHVVQRGEHSLRLRWEPVPRAQGFLLHWQPEGGQEQSRVLGPELSSYHLDGLEPATQYRVRLSVLGPAGEGPSAEVTARTESPRVPSIELRVVDTSIDSVTLAWTPVSRASSYILSWRPLRGPGQEVPGSPQTLPGISSSQRVTGLEPGVSYIFSLTPVLDGVRGPEASVTQTPVCPRGLADVVFLPHATQDNAHRAEATRRVLERLVLALGPLGPQAVQVGLLSYSHRPSPLFPLNGSHDLGIILQRIRDMPYMDPSGNNLGTAVVTAHRYMLAPDAPGRRQHVPGVMVLLVDEPLRGDIFSPIREAQASGLNVVMLGMAGADPEQLRRLAPGMDSVQTFFAVDDGPSLDQAVSGLATALCQASFTTQPRPEPCPVYCPKGQKGEPGEMGLRGQVGPPGDPGLPGRTGAPGPQGPPGSATAKGERGFPGADGRPGSPGRAGNPGTPGAPGLKGSPGLPGPRGDPGERGPRGPKGEPGAPGQVIGGEGPGLPGRKGDPGPSGPPGPRGPLGDPGPRGPPGLPGTAMKGDKGDRGERGPPGPGEGGIAPGEPGLPGLPGSPGPQGPVGPPGKKGEKGDSEDGAPGLPGQPGSPGEQGPRGPPGAIGPKGDRGFPGPLGEAGEKGERGPPGPAGSRGLPGVAGRPGAKGPEGPPGPTGRQGEKGEPGRPGDPAVVGPAVAGPKGEKGDVGPAGPRGATGVQGERGPPGLVLPGDPGPKGDPGDRGPIGLTGRAGPPGDSGPPGEKGDPGRPGPPGPVGPRGRDGEVGEKGDEGPPGDPGLPGKAGERGLRGAPGVRGPVGEKGDQGDPGEDGRNGSPGSSGPKGDRGEPGPPGPPGRLVDTGPGAREKGEPGDRGQEGPRGPKGDPGLPGAPGERGIEGFRGPPGPQGDPGVRGPAGEKGDRGPPGLDGRSGLDGKPGAAGPSGPNGAAGKAGDPGRDGLPGLRGEQGLPGPSGPPGLPGKPGEDGKPGLNGKNGEPGDPGEDGRKGEKGDSGASGREGRDGPKGERGAPGILGPQGPPGLPGPVGPPGQGFPGVPGGTGPKGDRGETGSKGEQGLPGERGLRGEPGSVPNVDRLLETAGIKASALREIVETWDESSGSFLPVPERRRGPKGDSGEQGPPGKEGPIGFPGERGLKGDRGDPGPQGPPGLALGERGPPGPSGLAGEPGKPGIPGLPGRAGGVGEAGRPGERGERGEKGERGEQGRDGPPGLPGTPGPPGPPGPKVSVDEPGPGLSGEQGPPGLKGAKGEPGSNGDQGPKGDRGVPGIKGDRGEPGPRGQDGNPGLPGERGMAGPEGKPGLQGPRGPPGPVGGHGDPGPPGAPGLAGPAGPQGPSGLKGEPGETGPPGRGLTGPTGAVGLPGPPGPSGLVGPQGSPGLPGQVGETGKPGAPGRDGASGKDGDRGSPGVPGSPGLPGPVGPKGEPGPTGAPGQAVVGLPGAKGEKGAPGGLAGDLVGEPGAKGDRGLPGPRGEKGEAGRAGEPGDPGEDGQKGAPGPKGFKGDPGVGVPGSPGPPGPPGVKGDLGLPGLPGAPGVVGFPGQTGPRGEMGQPGPSGERGLAGPPGREGIPGPLGPPGPPGSVGPPGASGLKGDKGDPGVGLPGPRGERGEPGIRGEDGRPGQEGPRGLTGPPGSRGERGEKGDVGSAGLKGDKGDSAVILGPPGPRGAKGDMGERGPRGLDGDKGPRGDNGDPGDKGSKGEPGDKGSAGLPGLRGLLGPQGQPGAAGIPGDPGSPGKDGVPGIRGEKGDVGFMGPRGLKGERGVKGACGLDGEKGDKGEAGPPGRPGLAGHKGEMGEPGVPGQSGAPGKEGLIGPKGDRGFDGQPGPKGDQGEKGERGTPGIGGFPGPSGNDGSAGPPGPPGSVGPRGPEGLQGQKGERGPPGERVVGAPGVPGAPGERGEQGRPGPAGPRGEKGEAALTEDDIRGFVRQEMSQHCACQGQFIASGSRPLPSYAADTAGSQLHAVPVLRVSHAEEEERVPPEDDEYSEYSEYSVEEYQDPEAPWDSDDPCSLPLDEGSCTAYTLRWYHRAVTGSTEACHPFVYGGCGGNANRFGTREACERRCPPRVVQSQGTGTAQD

SEQ ID NO: 5967 - protein, 744 aa, unidentified
MAVLPGPLQLLGVLLTISLSSIRLIQAGAYYGIKPLPPQIPPQMPPQIPQYQPLGQQVPHMPLAKDGLAMGKEMPHLQYGKEYPHLPQYMKEIQPAPRMGKEAVPKKGKEIPLASLRGEQGPRGEPGPRGPPGPPGLPGHGIPGIKGKPGPQGYPGVGKPGMPGMPGKPGAMGMPGAKGEIGQKGEIGPMGIPGPQGPPGPHGLPGIGKPGGPGLPGQPGPKGDRGPKGLPGPQGLRGPKGDKGFGMPGAPGVKGPPGMHGPPGPVGLPGVGKPGVTGFPGPQGPLGKPGAPGEPGPQGPIGVPGVQGPPGIPGIGKPGQDGIPGQPGFPGGKGEQGLPGLPGPPGLPGIGKPGFPGPKGDRGMGGVPGALGPRGEKGPIGAPGIGGPPGEPGLPGIPGPMGPPGAIGFPGPKGEGGIVGPQGPPGPKGEPGLQGFPGKPGFLGEVGPPGMRGLPGPIGPKGEAGQKGVPGLPGVPGLLGPKGEPGIPGDQGLQGPPGIPGIGGPSGPIGPPGIPGPKGEPGLPGPPGFPGIGKPGVAGLHGPPGKPGALGPQGQPGLPGPPGPPGPPGPPAVMPPTPPPQGEYLPDMGLGIDGVKPPHAYGAKKGKNGGPAYEMPAFTAELTAPFPPVGAPVKFNKLLYNGRQNYNPQTGIFTCEVPGVYYFAYHVHCKGGNVWVALFKNNEPVMYTYDEYKKGFLDQASGSAVLLLRPGDRVFLQMPSEQAAGLYAGQYVHSSFSGYLLYPM

SEQ ID NO: 5968 - protein, 703 aa, unidentified
MLGTLTPLSSLLLLLLVLVLGCGPRASSGGGAGGAAGYAPVKYIQPMQKGPVGPPFREGKGQYLEMPLPLLPMDLKGEPGPPGKPGPRGPPGPPGFPGKPGMGKPGLHGQPGPAGPPGFSRMGKAGPPGLPGKVGPPGQPGLRGEPGIRGDQGLRGPPGPPGLPGPSGITIPGKPGAQGVPGPPGFQGEPGPQGEPGPPGDRGLKGDNGVGQPGLPGAPGQGGAPGPPGLPGPAGLGKPGLDGLPGAPGDKGESGPPGVPGPRGEPGAVGPKGPPGVDGVGVPGAAGLPGPQGPSGAKGEPGTRGPPGLIGPTGYGMPGLPGPKGDRGPAGVPGLLGDRGEPGEDGEPGEQGPQGLGGPPGLPGSAGLPGRRGPPGPKGEAGPGGPPGVPGIRGDQGPSGLAGKPGVPGERGLPGAHGPPGPTGPKGEPGFTGRPGGPGVAGALGQKGDLGLPGQPGLRGPSGIPGLQGPAGPIGPQGLPGLKGEPGLPGPPGEGRAGEPGTAGPTGPPGVPGSPGITGPPGPPGPPGPPGAPGAFDETGIAGLHLPNGGVEGAVLGKGGKPQFGLGELSAHATPAFTAVLTSPFPASGMPVKFDRTLYNGHSGYNPATGIFTCPVGGVYYFAYHVHVKGTNVWVALYKNNVPATYTYDEYKKGYLDQASGGAVLQLRPNDQVWVQMPSDQANGLYSTEYIHSSFSGFLLCPT

SEQ ID NO: 5969 - protein, 921 aa, unidentified
MKTCWKIPVFFFVCSFLEPWASAAVKRRPRFPVNSNSNGGNELCPKIRIGQDDLPGFDLISQFQVDKAASRRAIQRVVGSATLQVAYKLGNNVDFRIPTRNLYPSGLPEEYSFLTTFRMTGSTLKKNWNIWQIQDSSGKEQVGIKINGQTQSVVFSYKGLDGSLQTAAFSNLSSLFDSQWHKIMIGVERSSATLFVDCNRIESLPIKPRGPIDIDGFAVLGKLADNPQVSVPFELQWMLIHCDPLRPRRETCHELPARITPSQTTDERGPPGEQGPPGPPGPPGVPGIDGIDGDRGPKGPPGPPGPAGEPGKPGAPGKPGTPGADGLTGPDGSPGSIGSKGQKGEPGVPGSRGFPGRGIPGPPGPPGTAGLPGELGRVGPVGDPGRRGPPGPPGPPGPRGTIGFHDGDPLCPNACPPGRSGYPGLPGMRGHKGAKGEIGEPGRQGHKGEEGDQGELGEVGAQGPPGAQGLRGITGIVGDKGEKGARGLDGEPGPQGLPGAPGDQGQRGPPGEAGPKGDRGAEGARGIPGLPGPKGDTGLPGVDGRDGIPGMPGTKGEPGKPGPPGDAGLQGLPGVPGIPGAKGVAGEKGSTGAPGKPGQMGNSGKPGQQGPPGEVGPRGPQGLPGSRGELGPVGSPGLPGKLGSLGSPGLPGLPGPPGLPGMKGDRGVVGEPGPKGEQGASGEEGEAGERGELGDIGLPGPKGSAGNPGEPGLRGPEGSRGLPGVEGPRGPPGPRGVQGEQGATGLPGVQGPPGRAPTDQHIKQVCMRVIQEHFAEMAASLKRPDSGATGLPGRPGPPGPPGPPGENGFPGQMGIRGLPGIKGPPGALGLRGPKGDLGEKGERGPPGRGPNGLPGAIGLPGDPGPASYGRNGRDGERGPPGVAGIPGVPGPPGPPGLPGFCEPASCTMQAGQRAFNKGPDP

SEQ ID NO: 5970 - protein, 689 aa, unidentified
MAAATASPRSLLVLLQVVVLALAQIRGPPGERGPPGPPGPPGVPGSDGIDGDNGPPGKAGPPGPKGEPGKAGPDGPDGKPGIDGLTGAKGEPGPMGIPGVKGQPGLPGPPGLPGPGFAGPPGPPGPVGLPGEIGIRGPKGDPGPDGPSGPPGPPGKPGRPGTIQGLEGSADFLCPTNCPPGMKGPPGLQGVKGHAGKRGILGDPGHQGKPGPKGDVGASGEQGIPGPPGPQGIRGYPGMAGPKGETGPHGYKGMVGAIGATGPPGEEGPRGPPGRAGEKGDEGSPGIRGPQGITGPKGATGPPGINGKDGTPGTPGMKGSAGQAGQPGSPGHQGLAGVPGQPGTKGGPGDQGEPGPQGLPGFSGPPGKEGEPGPRGEIGPQGIMGQKGDQGERGPVGQPGPQGRQGPKGEQGPPGIPGPQGLPGVKGDKGSPGKTGPRGKVGDPGVAGLPGEKGEKGESGEPGPKGQQGVRGEPGYPGPSGDAGAPGVQGYPGPPGPRGLAGNRGVPGQPGRQGVEGRDATDQHIVDVALKMLQEQLAEVAVSAKREALGAVGMMGPPGPPGPPGYPGKQGPHGHPGPRGVPGIVGAVGQIGNTGPKGKRGEKGDPGEVGRGHPGMPGPPGIPGLPGRPGQAINGKDGDRGSPGAPGEAGRPGLPGPVGLPGFCEPAACLGASAYASARLTEPGSIKGP

SEQ ID NO: 5971 - protein, 684 aa, unidentified
MAGPRACAPLLLLLLLGELLAAAGAQRVGLPGPPGPPGPPGKPGQDGIDGEAGPPGLPGPPGPKGAPGKPGKPGEAGLPGLPGVDGLTGRDGPPGPKGAPGERGSLGPPGPPGLGGKGLPGPPGEAGVSGPPGGIGLRGPPGPSGLPGLPGPPGPPGPPGHPGVLPEGATDLQCPSICPPGPPGPPGMPGFKGPTGYKGEQGEVGKDGEKGDPGPPGPAGLPGSVGLQGPRGLRGLPGPLGPPGDRGPIGFRGPPGIPGAPGKAGDRGERGPEGFRGPKGDLGRPGPKGTPGVAGPSGEPGMPGKDGQNGVPGLDGQKGEAGRNGAPGEKGPNGLPGLPGRAGSKGEKGERGRAGELGEAGPSGEPGVPGDAGMPGERGEAGHRGSAGALGPQGPPGAPGVRGFQGQKGSMGDPGLPGPQGLRGDVGDRGPGGAAGPKGDQGIAGSDGLPGDKGELGPSGLVGPKGESGSRGELGPKGTQGPNGTSGVQGVPGPPGPLGLQGVPGVPGITGKPGVPGKEASEQRIRELCGGMISEQIAQLAAHLRKPLAPGSIGRPGPAGPPGPPGPPGSIGHPGARGPPGYRGPTGELGDPGPRGNQGDRGDKGAAGAGLDGPEGDQGPQGPQGVPGTSKDGQDGAPGEPGPPGDPGLPGAIGAQGTPGICDTSACQGAVLGGVGEKSGSRSS

SEQ ID NO: 5972 - protein, 277 aa, unidentified
MNGFASLLRRNQFILLVLFLLQIQSLGLDIDSRPTAEVCATHTISPGPKGDDGEKGDPGEEGKHGKVGRMGPKGIKGELGDMGDQGNIGKTGPIGKKGDKGEKGLLGIPGEKGKAGTVCDCGRYRKFVGQLDISIARLKTSMKFVKNVIAGIRETEEKFYYIVQEEKNYRESLTHCRIRGGMLAMPKDEAANTLIADYVAKSGFFRVFIGVNDLEREGQYMFTDNTPLQNYSNWNEGEPSDPYGHEDCVEMLSSGRWNDTECHLTMYFVCEFIKKKK

SEQ ID NO: 5973 - protein, 271 aa, unidentified
MRGNLALVGVLISLAFLSLLPSGHPQPAGDDACSVQILVPGLKGDAGEKGDKGAPGRPGRVGPTGEKGDMGDKGQKGSVGRHGKIGPIGSKGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGLARVFIGINDLEKEGAFVYSDHSPMRTFNKWRSGEPNNAYDEEDCVEMVASGGWNDVACHTTMYFMCEFDKENM

SEQ ID NO: 5974 - protein, 622 aa, unidentified
MAAAPRAGRRRGQPLLALLLLLLAPLPPGAPPGADAYFPEERWSPESPLQAPRVLIALLARNAAHALPTTLGALERLRHPRERTALWVATDHNMDNTSTVLREWLVAVKSLYHSVEWRPAEEPRSYPDEEGPKHWSDSRYEHVMKLRQAALKSARDMWADYILFVDADNLILNPDTLSLLIAENKTVVAPMLDSRAAYSNFWCGMTSQGYYKRTPAYIPIRKRDRRGCFAVPMVHSTFLIDLRKAASRNLAFYPPHPDYTWSFDDIIVFAFSCKQAEVQMYVCNKEEYGFLPVPLRAHSTLQDEAESFMHVQLEVMVKHPPAEPSRFISAPTKTPDKMGFDEVFMINLRRRQDRRERMLRALQAQEIECRLVEAVDGKAMNTSQVEALGIQMLPGYRDPYHGRPLTKGELGCFLSHYNIWKEVVDRGLQKSLVFEDDLRFEIFFKRRLMNLMRDVEREGLDWDLIYVGRKRMQVEHPEKAVPRVRNLVEADYSYWTLAYVISLQGARKLLAAEPLSKMLPVDEFLPVMFDKHPVSEYKAHFSLRNLHAFSVEPLLIYPTHYTGDDGYVSDTETSVVWNNEHVKTDWDRAKSQKMREQQALSREAKNSDVLQSPLDSAARDEL

SEQ ID NO: 5975 - protein, 626 aa, unidentified
MAARPAATLAWSLLLLSSALLREGCRARFVAERDSEDDGEEPVVFPESPLQSPTVLVAVLARNAAHTLPHFLGCLERLDYPKSRMAIWAATDHNVDNTTEIFREWLKNVQRLYHYVEWRPMDEPESYPDEIGPKHWPTSRFAHVMKLRQAALRTAREKWSDYILFIDVDNFLTNPQTLNLLIAENKTIVAPMLESRGLYSNFWCGITPKGFYKRTPDYVQIREWKRTGCFPVPMVHSTFLIDLRKEASDKLTFYPPHQDYTWTFDDIIVFAFSSRQAGIQMYLCNREHYGYLPIPLKPHQTLQEDIENLIHVQIEAMIDRPPMEPSQYVSVVPKYPDKMGFDEIFMINLKRRKDRRDRMLRTLYEQEIEVKIVEAVDGKALNTSQLKALNIEMLPGYRDPYSSRPLTRGEIGCFLSHYSVWKEVIDRELEKTLVIEDDVRFEHQFKKKLMKLMDNIDQAQLDWELIYIGRKRMQVKEPEKAVPNVANLVEADYSYWTLGYVISLEGAQKLVGANPFGKMLPVDEFLPVMYNKHPVAEYKEYYESRDLKAFSAEPLLIYPTHYTGQPGYLSDTETSTIWDNETVATDWDRTHAWKSRKQSRIYSNAKNTEALPPPTSLDTVPSRDEL

SEQ ID NO: 5976 - protein, 455 aa, unidentified
MVVLNPMTLGIYLQLFFLSIVSQPTFINSVLPISAALPSLDQKKRGGHKACCLLTPPPPPLFPPPFFRGGRSPLLSPDMKNLMLELETSQSPCMQGSLGSPGPPGPQGPPGLPGKTGPKGEKGELGRPGRKGRPGPPGVPGMPGPIGWPGPEGPRGEKGDLGMMGLPGSRGPMGSKGYPGSRGEKGSRGEKGDLGPKGEKGFPGFPGMLGQKGEMGPKGEPGIAGHRGPTGRPGKRGKQGQKGDSGVMGPPGKPGPSGQPGRPGPPGPPPAGQLIMGPKGERGFPGPPGRCLCGPTMNVNNPSYGESVYGPSSPRVPVIFVVNNQEELERLNTQNAIAFRRDQRSLYFKDSLGWLPIQLTPFYPVDYTADQHGTCGDGLLQPGEECDDGNSDVGDDCIRCHRAYCGDGHRHEGVEDCDGSDFGYLTCETYLPGSYGDLQCTQYCYIDSTPCRYFT

SEQ ID NO: 5977 - protein, 757 aa, unidentified
MVPDTACVLLLTLAALGASGQGQSPLGSDLGPQMLRELQETNAALQDVRELLRQQVREITFLKNTVMECDACGMQQSVRTGLPSVRPLLHCAPGFCFPGVACIQTESGARCGPCPAGFTGNGSHCTDVNECNAHPCFPRVRCINTSPGFRCEACPPGYSGPTHQGVGLAFAKANKQVCTDINECETGQHNCVPNSVCINTRGSFQCGPCQPGFVGDQASGCQRRAQRFCPDGSPSECHEHADCVLERDGSRSCVCAVGWAGNGILCGRDTDLDGFPDEKLRCPERQCRKDNCVTVPNSGQEDVDRDGIGDACDPDADGDGVPNEKDNCPLVRNPDQRNTDEDKWGDACDNCRSQKNDDQKDTDQDGRGDACDDDIDGDRIRNQADNCPRVPNSDQKDSDGDGIGDACDNCPQKSNPDQADVDHDFVGDACDSDQDQDGDGHQDSRDNCPTVPNSAQEDSDHDGQGDACDDDDDNDGVPDSRDNCRLVPNPGQEDADRDGVGDVCQDDFDADKVVDKIDVCPENAEVTLTDFRAFQTVVLDPEGDAQIDPNWVVLNQGREIVQTMNSDPGLAVGYTAFNGVDFEGTFHVNTVTDDDYAGFIFGYQDSSSFYVVMWKQMEQTYWQANPFRAVAEPGIQLKAVKSSTGPGEQLRNALWHTGDTESQVRLLWKDPRNVGWKDKKSYRWFLQHRPQVGYIRVRFYEGPELVADSNVVLDTTMRGGRLGVFCFSQENIIWANLRYRCNDTIPEDYETHQLRQA

SEQ ID NO: 5978 - protein, 327 aa, unidentified
MAAAAAAAAATNGTGGSSGMEVDAAVVPSVMACGVTGSVSVALHPLVILNISDHWIRMRSQEGRPVQVIGALIGKQEGRNIEVMNSFELLSHTVEEKIIIDKEYYYTKEEQFKQVFKELEFLGWYTTGGPPDPSDIHVHKQVCEIIESPLFLKLNPMTKHTDLPVSVFESVIDIINGEATMLFAELTYTLATEEAERIGVDHVARMTATGSGENSTVAEHLIAQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRRMRGLFF

SEQ ID NO: 5979 - protein, 468 aa, unidentified
MAARLVSRCGAVRAAPHSGPLVSWRRWSGASTDTVYDVVVSGGGLVGAAMACALGYDIHFHDKKILLLEAGPKKVLEKLSETYSNRVSSISPGSATLLSSFGAWDHICNMRYRAFRRMQVWDACSEALIMFDKDNLDDMGYIVENDVIMHALTKQLEAVSDRVTVLYRSKAIRYTWPCPFPMADSSPWVHITLGDGSTFQTKLLIGADGHNSGVRQAVGIQNVSWNYDQSAVVATLHLSEATENNVAWQRFLPSGPIALLPLSDTLSSLVWSTSHEHAAELVSMDEEKFVDAVNSAFWSDADHTDFIDTAGAMLQYAVSLLKPTKVSARQLPPSVARVDAKSRVLFPLGLGHAAEYVRPRVALIGDAAHRVHPLAGQGVNMGFGDISSLAHHLSTAAFNGKDLGSVSHLTGYETERQRHNTALLAATDLLKRLYSTSASPLVLLRTWGLQATNAVSPLKEQIMAFASK

SEQ ID NO: 5980 - protein, 105 aa, unidentified
MPLSPGLLLLLLSGATATAALPLEGGPTGRDSEHMQEAAGIRKSSLLTFLAWWFEWTSQASAGPLIGEEAREVARRQEGAPPQQSARRDRMPCRNFFWKTFSSCK

SEQ ID NO: 5981 - protein, 1065 aa, unidentified
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHRGVYSSDVFDIFPGTYQTLEMFPRTPGIWLLHCHVTDHIHAGMETTYTVLQNEDTKSG

SEQ ID NO: 5982 - protein, 419 aa, unidentified
MRGLLVLSVLLGAVFGKEDFVGHQVLRISVADEAQVQKVKELEDLEHLQLDFWRGPAHPGSPIDVRVPFPSIQAVKIFLESHGISYETMIEDVQSLLDEEQEQMFAFRSRARSTDTFNYATYHTLEEIYDFLDLLVAENPHLVSKIQIGNTYEGRPIYVLKFSTGGSKRPAIWIDTGIHSREWVTQASGVWFAKKITQDYGQDAAFTAILDTLDIFLEIVTNPDGFAFTHSTNRMWRKTRSHTAGSLCIGVDPNRNWDAGFGLSGASSNPCSETYHGKFANSEVEVKSIVDFVKDHGNIKAFISIHSYSQLLMYPYGYKTEPVPDQDELDQLSKAAVTALASLYGTKFNYGSIIKAIYQASGSTIDWTYSQGIKYSFTFELRDTGRYGFLLPASQIIPTAKETWLALLTIMEHTLNHPY

SEQ ID NO: 5983 - protein, 419 aa, unidentified
MAMRLILFFGALFGHIYCLETFVGDQVLEIVPSNEEQIKNLLQLEAQEHLQLDFWKSPTTPGETAHVRVPFVNVQAVKVFLESQGIAYSIMIEDVQVLLDKENEEMLFNRRRERSGNFNFGAYHTLEEISQEMDNLVAEHPGLVSKVNIGSSFENRPMNVLKFSTGGDKPAIWLDAGIHAREWVTQATALWTANKIVSDYGKDPSITSILDALDIFLLPVTNPDGYVFSQTKNRMWRKTRSKVSGSLCVGVDPNRNWDAGFGGPGASSNPCSDSYHGPSANSEVEVKSIVDFIKSHGKVKAFITLHSYSQLLMFPYGYKCTKLDDFDELSEVAQKAAQSLRSLHGTKYKVGPICSVIYQASGGSIDWSYDYGIKYSFAFELRDTGRYGFLLPARQILPTAEETWLGLKAIMEHVRDHPY

SEQ ID NO: 5984 - protein, 417 aa, unidentified
MRLILPVGLIATTLAIAPVRFDREKVFRVKPQDEKQADIIKDLAKTNELDFWYPGATHHVAANMMVDFRVSEKESQAIQSALDQNKMHYEILIHDLQEEIEKQFDVKEDIPGRHSYAKYNNWEKIVAWTEKMMDKYPEMVSRIKIGSTVEDNPLYVLKIGEKNERRKAIFTDCGIHAREWVSPAFCQWFVYQATKTYGRNKIMTKLLDRMNFYILPVFNVDGYIWSWTKNRMWRKNRSKNQNSKCIGTDLNRNFNASWNSIPNTNDPCADNYRGSAPESEKETKAVTNFIRSHLNEIKVYITFHSYSQMLLFPYGYTSKLPPNHEDLAKVAKIGTDVLSTRYETRYIYGPIESTIYPISGSSLDWAYDLGIKHTFAFELRDKGKFGFLLPESRIKPTCRETMLAVKFIAKYILKHTS

SEQ ID NO: 5985 - protein, 421 aa, unidentified
MRWILFIGALIGSSICGQEKFFGDQVLRINVRNGDEISKLSQLVNSNNLKLNFWKSPSSFNRPVDVLVPSVSLQAFKSFLRSQGLEYAVTIEDLQALLDNEDDEMQHNEGQERSSNNFNYGAYHSLEAIYHEMDNIAADFPDLARRVKIGHSFENRPMYVLKFSTGKGVRRPAVWLNAGIHSREWISQATAIWTARKIVSDYQRDPAITSILEKMDIFLLPVANPDGYVYTQTQNRLWRKTRSRNPGSSCIGADPNRNWNASFAGKGASDNPCSEVYHGPHANSEVEVKSVVDFIQKHGNFKGFIDLHSYSQLLMYPYGYSVKKAPDAEELDKVARLAAKALASVSGTEYQVGPTCTTVYPASGSSIDWAYDNGIKFAFTFELRDTGTYGFLLPANQIIPTAEETWLGLKTIMEHVRDNLY

SEQ ID NO: 5986 - protein, 437 aa, unidentified
MKCLGKRRGQAAAFLPLCWLFLKILQPGHSHLYNNRYAGDKVIRFIPKTEEEAYALKKISYQLKVDLWQPSSISYVSEGTVTDVHIPQNGSRALLAFLQEANIQYKVLIEDLQKTLEKGSSLHTQRNRRSLSGYNYEVYHSLEEIQNWMHHLNKTHSGLIHMFSIGRSYEGRSLFILKLGRRSRLKRAVWIDCGIHAREWIGPAFCQWFVKEALLTYKSDPAMRKMLNHLYFYIMPVFNVDGYHFSWTNDRFWRKTRSRNSRFRCRGVDANRNWKVKWCDEGASMHPCDDTYCGPFPESEPEVKAVANFLRKHRKHIRAYLSFHAYAQMLLYPYSYKYATIPNFRCVESAAYKAVNALQSVYGVRYRYGPASTTLYVSSGSSMDWAYKNGIPYAFAFELRDTGYFGFLLPEMLIKPTCTETMLAVKNITMHLLKKCP

SEQ ID NO: 5987 - protein, 1885 aa, unidentified
MSGALLWPLLPLLLLLLSARDGVRAAQPQAPGYLIAAPSVFRAGVEEVISVTIFNSPREVTVQAQLVAQGEPVVQSQGAILDKGTIKLKVPTGLRGQALLKVWGRGWQAEEGPLFHNQTSVTVDGRGASVFIQTDKPVYRPQHRVLISIFTVSPNLRPVNEKLEAYILDPRGSRMIEWRHLKPFCCGITNMSFPLSDQPVLGEWFIFVEMQGHAYNKSFEVQKYVLPKFELLIDPPRYIQDLDACETGTVRARYTFGKPVAGALMINMTVNGVGYYSHEVGRPVLRTTKILGSRDFDICVRDMIPADVPEHFRGRVSIWAMVTSVDGSQQVAFDDSTPVQRQLVDIRYSKDTRKQFKPGLAYVGKVELSYPDGSPAEGVTVQIKAELTPKDNIYTSEVVSQRGLVGFEIPSIPTSAQHVWLETKVMALNGKPVGAQYLPSYLSLGSWYSPSQCYLQLQPPSHPLQVGEEAYFSVKSTCPCNFTLYYEVAARGNIVLSGQQPAHTTQQRSKRAAPALEKPIRLTHLSETEPPPAPEAEVDVCVTSLHLAVTPSMVPLGRLLVFYVRENGEGVADSLQFAVETFFENQVSVTYSANETQPGEVVDLRIRAARGSCVCVAAVDKSVYLLRSGFRLTPAQVFQELEDYDVSDSFGVSREDGPFWWAGLTAQRRRRSSVFPWPWGITKDSGFAFTETGLVVMTDRVSLNHRQDGGLYTDEAVPAFQPHTGSLVAVAPSRHPPRTEKRKRTFFPETWIWHCLNISDPSGEGTLSVKVPDSITSWVGEAVALSTSQGLGIAEPSLLKTFKPFFVDFMLPALIIRGEQVKIPLSVYNYMGTCAEVYMKLSVPKGIQFVGHPGKRHVTKKMCVAPGEAEPIWVVLSFSDLGLNNITAKALAYGDTNCCRDGRSSKHPEENHADRRVPIGVDHVRRSVMVEAEGVPRAYTYSAFFCPSERVHISTPNKYEFQYVQRPLRLTRFDVAVRAHNDARVALSSGPQDTAGMIEIVLGGHQNTRSWISTSKMGEPVASAHTAKILSWDEFRTFWISWRGGLIQVGHGPEPSNESVIVAWTLPRPPEVQFIGFSTGWGSMGEFRIWRKMEVDESYSEAFTLGVPHGAIPGSERATASIIGDVMGPTLNHLNNLLRLPFGCGEQNMIHFAPNVFVLKYLQKTQQLSPEVERETTDYLVQGYQRQLTYKRQDGSYSAFGERDASGSMWLTAFVLKSFAQARSFIFVDPRELAAAKSWIIQQQQADGSFLAVGRVLNKDIQGGIHGTVPLTAYVVVALLETGTASEEERGSTDKARHFLESAAPLAMDPYSCALTTYALTLLRSPAAPEALRKLRSLAIMRDGVTHWSLSNSWDVDKGTFLSFSDRVSQSVVSAEVEMTAYALLTYTLLGDVAAALPVVKWLSQQRNALGGFSSTQDTCVALQALAEYAILSYAGGINLTVSLASTNLDYQETFELHRTNQKVLQTAAIPSLPTGLFVSAKGDGCCLMQIDVTYNVPDPVAKPAFQLLVSLQEPEAQGRPPPMPASAAEGSRGDWPPADDDDPAADQHHQEYKVMLEVCTRWLHAGSSNMAVLEVPLLSGFRADIESLEQLLLDKHMGMKRYEVAGRRVLFYFDEIPSRCLTCVRFRALRECVVGRTSALPVSVYDYYEPAFEATRFYNVSTHSPLARELCAGPACNEVERAPARGPGWFPGESGPAVAPEEGAAIARCGCDHDCGAQGNPVCGSDGVVYASACRLREAACRQAAPLEPAPPSCCALEQRLPASSSSTYGDDLASVAPGPLQQDVKLNGAGLEVEDSDPEPEGEAEDRVTAGPRPPVSSGNLESSTQSASPFHRWGQTPAPQRHSGRVVGAHRPGLLSPVFVYSPAFQSGGEEGLWMSNTCTLR

SEQ ID NO: 5988 - protein, 417 aa, unidentified
MLALLVLVTVALASAHHGGEHFEGEKVFRVNVEDENHINIIRELASTTQIDFWKPDSVTQIKPHSTVDFRVKAEDTVTVENVLKQNELQYKVLISNLRNVVEAQFDSRVRATGHSYEKYNKWETIEAWTQQVATENPALISRSVIGTTFEGRAIYLLKVGKAGQNKPAIFMDCGFHAREWISPAFCQWFVREAVRTYGREIQVTELLDKLDFYVLPVLNIDGYIYTWTKSRFWRKTRSTHTGSSCIGTDPNRNFDAGWCEIGASRNPCDETYCGPAAESEKETKALADFIRNKLSSIKAYLTIHSYSQMMIYPYSYAYKLGENNAELNALAKATVKELASLHGTKYTYGPGATTIYPAAGGSDDWAYDQGIRYSFTFELRDTGRYGFLLPESQIRATCEETFLAIKYVASYVLEHLY

SEQ ID NO: 5989 - protein, 423 aa, unidentified
MKLCSLAVLVPIVLFCEQHVFAFQSGQVLAALPRTSRQVQVLQNLTTTYEIVLWQPVTADLIVKKKQVHFFVNASDVDNVKAHLNVSGIPCSVLLADVEDLIQQQISNDTVSPRASASYYEQYHSLNEIYSWIEFITERHPDMLTKIHIGSSFEKYPLYVLKVSGKEQAAKNAIWIDCGIHAREWISPAFCLWFIGHITQFYGIIGQYTNLLRLVDFYVMPVVNVDGYDYSWKKNRMWRKNRSFYANNHCIGTDLNRNFASKHWCEEGASSSSCSETYCGLYPESEPEVKAVASFLRRNINQIKAYISMHSYSQHIVFPYSYTRSKSKDHEELSLVASEAVRAIEKISKNTRYTHGHGSETLYLAPGGGDDWIYDLGIKYSFTIELRDTGTYGFLLPERYIKPTCREAFAAVSKIAWHVIRNV

SEQ ID NO: 5990 - protein, 476 aa, unidentified
MAGRGGSALLALCGALAACGWLLGAEAQEPGAPAAGMRRRRRLQQEDGISFEYHRYPELREALVSVWLQCTAISRIYTVGRSFEGRELLVIELSDNPGVHEPGEPEFKYIGNMHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGDLVANYPYDETRSGSAHEYSSSPDDAIFQSLARAYSSFNPAMSDPNRPPCRKNDDDSSFVDGTTNGGAWYSVPGGMQDFNYLSSNCFEITVELSCEKFPPEETLKTYWEDNKNSLISYLEQIHRGVKGFVRDLQGNPIANATISVEGIDHDVTSAKDGDYWRLLIPGNYKLTASAPGYLAITKKVAVPYSPAAGVDFELESFSERKEEEKEELMEWWKMMSETLNF

SEQ ID NO: 5991 - protein, 443 aa, unidentified; identical to SEQ ID NO: 1104

SEQ ID NO: 5992 - protein, 458 aa, unidentified
MSDLLSVFLHLLLLFKLVAPVTFRHHRYDDLVRTLYKVQNECPGITRVYSIGRSVEGRHLYVLEFSDHPGIHEPLEPEVKYVGNMHGNEALGRELMLQLSEFLCEEFRNRNQRIVQLIQDTRIHILPSMNPDGYEVAAAQGPNKPGYLVGRNNANGVDLNRNFPDLNTYIYYNEKYGGPNHHLPLPDNWKSQVEPETRAVIRWMHSFNFVLSANLHGGAVVANYPYDKSFEHRVRGVRRTASTPTPDDKLFQKLAKVYSYAHGWMFQGWNCGDYFPDGITNGASWYSLSKGMQDFNYLHTNCFEITLELSCDKFPPEEELQREWLGNREALIQFLEQVHQGIKGMVLDENYNNLANAVISVSGINHDVTSGDHGDYFRLLLPGIYTVSATAPGYDPETVTVTVGPAEPTLVNFHLKRSIPQVSPVRRAPSRRHGVRAKVQPQARKKEMEMRQLQRGPA

SEQ ID NO: 5993 - protein, 545 aa, unidentified
MLPGAWLLWTSLLLLARPAQPCPMGCDCFVQEVFCSDEELATVPLDIPPYTKNIIFVETSFTTLETRAFGSNPNLTKVVFLNTQLCQFRPDAFGGLPRLEDLEVTGSSFLNLSTNIFSNLTSLGKLTLNFNMLEALPEGLFQHLAALESLHLQGNQLQALPRRLFQPLTHLKTLNLAQNLLAQLPEELFHPLTSLQTLKLSNNALSGLPQGVFGKLGSLQELFLDSNNISELPPQVFSQLFCLERLWLQRNAITHLPLSIFASLGNLTFLSLQWNMLRVLPAGLFAHTPCLVGLSLTHNQLETVAEGTFAHLSNLRSLMLSYNAITHLPAGIFRDLEELVKLYLGSNNLTALHPALFQNLSKLELLSLSKNQLTTLPEGIFDTNYNLFNLALHGNPWQCDCHLAYLFNWLQQYTDRLLNIQTYCAGPAYLKGQVVPALNEKQLVCPVTRDHLGFQVTWPDESKAGGSWDLAVQERAARSQCTYSNPEGTVVLACDQAQCRWLNVQLSPQQGSLGLQYNASQEWDLRSSCGSLRLTVSIEARAAGP

SEQ ID NO: 5994 - protein, 374 aa, unidentified
MKPLLETLYLLGMLVPGGLGYDRSLAQHRQEIVDKSVSPWSLETYSYNIYHPMGEIYEWMREISEKYKEVVTQHFLGVTYETHPMYYLKISQPSGNPKKIIWMDCGIHAREWIAPAFCQWFVKEILQNHKDNSSIRKLLRNLDFYVLPVLNIDGYIYTWTTDRLWRKSRSPHNNGTCFGTDLNRNFNASWCSIGASRNCQDQTFCGTGPVSEPETKAVASFIESKKDDILCFLTMHSYGQLILTPYGYTKNKSSNHPEMIQVGQKAANALKAKYGTNYRVGSSADILYASSGSSRDWARDIGIPFSYTFELRDSGTYGFVLPEAQIQPTCEETMEAVLSVLDDVYAKHWHSDSAGRVTSATMLLGLLVSCMSLL

SEQ ID NO: 5995 - protein, 472 aa, unidentified
MKFLIFAFFGGVHLLSLCSGKAICKNGISKRTFEEIKEEIASCGDVAKAIINLAVYGKAQNRSYERLALLVDTVGPRLSGSKNLEKAIQIMYQNLQQDGLEKVHLEPVRIPHWERGEESAVMLEPRIHKIAILGLGSSIGTPPEGITAEVLVVTSFDELQRRASEARGKIVVYNQPYINYSRTVQYRTQGAVEAAKVGALASLIRSVASFSIYSPHTGIQEYQDGVPKIPTACITVEDAEMMSRMASHGIKIVIQLKMGAKTYPDTDSFNTVAEITGSKYPEQVVLVSGHLDSWDVGQGAMDDGGGAFISWEALSLIKDLGLRPKRTLRLVLWTAEEQGGVGAFQYYQLHKVNISNYSLVMESDAGTFLPTGLQFTGSEKARAIMEEVMSLLQPLNITQVLSHGEGTDINFWIQAGVPGASLLDDLYKYFFFHHSHGDTMTVMDPKQMNVAAAVWAVVSYVVADMEEMLPRS

SEQ ID NO: 5996 - protein, 476 aa, unidentified
MVGAMWKVIVSLVLLMPGPCDGLFRSLYRSVSMPPKGDSGQPLFLTPYIEAGKIQKGRELSLVGPFPGLNMKSYAGFLTVNKTYNSNLFFWFFPAQIQPEDAPVVLWLQGGPGGSSMFGLFVEHGPYVVTSNMTLRDRDFPWTTTLSMLYIDNPVGTGFSFTDDTHGYAVNEDDVARDLYSALIQFFQIFPEYKNNDFYVTGESYAGKYVPAIAHLIHSLNPVREVKINLNGIAIGDGYSDPESIIGGYAEFLYQIGLLDEKQKKYFQKQCHECIEHIRKQNWFEAFEILDKLLDGDLTSDPSYFQNVTGCSNYYNFLRCTEPEDQLYYVKFLSLPEVRQAIHVGNQTFNDGTIVEKYLREDTVQSVKPWLTEIMNNYKVLIYNGQLDIIVAAALTERSLMGMDWKGSQEYKKAEKKVWKIFKSDSEVAGYIRQAGDFHQVIIRGGGHILPYDQPLRAFDMINRFIYGKGWDPYVG

SEQ ID NO: 5997 - protein, 734 aa, unidentified
MWGLLLALAAFAPAVGPALGAPRNSVLGLAQPGTTKVPGSTPALHSSPAQPPAETANGTSEQHVRIRVIKKKKVIMKKRKKLTLTRPTPLVTAGPLVTPTPAGTLDPAEKQETGCPPLGLESLRVSDSRLEASSSQSFGLGPHRGRLNIQSGLEDGDLYDGAWCAEEQDADPWFQVDAGHPTRFSGVITQGRNSVWRYDWVTSYKVQFSNDSRTWWGSRNHSSGMDAVFPANSDPETPVLNLLPEPQVARFIRLLPQTWLQGGAPCLRAEILACPVSDPNDLFLEAPASGSSDPLDFQHHNYKAMRKLMKQVQEQCPNITRIYSIGKSYQGLKLYVMEMSDKPGEHELGEPEVRYVAGMHGNEALGRELLLLLMQFLCHEFLRGNPRVTRLLSEMRIHLLPSMNPDGYEIAYHRGSELVGWAEGRWNNQSIDLNHNFADLNTPLWEAQDDGKVPHIVPNHHLPLPTYYTLPNATVAPETRAVIKWMKRIPFVLSANLHGGELVVSYPFDMTRTPWAARELTPTPDDAVFRWLSTVYAGSNLAMQDTSRRPCHSQDFSVHGNIINGADWHTVPGSMNDFSYLHTNCFEVTVELSCDKFPHENELPQEWENNKDALLTYLEQVRMGIAGVVRDKDTELGIADAVIAVDGINHDVTTAWGGDYWRLLTPGDYMVTASAEGYHSVTRNCRVTFEEGPFPCNFVLTKTPKQRLRELLAAGAKVPPDLRRRLERLRGQKD

SEQ ID NO: 5998 - protein, 756 aa, unidentified
MSRPGTATPALALVLLAVTLAGVGAQGAALEDPDYYGQEIWSREPYYARPEPELETFSPPLPAGPGEEWERRPQEPRPPKRATKPKKAPKREKSAPEPPPPGKHSNKKVMRTKSSEKAANDDHSVRVAREDVRESCPPLGLETLKITDFQLHASTVKRYGLGAHRGRLNIQAGINENDFYDGAWCAGRNDLQQWIEVDARRLTRFTGVITQGRNSLWLSDWVTSYKVMVSNDSHTWVTVKNGSGDMIFEGNSEKEIPVLNELPVPMVARYIRINPQSWFDNGSICMRMEILGCPLPDPNNYYHRRNEMTTTDDLDFKHHNYKEMRQLMKVVNEMCPNITRIYNIGKSHQGLKLYAVEISDHPGEHEVGEPEFHYIAGAHGNEVLGRELLLLLVQFVCQEYLARNARIVHLVEETRIHVLPSLNPDGYEKAYEGGSELGGWSLGRWTHDGIDINNNFPDLNTLLWEAEDRQNVPRKVPNHYIAIPEWFLSENATVAAETRAVIAWMEKIPFVLGGNLQGGELVVAYPYDLVRSPWKTQEHTPTPDDHVFRWLAYSYASTHRLMTDARRRVCHTEDFQKEEGTVNGASWHTVAGSLNDFSYLHTNCFELSIYVGCDKYPHESQLPEEWENNRESLIVFMEQVHRGIKGLVRDSHGKGIPNAIISVEGINHDIRTANDGDYWRLLNPGEYVVTAKAEGFTASTKNCMVGYDMGATRCDFTLSKTNMARIREIMEKFGKQPVSLPARRLKLRGQKRRQRG

SEQ ID NO: 5999 - protein, 652 aa, unidentified
MPPPLPLLLLTVLVVAAARPGCEFERNPAGECHRPPAADSATCVDLQLRTCSDAAYNHTTFPNLLQHRSWEVVEASSEYILLSVLHQLLEGQCNPDLRLLGCAVLAPRCEGGWVRRPCRHICEGLREVCQPAFDAIDMAWPYFLDCHRYFTREDEGCYDPLEKLRGGLEADEALPSGLPPTFIRFSHHSYAQMVRVLRRTASRCAHVARTYSIGRSFDGRELLVIEFSSRPGQHELMEPEVKLIGNIHGNEVAGREMLIYLAQYLCSEYLLGNPRIQRLLNTTRIHLLPSMNPDGYEVAAAEGAGYNGWTSGRQNAQNLDLNRNFPDLTSEYYRLAETRGARSDHIPIPQHYWWGKVAPETKAIMKWMQTIPFVLSASLHGGDLVVSYPFDFSKHPQEEKMFSPTPDEKMFKLLSRAYADVHPMMMDRSENRCGGNFLKRGSIINGADWYSFTGGMSDFNYLHTNCFEITVELGCVKFPPEEALYILWQHNKESLLNFVETVHRGIKGVVTDKFGKPVKNARISVKGIRHDITTAPDGDYWRLLPPGIHIVIAQAPGYAKVIKKVIIPARMKRAGRVDFILQPLGMGPKNFIHGLRRTGPHDPLGGASSLGEATEPDPLRARRQPSADGSKPWWWSYFTSLSTHRPRWLLKY

SEQ ID NO: 6000 - protein, 569 aa, unidentified
MAPPVRLERPFPSRRFPGLLLAALVLLLSSFSDQCNVPEWLPFARPTNLTDDFEFPIGTYLNYECRPGYSGRPFSIICLKNSVWTSAKDKCKRKSCRNPPDPVNGMAHVIKDIQFRSQIKYSCPKGYRLIGSSSATCIISGNTVIWDNKTPVCDRIICGLPPTIANGDFTSISREYFHYGSVVTYHCNLGSRGKKVFELVGEPSIYCTSKDDQVGIWSGPAPQCIIPNKCTPPNVENGILVSDNRSLFSLNEVVEFRCQPGFGMKGPSHVKCQALNKWEPELPSCSRVCQPPPDVLHAERTQRDKDNFSPGQEVFYSCEPGYDLRGSTYLHCTPQGDWSPAAPRCEVKSCDDFLGQLPNGHVLFPLNLQLGAKVDFVCDEGFQLKGSSASYCVLAGMESLWNSSVPVCERKSCETPPVPVNGMVHVITDIHVGSRINYSCTTGHRLIGHSSAECILSGNTAHWSMKPPICQQIFCPNPPAILNGRHTGTPLGDIPYGKEVSYTCDPHPDRGMTFNLIGESTIRRTSEPHGNGVWSSPAPRCELPVGAGSHDALIVGKFYEVFAEEFCHL

SEQ ID NO: 6001 - protein, 1406 aa, unidentified; identical to SEQ ID NO: 1111

SEQ ID NO: 6002 - protein, 1285 aa, unidentified; identical to SEQ ID NO: 1112

SEQ ID NO: 6003 - protein, 220 aa, unidentified
MAGLSRGSARALLAALLASTLLALLVSPARGRGGRDHGDWDEASRLPPLPPREDAARVARFVTHVSDWGALATISTLEAVRGRPFADVLSLSDGPPGAGSGVPYFYLSPLQLSVSNLQENPYATLTMTLAQTNFCKKHGFDPQSPLCVHIMLSGTVTKVNETEMDIAKHSLFIRHPEMKTWPSSHNWFFAKLNITNIWVLDYFGGPKIVTPEEYYNVTVQ

SEQ ID NO: 6004 - protein, 290 aa, unidentified
MSVRRGRRPARPGTRLSWLLCCSALLSPAAGYVIVSSVSWAVTNEVDEELDSASTEEAMPALLEDSGSIWQQSFPASAHKEDAHLRPRAGAARARPPPAPPGMFSYRREGGQTASAPPGPRLRAATARSLAHASVWGCLATVSTHKKIQGLPFGNCLPVSDGPFNNSTGIPFFYMTAKDPVVADLMKNPMASLMLPESEGEFCRKNIVDPEDPRCVQLTLTGQMIAVSPEEVEFAKQAMFSRHPGMRKWPRQYEWFFMKMRIEHIWLQKWYGGASSISREEYFKAVPRKA

SEQ ID NO: 6005 - protein, 420 aa, unidentified; identical to SEQ ID NO: 1119

SEQ ID NO: 6006 - protein, 353 aa, unidentified
MRLPRRAALGLLPLLLLLPPAPEAAKKPTPCHRCRGLVDKFNQGMVDTAKKNFGGGNTAWEEKTLSKYESSEIRLLEILEGLCESSDFECNQMLEAQEEHLEAWWLQLKSEYPDLFEWFCVKTLKVCCSPGTYGPDCLACQGGSQRPCSGNGHCSGDGSRQGDGSCRCHMGYQGPLCTDCMDGYFSSLRNETHSICTACDESCKTCSGLTNRDCGECEVGWVLDEGACVDVDECAAEPPPCSAAQFCKNANGSYTCEECDSSCVGCTGEGPGNCKECISGYAREHGQCADVDECSLAEKTCVRKNENCYNTPGSYVCVCPDGFEETEDACVPPAEAEATEGESPTQLPSREDL

SEQ ID NO: 6007 - protein, 196 aa, unidentified
MRLPLLVSAGVLLVALLPCPPCRALLSRGPVPGARQAPQHPQPLDFFQPPPQSEQPQQPQARPVLLRMGEEYFLRLGNLNKSPAAPLSPASSLLAGGSGSRPSPEQATANFFRVLLQQLLLPRRSLDSPAALAERGARNALGGHQEAPERERRSEEPPISLDLTFHLLREVLEMARAEQLAQQAHSNRKLMEIIGK

SEQ ID NO: 6008 - protein, 322 aa, unidentified
MSPNFKLQCHFILIFLTALRGESRYLELREAADYDPFLLFSANLKRELAGEQPYRRALRCLDMLSLQGQFTFTADRPQLHCAAFFISEPEEFITIHYDQVSIDCQGGDFLKVFDGWILKGEKFPSSQDHPLPSAERYIDFCESGLSRRSIRSSQNVAMIFFRVHEPGNGFTLTIKTDPNLFPCNVISQTPNGKFTLVVPHQHRNCSFSIIYPVVIKISDLTLGHVNGLQLKKSSAGCEGIGDFVELLGGTGLDPSKMTPLADLCYPFHGPAQMKVGCDNTVVRMVSSGKHVNRVTFEYRQLEPYELENPNGNSIGEFCLSGL

SEQ ID NO: 6009 - protein, 444 aa, unidentified; identical to SEQ ID NO: 1120

SEQ ID NO: 6010 - protein, 411 aa, unidentified; identical to SEQ ID NO: 1121

SEQ ID NO: 6011 - protein, 249 aa, unidentified
MEIKHLLFLVAAACLLPMLSMKKKSARDQFNKLVTDLPNVQEEIVNIHNALRRRVVPPASNMLKMSWSEEAAQNARIFSKYCDMTESNPLERRLPNTFCGENMHMTSYPVSWSSVIGVWYSESTSFKHGEWTTTDDDITTDHYTQIVWATSYLIGCAIASCRQQGSPRYLYVCHYCHEGNDPETKNEPYKTGVPCEACPSNCEDKLCTNPCIYYDEYFDCDIQVHYLGCNHSTTILFCKATCLCDTEIK

SEQ ID NO: 6012 - protein, 243 aa, unidentified
MALLPVLFLVTVLLPSLPAEGKDPAFTALLTTQLQVQREIVNKHNELRKAVSPPASNMLKMEWSREVTTNAQRWANKCTLQHSDPEDRKTSTRCGENLYMSSDPTSWSSAIQSWYDEILDFVYGVGPKSPNAVVGHYTQLVWYSTYQVGCGIAYCPNQDSLKYYYVCQYCPAGNNMNRKNTPYQQGTPCAGCPDDCDKGLCTNSCQYQDLLSNCDSLKNTAGCEHELLKEKCKATCLCENKIY

SEQ ID NO: 6013 - protein, 245 aa, unidentified
MTLFPVLLFLVAGLLPSFPANEDKDPAFTALLTTQTQVQREIVNKHNELRRAVSPPARNMLKMEWNKEAAANAQKWANQCNYRHSNPKDRMTSLKCGENLYMSSASSSWSQAIQSWFDEYNDFDFGVGPKTPNAVVGHYTQVVWYSSYLVGCGNAYCPNQKVLKYYYVCQYCPAGNWANRLYVPYEQGAPCASCPDNCDDGLCTNGCKYEDLYSNCKSLKLTLTCKHQLVRDSCKASCNCSNSIY

SEQ ID NO: 6014 - protein, 497 aa, unidentified
MSCVLGGVIPLGLLFLVCGSQGYLLPNVTLLEELLSKYQHNESHSRVRRAIPREDKEEILMLHNKLRGQVQPQASNMEYMTWDDELEKSAAAWASQCIWEHGPTSLLVSIGQNLGAHWGRYRSPGFHVQSWYDEVKDYTYPYPSECNPWCPERCSGPMCTHYTQIVWATTNKIGCAVNTCRKMTVWGEVWENAVYFVCNYSPKGNWIGEAPYKNGRPCSECPPSYGGSCRNNLCYREETYTPKPETDEMNEVETAPIPEENHVWLQPRVMRPTKPKKTSAVNYMTQVVRCDTKMKDRCKGSTCNRYQCPAGCLNHKAKIFGTLFYESSSSICRAAIHYGILDDKGGLVDITRNGKVPFFVKSERHGVQSLSKYKPSSSFMVSKVKVQDLDCYTTVAQLCPFEKPATHCPRIHCPAHCKDEPSYWAPVFGTNIYADTSSICKTAVHAGVISNESGGDVDVMPVDKKKTYVGSLRNGVQSESLGTPRDGKAFRIFAVRQ

SEQ ID NO: 6015 - protein, 422 aa, unidentified
MPAGRRGPAAQSARRPPPLLPLLLLLCVLGAPRAGSGAHTAVISPQDPTLLIGSSLLATCSVHGDPPGATAEGLYWTLNGRRLPPELSRVLNASTLALALANLNGSRQRSGDNLVCHARDGSILAGSCLYVGLPPEKPVNISCWSKNMKDLTCRWTPGAHGETFLHTNYSLKYKLRWYGQDNTCEEYHTVGPHSCHIPKDLALFTPYEIWVEATNRLGSARSDVLTLDILDVVTTDPPPDVHVSRVGGLEDQLSVRWVSPPALKDFLFQAKYQIRYRVEDSVDWKVVDDVSNQTSCRLAGLKPGTVYFVQVRCNPFGIYGSKKAGIWSEWSHPTAASTPRSERPGPGGGACEPRGGEPSSGPVRRELKQFLGWLKKHAYCSNLSFRLYDQWRAWMQKSHKTRNQDEGILPSGRRGTARGPAR

SEQ ID NO: 6016 - protein, 224 aa, unidentified
MEKLLCFLVLTSLSHAFGQTDMSRKAFVFPKESDTSYVSLKAPLTKPLKAFTVCLHFYTELSSTRGYSIFSYATKRQDNEILIFWSKDIGYSFTVGGSEILFEVPEVTVAPVHICTSWESASGIVEFWVDGKPRVRKSLKKGYTVGAEASIILGQEQDSFGGNFEGSQSLVGDIGNVNMWDFVLSPDEINTIYLGGPFSPNVLNWRALKYEVQGEVFTKPQLWP

SEQ ID NO: 6017 - protein, 661 aa, unidentified
MAPSADPGMSRMLPFLLLLWFLPITEGSQRAEPMFTAVTNSVLPPDYDSNPTQLNYGVAVTDVDHDGDFEIVVAGYNGPNLVLKYDRAQKRLVNIAVDERSSPYYALRDRQGNAIGVTACDIDGDGREEIYFLNTNNAFSGVATYTDKLFKFRNNRWEDILSDEVNVARGVASLFAGRSVACVDRKGSGRYSIYIANYAYGNVGPDALIEMDPEASDLSRGILALRDVAAEAGVSKYTGGRGVSVGPILSSSASDIFCDNENGPNFLFHNRGDGTFVDAAASAGVDDPHQHGRGVALADFNRDGKVDIVYGNWNGPHRLYLQMSTHGKVRFRDIASPKFSMPSPVRTVITADFDNDQELEIFFNNIAYRSSSANRLFRVIRREHGDPLIEELNPGDALEPEGRGTGGVVTDFDGDGMLDLILSHGESMAQPLSVFRGNQGFNNNWLRVVPRTRFGAFARGAKVVLYTKKSGAHLRIIDGGSGYLCEMEPVAHFGLGKDEASSVEVTWPDGKMVSRNVASGEMNSVLEILYPRDEDTLQDPAPLECGQGFSQQENGHCMDTNECIQFPFVCPRDKPVCVNTYGSYRCRTNKKCSRGYEPNEDGTACVGTLGQSPGPRPTTPTAAAATAAAAAAAGAATAAPVLVDGDLNLGSVVKESCEPSC

SEQ ID NO: 6018 - protein, 401 aa, unidentified
MEPGRRGAAALLALLCVACALRAGRAQYERYSFRSFPRDELMPLESAYRHALDKYSGEHWAESVGYLEISLRLHRLLRDSEAFCHRNCSAAPQPEPAAGLASYPELRLFGGLLRRAHCLKRCKQGLPAFRQSQPSREVLADFQRREPYKFLQFAYFKANNLPKAIAAAHTFLLKHPDDEMMKRNMAYYKSLPGAEDYIKDLETKSYESLFIRAVRAYNGENWRTSITDMELALPDFFKAFYECLAACEGSREIKDFKDFYLSIADHYVEVLECKIQCEENLTPVIGGYPVEKFVATMYHYLQFAYYKLNDLKNAAPCAVSYLLFDQNDKVMQQNLVYYQYHRDTWGLSDEHFQPRPEAVQFFNVTTLQKELYDFAKENIMDDDEGEVVEYVDDLLELEETS

SEQ ID NO: 6019 - protein, 593 aa, unidentified
MAATVATAAAVAPAPAPGTDSASSVHWFRKGLRLHDNPALLAAVRGARCVRCVYILDPWFAASSSVGINRWRFLLQSLEDLDTSLRKLNSRLFVVRGQPADVFPRLFKEWGVTRLTFEYDSEPFGKERDAAIMKMAKEAGVEVVTENSHTLYDLDRIIELNGQKPPLTYKRFQAIISRMELPKKPVGLVTSQQMESCRAEIQENHDETYGVPSLEELGFPTEGLGPAVWQGGETEALARLDKHLERKAWVANYERPRMNANSLLASPTGLSPYLRFGCLSCRLFYYRLWDLYKKVKRNSTPPLSLFGQLLWREFFYTAATNNPRFDRMEGNPICIQIPWDRNPEALAKWAEGKTGFPWIDAIMTQLRQEGWIHHLARHAVACFLTRGDLWVSWESGVRVFDELLLDADFSVNAGSWMWLSCSAFFQQFFHCYCPVGFGRRTDPSGDYIRRYLPKLKAFPSRYIYEPWNAPESIQKAAKCIIGVDYPRPIVNHAETSRLNIERMKQIYQQLSRYRGLCLLASVPSCVEDLSHPVAEPSSSQAGSMSSAGPRPLPSGPASPKRKLEAAEEPPGEELSKRARVAELPTPELPSKDA

SEQ ID NO: 6020 - protein, 493 aa, unidentified
MADSEALPSLAGDPVAVEALLRAVFGVVVDEAIQKGTSVSQKVCEWKEPEELKQLLDLELRSQGESQKQILERCRAVIRYSVKTGHPRFFNQLFSGLDPHALAGRIITESLNTSQYTYEIAPVFVLMEEEVLRKLRALVGWSSGDGIFCPGGSISNMYAVNLARYQRYPDCKQRGLRTLPPLALFTSKECHYSIQKGAAFLGLGTDSVRVVKADERGKMVPEDLERQIGMAEAEGAVPFLVSATSGTTVLGAFDPLEAIADVCQRHGLWLHVDAAWGGSVLLSQTHRHLLDGIQRADSVAWNPHKLLAAGLQCSALLLQDTSNLLKRCHGSQASYLFQQDKFYDVALDTGDKVVQCGRRVDCLKLWLMWKAQGDQGLERRIDQAFVLARYLVEEMKKREGFELVMEPEFVNVCFWFVPPSLRGKQESPDYHERLSKVAPVLKERMVKEGSMMIGYQPHGTRGNFFRVVVANSALTCADMDFLLNELERLGQDL

SEQ ID NO: 6021 - protein, 554 aa, unidentified; identical to SEQ ID NO: 1128

SEQ ID NO: 6022 - protein, 972 aa, unidentified; identical to SEQ ID NO: 1129

SEQ ID NO: 6023 - protein, 144 aa, unidentified
MWLQSLLLLGTVACSISAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 6024 - protein, 400 aa, unidentified; identical to SEQ ID NO: 1130

SEQ ID NO: 6025 - protein, 207 aa, unidentified
MAGPATQSPMKLMALQLLLWHSALWTVQEATPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 6026 - protein, 532 aa, unidentified
MMMVRRGLLAWISRVVVLLVLLCCAISVLYMLACTPKGDEEQLALPRANSPTGKEGYQAVLQEWEEQHRNYVSSLKRQIAQLKEELQERSEQLRNGQYQASDAAGLGLDRSPPEKTQADLLAFLHSQVDKAEVNAGVKLATEYAAVPFDSFTLQKVYQLETGLTRHPEEKPVRKDKRDELVEAIESALETLNSPAENSPNHRPYTASDFIEGIYRTERDKGTLYELTFKGDHKHEFKRLILFRPFGPIMKVKNEKLNMANTLINVIVPLAKRVDKFRQFMQNFREMCIEQDGRVHLTVVYFGKEEINEVKGILENTSKAANFRNFTFIQLNGEFSRGKGLDVGARFWKGSNVLLFFCDVDIYFTSEFLNTCRLNTQPGKKVFYPVLFSQYNPGIIYGHHDAVPPLEQQLVIKKETGFWRDFGFGMTCQYRSDFINIGGFDLDIKGWGGEDVHLYRKYLHSNLIVVRTPVRGLFHLWHEKRCMDELTPEQYKMCMQSKAMNEASHGQLGMLVFRHEIEAHLRKQKQKTSSKKT

SEQ ID NO: 6027 - protein, 222 aa, unidentified
MAAGSRTSLLLAFALLCLPWLQEAGAVQTVPLSRLFKEAMLQAHRAHQLAIDTYQEFISSWGMEAYITKEQKYSFLHDSQTSFCFSDSIPTSSNMEETQQKSNLELLHISLLLIESRLEPVRFLRSTFTNNLVYDTSDSDDYHLLKDLEEGIQMLMGRLEDGSHLTGQTLKQTYSKFDTNSHNHDALLKNYGLLHCFRKDMDKVETFLRMVQCRSVEGSCGF

SEQ ID NO: 6028 - protein, 185 aa, unidentified
MRLLILTCLVAVALARPKLPLRYPERLQNPSESSEPIPLESREEYMNGMNRQRNILREKQTDEIKDTRNESTQNCVVAEPEKMESSISSSSEEMSLSKCAEQFCRLNEYNQLQLQAAHAQEQIRRMNENSHVQVPFQQLNQLAAYPYAVWYYPQIMQYVPFPPFSDISNPTAHENYEKNNVMLQW

SEQ ID NO: 6029 - protein, 226 aa, unidentified
MKVLILACLVALALARETIESLSSSEESITEYKQKVEKVKHEDQQQGEDEHQDKIYPSFQPQPLIYPFVEPIPYGFLPQNILPLAQPAVVLPVPQPEIMEVPKAKDTVYTKGRVMPVLKSPTIPFFDPQIPKLTDLENLHLPLPLLQPLMQQVPQPIPQTLALPPQPLWSVPQPKVLPIPQQVVPYPQRAVPVQALLLNQELLLNPTHQIYPVTQPLAPVHNPISV

SEQ ID NO: 6030 - protein, 182 aa, unidentified
MKSFLLVVNALALTLPFLAVEVQNQKQPACHENDERPFYQKTAPYVPMYYVPNSYPYYGTNLYQRRPAIAINNPYVPRTYYANPAVVRPHAQIPQRQYLPNSHPPTVVRRPNLHPSFIAIPPKKIQDKIIIPTINTIATVEPTPAPATEPTVDSVVTPEAFSESIITSTPETTTVAVTPPTA

SEQ ID NO: 6031 - protein, 141 aa, unidentified
MAQYLSTLLLLLATLAVALAWSPKEEDRIIPGGIYNADLNDEWVQRALHFAISEYNKATKDDYYRRPLRVLRARQQTVGGVNYFFDVEVGRTICTKSQPNLDTCAFHEQPELQKKQLCSFEIYEVPWENRRSLVKSRCQES

SEQ ID NO: 6032 - protein, 138 aa, unidentified
MMAEPWQALQLLLAILLTLMALPYQARKKTFLSVHEVMAVENYAKDSLQWITDQYNKESDDKYHFRIFRVLKVQRQVTDHLEYHLNVEMQWTTCQKPETTNCVPQERELHKQVNCFFSVFAVPWFEQYKILNKSCSSD

SEQ ID NO: 6033 - protein, 141 aa, unidentified
MAWPLCTLLLLLATQAVALAWSPQEEDRIIEGGIYDADLNDERVQRALHFVISEYNKATEDEYYRRLLRVLRAREQIVGGVNYFFDIEVGRTICTKSQPNLDTCAFHEQPELQKKQLCSFQIYEVPWEDRMSLVNSRCQEA

SEQ ID NO: 6034 - protein, 146 aa, unidentified
MAGPLRAPLLLLAILAVALAVSPAAGSSPGKPPRLVGGPMDASVEEEGVRRALDFAVGEYNKASNDMYHSRALQVVRARKQIVAGVNYFLDVELGRTTCTKTQPNLDNCPFHDQPHLKRKAFCSFQIYAVPWQGTMTLSKSTCQDA

SEQ ID NO: 6035 - protein, 141 aa, unidentified
MARPLCTLLLLMATLAGALASSSKEENRIIPGGIYDADLNDEWVQRALHFAISEYNKATEDEYYRRPLQVLRAREQTFGGVNYFFDVEVGRTICTKSQPNLDTCAFHEQPELQKKQLCSFEIYEVPWEDRMSLVNSRCQEA

SEQ ID NO: 6036 - protein, 142 aa, unidentified
MMWPMHTPLLLLTALMVAVAGSASAQSRTLAGGIHATDLNDKSVQCALDFAISEYNKVINKDEYYSRPLQVMAAYQQIVGGVNYYFNVKFGRTTCTKSQPNLDNCPFNDQPKLKEEEFCSFQINEVPWEDKISILNYKCRKV

SEQ ID NO: 6037 - protein, 149 aa, unidentified
MARSNLPLALGLALVAFCLLALPRDARARPQERMVGELRDLSPDDPQVQKAAQAAVASYNMGSNSIYYFRDTHIIKAQSQLVAGIKYFLTMEMGSTDCRKTRVTGDHVDLTTCPLAAGAQQEKLRCDFEVLVVPWQNSSQLLKHNCVQM

SEQ ID NO: 6038 - protein, 145 aa, unidentified
MRAAGTLLAFCCLVLSTTGGPSPDTCSQDLNSRVKPGFPKTIKTNDPGVLQAARYSVEKFNNCTNDMFLFKESRITRALVQIVKGLKYMLEVEIGRTTCKKNQHLRLDDCDFQTNHTLKQTLSCYSEVWVVPWLQHFEVPVLRCH

SEQ ID NO: 6039 - protein, 142 aa, unidentified
MPRCRWLSLILLTIPLALVARKDPKKNETGVLRKLKPVNASNANVKQCLWFAMQEYNKESEDKYVFLVVKTLQAQLQVTNLLEYLIDVEIARSDCRKPLSTNEICAIQENSKLKRKLSCSFLVGALPWNGEFTVMEKKCEDA

SEQ ID NO: 6040 - protein, 159 aa, unidentified
MSSPQRRKAMPWALSLLLMGFQLLVTYAWCSEEEMGGNNKIVQDPMFLATVEFALNTFNVQSKEEHAYRLLRVLSSWREDSMDRKWRGKMVFSMNLQLRQTVCRKFEDDIDNCPFQESLELNNVRQGISFPQVHSCGCCMGCGVGTGAADKAIPRDKGK

SEQ ID NO: 6041 - protein, 147 aa, unidentified
MLGLPWKGGLSWALLLLLLGSQILLIYAWHFHEQRDCDEHNVMARYLPATVEFAVHTFNQQSKDYYAYRLGHILNSWKEQVESKTVFSMELLLGRTRCGKFEDDIDNCHFQESTELNNTFTCFFTISTRPWMTQFSLLNKTCLEGFH

SEQ ID NO: 6042 - protein, 145 aa, unidentified
MGIGCWRNPLLLLIALVLSAKLGHFQRWEGFQQKLMSKKNMNSTLNFFIQSYNNASNDTYLYRVQRLIRSQMQLTTGVEYIVTVKIGWTKCKRNDTSNSSCPLQSKKLRKSLICESLIYTMPWINYFQLWNNSCLEAEHVGRNLR

SEQ ID NO: 6043 - protein, 264 aa, unidentified
MLRLLRLALAFYGRTADPAERQGPQQQGLPQGDTQLTTVQGVVTSFCGDYGMIDESIYFSSDVVTGNVPLKVGQKVNVVVEEDKPHYGLRAIKVDVVPRHLYGAGPSDSGTRVLIGCVTSINEDNIYISNSIYFSIAIVSEDFVPYKGDLLEVEYSTEPGISNIKATSVKPIRCIHTEEVCITSVHGRNGVIDYTIFFTLDSVKLPDGYVPQVDDIVNVVMVESIQFCFIWRAISITPVHKSSSGFQDDGGLGRPKRERRSQSI

SEQ ID NO: 6044 - protein, 385 aa, unidentified
MSRPQLRRWRLVSSPPSGVPGLALLALLALLALRLAAGTDCPCPEPELCRPIRHHPDFEVFVFDVGQKTWKSYDWSQITTVATFGKYDSELMCYAHSKGARVVLKGDVSLKDIIDPAFRASWIAQKLNLAKTQYMDGINIDIEQEVNCLSPEYDALTALVKETTDSFHREIEGSQVTFDVAWSPKNIDRRCYNYTGIADACDFLFVMSYDEQSQIWSECIAAANAPYNQTLTGYNDYIKMSINPKKLVMGVPWYGYDYTCLNLSEDHVCTIAKVPFRGAPCSDAAGRQVPYKTIMKQINSSISGNLWDKDQRAPYYNYKDPAGHFHQVWYDNPQSISLKATYIQNYRLRGIGMWNANCLDYSGDAVAKQQTEEMWEVLKPKLLQR

SEQ ID NO: 6045 - protein, 349 aa, unidentified
MTAASMGPVRVAFVVLLALCSRPAVGQNCSGPCRCPDEPAPRCPAGVSLVLDGCGCCRVCAKQLGELCTERDPCDPHKGLFCHFGSPANRKIGVCTAKDGAPCIFGGTVYRSGESFQSSCKYQCTCLDGAVGCMPLCSMDVRLPSPDCPFPRRVKLPGKCCEEWVCDEPKDQTVVGPALAAYRLEDTFGPDPTMIRANCLVQTTEWSACSKTCGMGISTRVTNDNASCRLEKQSRLCMVRPCEADLEENIKKGKKCIRTPKISKPIKFELSGCTSMKTYRAKFCGVCTDGRCCTPHRTTTLPVEFKCPDGEVMKKNMMFIKTCACHYNCPGDNDIFESLYYRKMYGDMA

SEQ ID NO: 6046 - protein, 243 aa, unidentified
MRPQGPAASPQRLRGLLLLLLLQLPAPSSASEIPKGKQKAQLRQREVVDLYNGMCLQGPAGVPGRDGSPGANGIPGTPGIPGRDGFKGEKGECLRESFEESWTPNYKQCSWSSLNYGIDLGKIAECTFTKMRSNSALRVLFSGSLRLKCRNACCQRWYFTFNGAECSGPLPIEAIIYLDQGSPEMNSTINIHRTSSVEGLCEGIGAGLVDVAIWVGTCSDYPKGDASTGWNSVSRIIIEELPK

SEQ ID NO: 6047 - protein, 223 aa, unidentified; identical to SEQ ID NO: 1146

SEQ ID NO: 6048 - protein, 367 aa, unidentified; identical to SEQ ID NO: 1147

SEQ ID NO: 6049 - protein, 263 aa, unidentified
MAFLWLLSCWALLGTTFGCGVPAIHPVLSGLSRIVNGEDAVPGSWPWQVSLQDKTGFHFCGGSLISEDWVVTAAHCGVRTSDVVVAGEFDQGSDEENIQVLKIAKVFKNPKFSILTVNNDITLLKLATPARFSQTVSAVCLPSADDDFPAGTLCATTGWGKTKYNANKTPDKLQQAALPLLSNAECKKSWGRRITDVMICAGASGVSSCMGDSGGPLVCQKDGAWTLVGIVSWGSRTCSTTTPAVYARVAKLIPWVQKILAAN

SEQ ID NO: 6050 - protein, 268 aa, unidentified [sequence omitted]

SEQ ID NO: 6051 - protein, 264 aa, unidentified
MLLLSLTLSLVLLGSSWGCGIPAIKPALSFSQRIVNGENAVLGSWPWQVSLQDSSGFHFCGGSLISQSWVVTAAHCNVSPGRHFVVLGEYDRSSNAEPLQVLSVSRAITHPSWNSTTMNNDVTLLKLASPAQYTTRISPVCLASSNEALTEGLTCVTTGWGRLSGVGNVTPAHLQQVALPLVTVNQCRQYWGSSITDSMICAGGAGASSCQGDSGGPLVCQKGNTWVLIGIVSWGTKNCNVRAPAVYTRVSKFSTWINQVIAYN

SEQ ID NO: 6052 - protein, 480 aa, unidentified
MIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLECVTNLQEVARIVGNSGLNIYNLYAPCAGGVPSHFRYEKDTVVVQDLGNIFTRLPLKRMWHQALLRSGDKVRMDPPCTNTTAASTYLNNPYVRKALNIPEQLPQWDMCNFLVNLQYRRLYRSMNSQYLKLLSSQKYQILLYNGDVDMACNFMGDEWFVDSLNQKMEVQRRPWLVKYGDSGEQIAGFVKEFSHIAFLTIKGAGHMVPTDKPLAAFTMFSRFLNKQPY

SEQ ID NO: 6053 - protein, 339 aa, unidentified
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAEDLLTCCGSMCGDGCNGGYPAEAWNFWTRKGLVSGGLYESHVGCRPYSIPPCEHHVNGSRPPCTGEGDTPKCSKICEPGYSPTYKQDKHYGYNSYSVSNSEKDIMAEIYKNGPVEGAFSVYSDFLLYKSGVYQHVTGEMMGGHAIRILGWGVENGTPYWLVANSWNTDWGDNGFFKILRGQDHCGIESEVVAGIPRTDQYWEKI

SEQ ID NO: 6054 - protein, 463 aa, unidentified
MGAGPSLLLAALLLLLSGDGAVRCDTPANCTYLDLLGTWVFQVGSSGSQRDVNCSVMGPQEKKVVVYLQKLDTAYDDLGNSGHFTIIYNQGFEIVLNDYKWFAFFKYKEEGSKVTTYCNETMTGWVHDVLGRNWACFTGKKVGTASENVYVNIAHLKNSQEKYSNRLYKYDHNFVKAINAIQKSWTATTYMEYETLTLGDMIRRSGGHSRKIPRPKPAPLTAEIQQKILHLPTSWDWRNVHGINFVSPVRNQASCGSCYSFASMGMLEARIRILTNNSQTPILSPQEVVSCSQYAQGCEGGFPYLIAGKYAQDFGLVEEACFPYTGTDSPCKMKEDCFRYYSSEYHYVGGFYGGCNEALMKLELVHHGPMAVAFEVYDDFLHYKKGIYHHTGLRDPFNPFELTNHAVLLVGYGTDSASGMDYWIVKNSWGTGWGENGYFRIRRGTDECAIESIAVAATPIPKL

SEQ ID NO: 6055 - protein, 412 aa, unidentified
MQPSSLLPLALCLLAAPASALVRIPLHKFTSIRRTMSEVGGSVEDLIAKGPVSKYSQAVPAVTEGPIPEVLKNYMDAQYYGEIGIGTPPQCFTVVFDTGSSNLWVPSIHCKLLDIACWIHHKYNSDKSSTYVKNGTSFDIHYGSGSLSGYLSQDTVSVPCQSASSASALGGVKVERQVFGEATKQPGITFIAAKFDGILGMAYPRISVNNVLPVFDNLMQQKLVDQNIFSFYLSRDPDAQPGGELMLGGTDSKYYKGSLSYLNVTRKAYWQVHLDQVEVASGLTLCKEGCEAIVDTGTSLMVGPVDEVRELQKAIGAVPLIQGEYMIPCEKVSTLPAITLKLGGKGYKLSPEDYTLKVSQAGKTLCLSGFMGMDIPPPSGPLWILGDVFIGRYYTVFDRDNNRVGFAEAARL

SEQ ID NO: 6056 - protein, 396 aa, unidentified
MKTLLLLLLVLLELGEAQGSLHRVPLRRHPSLKKKLRARSQLSEFWKSHNLDMIQFTESCSMDQSAKEPLINYLDMEYFGTISIGSPPQNFTVIFDTGSSNLWVPSVYCTSPACKTHSRFQPSQSSTYSQPGQSFSIQYGTGSLSGIIGADQVSVEGLTVVGQQFGESVTEPGQTFVDAEFDGILGLGYPSLAVGGVTPVFDNMMAQNLVDLPMFSVYMSSNPEGGAGSELIFGGYDHSHFSGSLNWVPVTKQAYWQIALDNIQVGGTVMFCSEGCQAIVDTGTSLITGPSDKIKQLQNAIGAAPVDGEYAVECANLNVMPDVTFTINGVPYTLSPTAYTLLDFVDGMQFCSSGFQGLDIHPPAGPLWILGDVFIRQFYSVFDRGNNRVGLAPAVP

SEQ ID NO: 6057 - protein, 484 aa, unidentified [sequence omitted]

SEQ ID NO: 6058 - protein, 255 aa, unidentified
MQPLLLLLAFLLPTGAEAGEIIGGRESRPHSRPYMAYLQIQSPAGQSRCGGFLVREDFVLTAAHCWGSNINVTLGAHNIQRRENTQQHITARRAIRHPQYNQRTIQNDIMLLQLSRRVRRNRNVNPVALPRAQEGLRPGTLCTVAGWGRVSMRRGTDTLREVQLRVQRDRQCLRIFGSYDPRRQICVGDRRERKAAFKGDSGGPLLCNNVAHGIVSYGKSSGVPPEVFTRVSSFLPWIRTTMRSFKLLDQMETPL

SEQ ID NO: 6059 - protein, 335 aa, unidentified
MWATLPLLCAGAWLLGVPVCGAAELCVNSLEKFHFKSWMSKHRKTYSTEEYHHRLQTFASNWRKINAHNNGNHTFKMALNQFSDMSFAEIKHKYLWSEPQNCSATKSNYLRGTGPYPPSVDWRKKGNFVSPVKNQGACGSCWTFSTTGALESAIAIATGKMLSLAEQQLVDCAQDFNNHGCQGGLPSQAFEYILYNKGIMGEDTYPYQGKDGYCKFQPGKAIGFVKDVANITIYDEEAMVEAVALYNPVSFAFEVTQDFMMYRTGIYSSTSCHKTPDKVNHAVLAVGYGEKNGIPYWIVKNSWGPQWGMNGYFLIERGKNMCGLAACASYPIPLV

SEQ ID NO: 6060 - protein, 329 aa, unidentified; identical to SEQ ID NO: 1148

SEQ ID NO: 6061 - protein, 333 aa, unidentified [sequence omitted]

SEQ ID NO: 6062 - protein, 321 aa, unidentified
MDVRALPWLPWLLWLLCRGGGDADSRAPFTPTWPRSREREAAAFRESLNRHRYLNSLFPSENSTAFYGINQFSYLFPEEFKAIYLRSKPSKFPRYSAEVHMSIPNVSLPLRFDWRDKQVVTQVRNQQMCGGCWAFSVVGAVESAYAIKGKPLEDLSVQQVIDCSYNNYGCNGGSTLNALNWLNKMQVKLVKDSEYPFKAQNGLCHYFSGSHSGFSIKGYSAYDFSDQEDEMAKALLTFGPLVVIVDAVSWQDYLGGIIQHHCSSGEANHAVLITGFDKTGSTPYWIVRNSWGSSWGVDGYAHVKMGSNVCGIADSVSSIFV

SEQ ID NO: 6063 - protein, 331 aa, unidentified
MKRLVCVLLVCSSAVAQLHKDPTLDHHWHLWKKTYGKQYKEKNEEAVRRLIWEKNLKFVMLHNLEHSMGMHSYDLGMNHLGDMTSEEVMSLMSSLRVPSQWQRNITYKSNPNRILPDSVDWREKGCVTEVKYQGSCGACWAFSAVGALEAQLKLKTGKLVSLSAQNLVDCSTEKYGNKGCNGGFMTTAFQYIIDNKGIDSDASYPYKAMDQKCQYDSKYRAATCSKYTELPYGREDVLKEAVANKGPVSVGVDARHPSFFLYRSGVYYEPSCTQNVNHGVLVVGYGDLNGKEYWLVKNSWGHNFGEEGYIRMARNKGNHCGIASFPSYPEI

SEQ ID NO: 6064 - protein, 334 aa, unidentified
MNLSLVLAAFCLGIASAVPKFDQNLDTKWYQWKATHRRLYGANEEGWRRAVWEKNMKMIELHNGEYSQGKHGFTMAMNAFGDMTNEEFRQMMGCFRNQKFRKGKVFREPLFLDLPKSVDWRKKGYVTPVKNQKQCGSCWAFSATGALEGQMFRKTGKLVSLSEQNLVDCSRPQGNQGCNGGFMARAFQYVKENGGLDSEESYPYVAVDEICKYRPENSVANDTGFTVVAPGKEKALMKAVATVGPISVAMDAGHSSFQFYKSGIYFEPDCSSKNLDHGVLVVGYGFEGANSNNSKYWLVKNSWGPEWGSNGYVKIAKDKNNHCGIATAASYPNV

SEQ ID NO: 6065 - protein, 376 aa, unidentified
MALTAHPSCLLALLVAGLAQGIRGPLRAQDLGPQPLELKEAFKLFQIQFNRSYLSPEEHAHRLDIFAHNLAQAQRLQEEDLGTAEFGVTPFSDLTEEEFGQLYGYRRAAGGVPSMGREIRSEEPEESVPFSCDWRKVASAISPIKDQKNCNCCWAMAAAGNIETLWRISFWDFVDVSVQELLDCGRCGDGCHGGFVWDAFITVLNNSGLASEKDYPFQGKVRAHRCHPKKYQKVAWIQDFIMLQNNEHRIAQYLATYGPITVTINMKPLQLYRKGVIKATPTTCDPQLVDHSVLLVGFGSVKSEEGIWAETVSSQSQPQPPHPTPYWILKNSWGAQWGEKGYFRLHRGSNTCGITKFPLTARVQKPDMKPRVSCPP

SEQ ID NO: 6066 - protein, 303 aa, unidentified
MARRGPGWRPLLLLVLLAGAAQGGLYFRRGQTCYRPLRGDGLAPLGRSTYPRPHEYLSPADLPKSWDWRNVDGVNYASITRNQHIPQYCGSCWAHASTSAMADRINIKRKGAWPSTLLSVQNVIDCGNAGSCEGGNDLSVWDYAHQHGIPDETCNNYQAKDQECDKFNQCGTCNEFKECHAIRNYTLWRVGDYGSLSGREKMMAEIYANGPISCGIMATERLANYTGGIYAEYQDTTYINHVVSVAGWGISDGTEYWIVRNSWGEPWGERGWLRIVTSTYKDGKGARYNLAIEEHCTFGDPIV

SEQ ID NO: 6067 - protein, 3623 aa, unidentified
MMNMSLPFLWSLLTLLIFAEVNGEAGELELQRQKRSINLQQPRMATERGNLVFLTGSAQNIEFRTGSLGKIKLNDEDLSECLHQIQKNKEDIIELKGSAIGLPQNISSQIYQLNSKLVDLERKFQGLQQTVDKKVCSSNPCQNGGTCLNLHDSFFCICPPQWKGPLCSADVNECEIYSGTPLSCQNGGTCVNTMGSYSCHCPPETYGPQCASKYDDCEGGSVARCVHGICEDLMREQAGEPKYSCVCDAGWMFSPNSPACTLDRDECSFQPGPCSTLVQCFNTQGSFYCGACPTGWQGNGYICEDINECEINNGGCSVAPPVECVNTPGSSHCQACPPGYQGDGRVCTLTDICSVSNGGCHPDASCSSTLGSLPLCTCLPGYTGNGYGPNGCVQLSNICLSHPCLNGQCIDTVSGYFCKCDSGWTGVNCTENINECLSNPCLNGGTCVDGVDSFSCECTRLWTGALCQVPQQVCGESLSGINGSFSYRSPDVGYVHDVNCFWVIKTEMGKVLRITFTFFRLESMDNCPHEFLQVYDGDSSSAFQLGRFCGSSLPHELLSSDNALYFHLYSEHLRNGRGFTVRWETQQPECGGILTGPYGSIKSPGYPGNYPPGRDCVWIVVTSPDLLVTFTFGTLSLEHHDDCNKDYLEIRDGPLYQDPLLGKFCTTFSVPPLQTTGPFARIHFHSDSQISDQGFHITYLTSPSDLRCGGNYTDPEGELFLPELSGPFTHTRQCVYMMKQPQGEQIQINFTHVELQCQSDSSQNYIEVRDGETLLGKVCGNGTISHIKSITNSVWIRFKIDASVEKASFRAVYQVACGDELTGEGVIRSPFFPNVYPGERTCRWTIHQPQSQVILLNFTVFEIGSSAHCETDYVEIGSSSILGSPENKKYCGTDIPSFITSVYNFLYVTFVKSSSTENHGFMAKFSAEDLACGEILTESTGTIQSPGHPNVYPHGINCTWHILVQPNHLIHLMFETFHLEFHYNCTNDYLEVYDTDSETSLGRYCGKSIPPSLTSSGNSLMLVFVTDSDLAYEGFLINYEAISAATACLQDYTDDLGTFTSPNFPNNYPNNWECIYRITVRTGQLIAVHFTNFSLEEAIGNYYTDFLEIRDGGYEKSPLLGIFYGSNLPPTIISHSNKLWLKFKSDQIDTRSGFSAYWDGSSTGCGGNLTTSSGTFISPNYPMPYYHSSECYWWLKSSHGSAFELEFKDFHLEHHPNCTLDYLAVYDGPSSNSHLLTQLCGDEKPPLIRSSGDSMFIKLRTDEGQQGRGFKAEYRQTCENVVIVNQTYGILESIGYPNPYSENQHCNWTIRATTGNTVNYTFLAFDLEHHINCSTDYLELYDGPRQMGRYCGVDLPPPGSTTSSKLQVLLLTDGVGRREKGFQMQWFVYGCGGELSGATGSFSSPGFPNRYPPNKECIWYIRTDPGSSIQLTIHDFDVEYHSRCNFDVLEIYGGPDFHSPRIAQLCTQRSPENPMQVSSTGNELAIRFKTDLSINGRGFNASWQAVTGGCGGIFQAPSGEIHSPNYPSPYRSNTDCSWVIRVDRNHRVLLNFTDFDLEPQDSCIMAYDGLSSTMSRLARTCGREQLANPIVSSGNSLFLRFQSGPSRQNRGFRAQFRQACGGHILTSSFDTVSSPRFPANYPNNQNCSWIIQAQPPLNHITLSFTHFELERSTTCARDFVEILDGGHEDAPLRGRYCGTDMPHPITSFSSALTLRFVSDSSISAGGFHTTVTASVSACGGTFYMAEGIFNSPGYPDIYPPNVECVWNIVSSPGNRLQLSFISFQLEDSQDCSRDFVEIREGNATGHLVGRYCGNSFPLNYSSIVGHTLWVRFISDGSGSGTGFQATFMKIFGNDNIVGTHGKVASPFWPENYPHNSNYQWTVNVNASHVVHGRILEMDIEEIQNCYYDKLRIYDGPSIHARLIGAYCGTQTESFSSTGNSLTFHFYSDSSISGKGFLLEWFAVDAPDGVLPTIAPGACGGFLRTGDAPVFLFSPGWPDSYSNRVDCTWLIQAPDSTVELNILSLDIESHRTCAYDSLVIRDGDNNLAQQLAVLCGREIPGPIRSTGEYMFIRFTSDSSVTRAGFNASFHKSCGGYLHADRGIITSPKYPETYPSNLNCSWHVLVQSGLTIAVHFEQPFQIPNGDSSCNQGDYLVLRNGPDICSPPLGPPGGNGHFCGSHASSTLFTSDNQMFVQFISDHSNEGQGFKIKYEAKSLACGGNVYIHDADSAGYVTSPNHPHNYPPHADCIWILAAPPETRIQLQFEDRFDIEVTPNCTSNYLELRDGVDSDAPILSKFCGTSLPSSQWSSGEVMYLRFRSDNSPTHVGFKAKYSIAQCGGRVPGQSGVVESIGHPTLPYRDNLFCEWHLQGLSGHYLTISFEDFNLQNSSGCEKDFVEIWDNHTSGNILGRYCGNTIPDSIDTSSNTAVVRFVTDGSVTASGFRLRFESSMEECGGDLQGSIGTFTSPNYPNPNPHGRICEWRITAPEGRRITLMFNNLRLATHPSCNNEHVIVFNGIRSNSPQLEKLCSSVNVSNEIKSSGNTMKVIFFTDGSRPYGGFTASYTSSEDAVCGGSLPNTPEGNFTSPGYDGVRNYSRNLNCEWTLSNPNQGNSSISIHFEDFYLESHQDCQFDVLEFRVGDADGPLMWRLCGPSKPTLPLVIPYSQVWIHFVTNERVEHIGFHAKYSFTDCGGIQIGDSGVITSPNYPNAYDSLTHCSSLLEAPQGHTITLTFSDFDIEPHTTCAWDSVTVRNGGSPESPIIGQYCGNSNPRTIQSGSNQLVVTFNSDHSLQGGGFYATWNTQTLGCGGIFHSDNGTIRSPHWPQNFPENSRCSWTAITHKSKHLEISFDNNFLIPSGDGQCQNSFVKVWAGTEEVDKALLATGCGNVAPGPVITPSNTFTAVFQSQEAPAQGFSASFVSRCGSNFTGPSGYIISPNYPKQYDNNMNCTYVIEANPLSVVLLTFVSFHLEARSAVTGSCVNDGVHIIRGYSVMSTPFATVCGDEMPAPLTIAGPVLLNFYSNEQITDFGFKFSYRIISCGGVFNFSSGIITSPAYSYADYPNDMHCLYTITVSDDKVIELKFSDFDVVPSTSCSHDYLAIYDGANTSDPLLGKFCGSKRPPNVKSSNNSMLLVFKTDSFQTAKGWKMSFRQTLGPQQGCGGYLTGSNNTFASPDSDSNGMYDKNLNCVWIIIAPVNKVIHLTFNTFALEAASTRQRCLYDYVKLYDGDSENANLAGTFCGSTVPAPFISSGNFLTVQFISDLTLEREGFNATYTIMDMPCGGTYNATWTPQNISSPNSSDPDVPFSICTWVIDSPPHQQVKITVWALQLTSQDCTQNYLQLQDSPQGHGNSRFQFCGRNASAVPVFYSSMSTAMVIFKSGVVNRNSRMSFTYQIADCNRDYHKAFGNLRSPGWPDNYDNDKDCTVTLTAPQNHTISLFFHSLGIENSVECRNDFLEVRNGSNSNSPLLGKYCGTLLPNPVFSQNNELYLRFKSDSVTSDRGYEIIWTSSPSGCGGTLYGDRGSFTSPGYPGTYPNNTYCEWVLVAPAGRLVTINFYFISIDDPGDCVQNYLTLYDGPNASSPSSGPYCGGDTSIAPFVASSNQVFIKFHADYARRPSAFRLTWDS

SEQ ID NO: 6068 - protein, 179 aa, unidentified
MSGGRAPAVLLGGVASLLLSFVWMPALLPVASRLLLLPRVLLTMASGSPPTQPSPASDSGSGYVPGSVSAAFVTCPNEKVAKEIARAVVEKRLAACVNLIPQITSIYEWKGKIEEDSEVLMMIKTQSSLVPALTDFVRSVHPYEVAEVIALPVEQGNFPYLQWVRQVTESVSDSITVLP

SEQ ID NO: 6069 - protein, 397 aa, unidentified; identical to SEQ ID NO: 1156

SEQ ID NO: 6070 - protein, 365 aa, unidentified; identical to SEQ ID NO: 1158

SEQ ID NO: 6071 - protein, 107 aa, unidentified
MARAALSAAPSNPRLLRVALLLLLLVAAGRRAAGASVATELRCQCLQTLQGIHPKNIQSVNVKSPGPHCAQTEVIATLKNGRKACLNPASPIVKKIIEKMLNSDKSN

SEQ ID NO: 6072 - protein, 98 aa, unidentified
MNQTAILICCLIFLTLSGIQGVPLSRTVRCTCISISNQPVNPRSLEKLEIIPASQFCPRVEIIATMKKKGEKRCLNPESKAIKNLLKAVSKERSKRSP

SEQ ID NO: 6073 - protein, 94 aa, unidentified
MSVKGMAIALAVILCATVVQGFPMFKRGRCLCIGPGVKAVKVADIEKASIMYPSNNCDKIEVIITLKENKGQRCLNPKSKQARLIIKKVERKNF

SEQ ID NO: 6074 - protein, 93 aa, unidentified
MNAKVVVVLVLVLTALCLSDGKPVSLSYRCPCRFFESHVARANVKHLKILNTPNCALQIVARLKNNNRQVCIDPKLKWIQEYLEKALNKRFKM

SEQ ID NO: 6075 - protein, 109 aa, unidentified
MKFISTSLLLMLLVSSLSPVQGVLEVYYTSLRCRCVQESSVFIPRRFIDRIQILPRGNGCPRKEIIVWKKNKSIVCVDPQAEWIQRMMEVLRKRSSSTLPVPVFKRKIP

SEQ ID NO: 6076 - protein, 111 aa, unidentified
MSLLPRRAPPVSMRLLAAALLLLLLALYTARVDGSKCKCSRKGPKIRYSDVKKLEMKPKYPHCEEKMVIITTKSVSRYRGQEHCLHPKLQSTKRFIKWYNAWNEKRRVYEE

SEQ ID NO: 6077 - protein, 119 aa, unidentified
MKVLISSLLLLLPLMLMSMVSSSLNPGVARGHRDRGQASRRWLQEGGQECECKDWFLRAPRRKFMTVSGLPKKQCPCDHFKGNVKKTRHQRHHRKPNKHSRACQQFLKQCQLRSFALPL

SEQ ID NO: 6078 - protein, 107 aa, unidentified
MARATLSAAPSNPRLLRVALLLLLLVAASRRAAGAPLATELRCQCLQTLQGIHLKNIQSVKVKSPGPHCAQTEVIATLKNGQKACLNPASPMVKKIIEKMLKNGKSN

SEQ ID NO: 6079 - protein, 107 aa, unidentified
MAHATLSAAPSNPRLLRVALLLLLLVAASRRAAGASVVTELRCQCLQTLQGIHLKNIQSVNVRSPGPHCAQTEVIATLKNGKKACLNPASPMVQKIIEKILNKGSTN

SEQ ID NO: 6080 - protein, 114 aa, unidentified
MSLLSSRAARVPGPSSSLCALLVLLLLLTQPGPIASAGPAAAVLRELRCVCLQTTQGVHPKMISNLQVFAIGPQCSKVEVVASLKNGKEICLDPEAPFLKKVIQKILDGGNKEN

SEQ ID NO: 6081 - protein, 114 aa, unidentified
MSLPSSRAARVPGPSGSLCALLALLLLLTPPGPLASAGPVSAVLTELRCTCLRVTLRVNPKTIGKLQVFPAGPQCSKVEVVASLKNGKQVCLDPEAPFLKKVIQKILDSGNKKN

SEQ ID NO: 6082 - protein, 99 aa, unidentified
MTSKLAVALLAAFLISAALCEGAVLPRSAKELRCQCIKTYSKPFHPKFIKELRVIESGPHCANTEIIVKLSDGRELCLDPKENWVQRVVEKFLKRAENS

SEQ ID NO: 6083 - protein, 125 aa, unidentified
MKKSGVLFLLGIILLVLIGVQGTPVVRKGRCSCISTNQGTIHLQSLKDLKQFAPSPSCEKIEIIATLKNGVQTCLNPDSADVKELIKKWEKQVSQKKKQKNGKKHQKKKVLKVRKSQRSRQKKTT

SEQ ID NO: 6084 - protein, 433 aa, unidentified
MEPQLGPEAAALRPGWLALLLWVSALSCSFSLPASSLSSLVPQVRTSYNFGRTFLGLDKCNACIGTSICKKFFKEEIRSDNWLASHLGLPPDSLLSYPANYSDDSKIWRPVEIFRLVSKYQNEISDRRICASASAPKTCSIERVLRKTERFQKWLQAKRLTPDLVQGLASPLLRCPSQRLLDRVVRRYAEVADAGSIFMDHFTDRDKLRLLYTLAVNSHPILLQIFPGAEGWPLPKYLGSCGRFLVSTSTRPLQEFYDAPPDQAADLAYQLLGVLESLRSNDLNYFFYFTHIDAGMFGVFNNGHLFIRDASAVGVIDKQEGSQEANRAGENKDIFSCLVSGCQAQLPSCESISEKQSLVLVCQKLLPRLLQGRFPSPVQDDIDSILVQCGDSIRPDPEVLGAASQLKDILRPLRTCDSRFAYRYPDCKYNDKF

SEQ ID NO: 6085 - protein, 264 aa, unidentified
MLRCGGRGLLLGLAVAAAAVMAARLMGWWGPRAGFRLFIPEELSRYRGGPGDPGLYLALLGRVYDVSSGRRHYEPGSHYSGFAGRDASRAFVTGDCSEAGLVDDVSDLSAAEMLTLHNWLSFYEKNYVCVGRVTGRFYGEDGLPTPALTQVEAAITRGLEANKLQLQEKQTFPPCNAEWSSARGSRLWCSQKSGGVSRDWIGVPRKLYKPGAKEPRCVCVRTTGPPSGQMPDNPPHRNRGDLDHPNLAEYTGCPPLAITCSFPL

SEQ ID NO: 6086 - protein, 362 aa, unidentified; identical to SEQ ID NO: 1179

SEQ ID NO: 6087 - protein, 508 aa, unidentified
MWELVALLLLTLAYLFWPKRRCPGAKYPKSLLSLPLVGSLPFLPRHGHMHNNFFKLQKKYGPIYSVRMGTKTTVIVGHHQLAKEVLIKKGKDFSGRPQMATLDIASNNRKGIAFADSGAHWQLHRRLAMATFALFKDGDQKLEKIICQEISTLCDMLATHNGQSIDISFPVFVAVTNVISLICFNTSYKNGDPELNVIQNYNEGIIDNLSKDSLVDLVPWLKIFPNKTLEKLKSHVKIRNDLLNKILENYKEKFRSDSITNMLDTLMQAKMNSDNGNAGPDQDSELLSDNHILTTIGDIFGAGVETTTSVVKWTLAFLLHNPQVKKKLYEEIDQNVGFSRTPTISDRNRLLLLEATIREVLRLRPVAPMLIPHKANVDSSIGEFAVDKGTEVIINLWALHHNEKEWHQPDQFMPERFLNPAGTQLISPSVSYLPFGAGPRSCIGEILARQELFLIMAWLLQRFDLEVPDDGQLPSLEGIPKVVFLIDSFKVKIKVRQAWREAQAEGST

SEQ ID NO: 6088 - protein, 462 aa, unidentified; identical to SEQ ID NO: 1184

SEQ ID NO: 6089 - protein, 494 aa, unidentified [sequence omitted]

SEQ ID NO: 6090 - protein, 512 aa, unidentified
MLFEGLDLVSALATLAACLVSVTLLLAVSQQLWQLRWAATRDKSCKLPIPKGSMGFPLIGETGHWLLQGSGFQSSRREKYGNVFKTHLLGRPLIRVTGAENVRKILMGEHHLVSTEWPRSTRMLLGPNTVSNSIGDIHRNKRKVFSKIFSHEALESYLPKIQLVIQDTLRAWSSHPEAINVYQEAQKLTFRMAIRVLLGFSIPEEDLGHLFEVYQQFVDNVFSLPVDLPFSGYRRGIQARQILQKGLEKAIREKLQCTQGKDYLDALDLLIESSKEHGKEMTMQELKDGTLELIFAAYATTASASTSLIMQLLKHPTVLEKLRDELRAHGILHSGGCPCEGTLRLDTLSGLRYLDCVIKEVMRLFTPISGGYRTVLQTFELDGFQIPKGWSVMYSIRDTHDTAPVFKDVNVFDPDRFSQARSEDKDGRFHYLPFGGGVRTCLGKHLAKLFLKVLAVELASTSRFELATRTFPRITLVPVLHPVDGLSVKFFGLDSNQNEILPETEAMLSATV

SEQ ID NO: 6091 - protein, 494 aa, unidentified
MLASGLLLVTLLACLTVMVLMSVWRQRKSRGKLPPGPTPLPFIGNYLQLNTEQMYNSLMKISERYGPVFTIHLGPRRVVVLCGHDAVKEALVDQAEEFSGRGEQATFDWLFKGYGVAFSNGERAKQLRRFSIATLRGFGVGKRGIEERIQEEAGFLIDALRGTHGANIDPTFFLSRTVSNVISSIVFGDRFDYEDKEFLSLLRMMLGSFQFTATSTGQLYEMFSSVMKHLPGPQQQAFKELQGLEDFIAKKVEHNQRTLDPNSPRDFIDSFLIRMQEEEKNPNTEFYLKNLVMTTLNLFFAGTETVSTTLRYGFLLLMKHPEVEAKVHEEIDRVIGKNRQPKFEDRAKMPYTEAVIHEIQRFGDMLPMGLAHRVNKDTKFRDFFLPKGTEVFPMLGSVLRDPRFFSNPRDFNPQHFLDKKGQFKKSDAFVPFSIGKRYCFGEGLARMELFLFFTTIMQNFRFKSPQSPKDIDVSPKHVGFATIPRNYTMSFLPR

SEQ ID NO: 6092 - protein, 494 aa, unidentified
MLASGMLLVALLVCLTVMVLMSVWQQRKSKGKLPPGPTPLPFIGNYLQLNTEQMYNSLMKISERYGPVFTIHLGPRRVVVLCGHDAVREALVDQAEEFSGRGEQATFDWVFKGYGVVFSNGERAKQLRRFSIATLRDFGVGKRGIEERIQEEAGFLIDALRGTGGANIDPTFFLSRTVSNVISSIVFGDRFDYKDKEFLSLLRMMLGIFQFTSTSTGQLYEMFSSVMKHLPGPQQQAFQLLQGLEDFIAKKVEHNQRTLDPNSPRDFIDSFLIRMQEEEKNPNTEFYLKNLVMTTLNLFIGGTETVSTTLRYGFLLLMKHPEVEAKVHEEIDRVIGKNRQPKFEDRAKMPYMEAVIHEIQRFGDVIPMSLARRVKKDTKFRDFFLPKGTEVYPMLGSVLRDPSFFSNPQDFNPQHFLNEKGQFKKSDAFVPFSIGKRNCFGEGLARMELFLFFTTVMQNFRLKSSQSPKDIDVSPKHVGFATIPRNYTMSFLPR

SEQ ID NO: 6093 - protein, 494 aa, unidentified
MLASGLLLVALLACLTVMVLMSVWQQRKSRGKLPPGPTPLPFIGNYLQLNTEHICDSIMKFSECYGPVFTIHLGPRRVVVLCGHDAVREALVDQAEEFSGRGEQATFDWVFKGYGVAFSNGERAKQLLRFAIATLRDFGVGKRGIEERIQEESGFLIEAIRSTHGANIDPTFFLSRTVSNVISSIVFGDRFDYEDKEFLSLLSMMLGIFQFTSTSTGQLYEMFSSVMKHLPGPQQQAFKLLQGLEDFIAKKVEHNQRTLDPNSPQDFIDSFLIHMQEEEKNPNTEFYLKNLMMSTLNLFIAGTETVSTTLRYGFLLLMKHPEVEAKVHEEIDRVIGKNRQPKFEDRTKMPYMEAVIHEIQRFGDVIPMSLARRVKKDTKFRDFFLPKGTEVFPMLGSVLRDPSFFSNPQDFNPQHFLDDKGQFKKSDAFVPFSIGKRNCFGEGLARMELFLFFTTVMQNFRLKSSQSPKDIDVSPKHVVFATIPRNYTMSFLPR

SEQ ID NO: 6094 - protein, 491 aa, unidentified
MELSVLLFLALLTGLLLLLVQRHPNTHDRLPPGPRPLPLLGNLLQMDRRGLLKSFLRFREKYGDVFTVHLGPRPVVMLCGVEAIREALVDKAEAFSGRGKIAMVDPFFRGYGVIFANGNRWKVLRRFSVTTMRDFGMGKRSVEERIQEEAQCLIEELRKSKGALMDPTFLFQSITANIICSIVFGKRFHYQDQEFLKMLNLFYQTFSLISSVFGQLFELFSGFLKYFPGAHRQVYKNLQEINAYIGHSVEKHRETLDPSAPKDLIDTYLLHMEKEKSNAHSEFSHQNLNLNTLSLFFAGTETTSTTLRYGFLLMLKYPHVAERVYREIEQVIGPHRPPELHDRAKMPYTEAVIYEIQRFSDLLPMGVPHIVTQHTSFRGYIIPKDTEVFLILSTALHDPHYFEKPDAFNPDHFLDANGALKKTEAFIPFSLGKRICLGEGIARAELFLFFTTILQNFSMASPVAPEDIDLTPQECGVGKIPPTYQIRFLPR

SEQ ID NO: 6095 - protein, 490 aa, unidentified
MDPAVALVLCLSCLFLLSLWRQSSGRGRLPSGPTPLPIIGNILQLDVKDMSKSLTNFSKVYGPVFTVYFGLKPIVVLHGYEAVKEALIDHGEEFSGRGSFPVAEKVNKGLGILFSNGKRWKEIRRFCLMTLRNFGMGKRSIEDRVQEEARCLVEELRKTNASPCDPTFILGCAPCNVICSVIFHDRFDYKDQRFLNLMEKFNENLRILSSPWIQVCNNFPALIDYLPGSHNKIAENFAYIKSYVLERIKEHQESLDMNSARDFIDCFLIKMEQEKHNQQSEFTVESLIATVTDMFGAGTETTSTTLRYGLLLLLKYPEVTAKVQEEIECVVGRNRSPCMQDRSHMPYTDAVVHEIQRYIDLLPTNLPHAVTCDVKFKNYLIPKGTTIITSLTSVLHNDKEFPNPEMFDPGHFLDKSGNFKKSDYFMPFSAGKRMCMGEGLARMELFLFLTTILQNFNLKSQVDPKDIDITPIANAFGRVPPLYQLCFIPV

SEQ ID NO: 6096 - protein, 490 aa, unidentified [sequence omitted]

SEQ ID NO: 6097 - protein, 490 aa, unidentified
MEPFVVLVLCLSFMLLFSLWRQSCRRRKLPPGPTPLPIIGNMLQIDVKDICKSFTNFSKVYGPVFTVYFGMNPIVVFHGYEAVKEALIDNGEEFSGRGNSPISQRITKGLGIISSNGKRWKEIRRFSLTTLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFIDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKGTTIMALLTSVLHDDKEFPNPNIFDPGHFLDKNGNFKKSDYFMPFSAGKRICAGEGLARMELFLFLTTILQNFNLKSVDDLKNLNTTAVTKGIVSLPPSYQICFIPV

SEQ ID NO: 6098 - protein, 490 aa, unidentified [sequence omitted]

SEQ ID NO: 6099 - protein, 493 aa, unidentified
MSALGVTVALLVWAAFLLLVSMWRQVHSSWNLPPGPFPLPIIGNLFQLELKNIPKSFTRLAQRFGPVFTLYVGSQRMVVMHGYKAVKEALLDYKDEFSGRGDLPAFHAHRDRGIIFNNGPTWKDIRRFSLTTLRNYGMGKQGNESRIQREAHFLLEALRKTQGQPFDPTFLIGCAPCNVIADILFRKHFDYNDEKFLRLMYLFNENFHLLSTPWLQLYNNFPSFLHYLPGSHRKVIKNVAEVKEYVSERVKEHHQSLDPNCPRDLTDCLLVEMEKEKHSAERLYTMDGITVTVADLFFAGTETTSTTLRYGLLILMKYPEIEEKLHEEIDRVIGPSRIPAIKDRQEMPYMDAVVHEIQRFITLVPSNLPHEATRDTIFRGYLIPKGTVVVPTLDSVLYDNQEFPDPEKFKPEHFLNENGKFKYSDYFKPFSTGKRVCAGEGLARMELFLLLCAILQHFNLKPLVDPKDIDLSPIHIGFGCIPPRYKLCVIPRS

SEQ ID NO: 6100 - protein, 491 aa, unidentified
MDSISTAILLLLLALVCLLLTLSSRDKGKLPPGPRPLSILGNLLLLCSQDMLTSLTKLSKEYGSMYTVHLGPRRVVVLSGYQAVKEALVDQGEEFSGRGDYPAFFNFTKGNGIAFSSGDRWKVLRQFSIQILRNFGMGKRSIEERILEEGSFLLAELRKTEGEPFDPTFVLSRSVSNIICSVLFGSRFDYDDERLLTIIRLINDNFQIMSSPWGELYDIFPSLLDWVPGPHQRIFQNFKCLRDLIAHSVHDHQASLDPRSPRDFIQCFLTKMAEEKEDPLSHFHMDTLLMTTHNLLFGGTKTVSTTLHHAFLALMKYPKVQARVQEEIDLVVGRARLPALKDRAAMPYTDAVIHEVQRFADIIPMNLPHRVTRDTAFRGFLIPKGTDVITLLNTVHYDPSQFLTPQEFNPEHFLDANQSFKKSPAFMPFSAGRRLCLGESLARMELFLYLTAILQSFSLQPLGAPEDIDLTPLSSGLGNLPRPFQLCLRPR

SEQ ID NO: 6101 - protein, 502 aa, unidentified
MLAAMGSLAAALWAVVHPRTLLLGTVAFLLAADFLKRRRPKNYPPGPWRLPFLGNFFLVDFEQSHLEVQLFVKKYGNLFSLELGDISAVLITGLPLIKEALIHMDQNFGNRPVTPMREHIFKKNGLIMSSGQAWKEQRRFTLTALRNFGLGKKSLEERIQEEAQHLTEAIKEENGQPFDPHFKINNAVSNIICSITFGERFEYQDSWFQQLLKLLDEVTYLEASKTCQLYNVFPWIMKFLPGPHQTLFSNWKKLKLFVSHMIDKHRKDWNPAETRDFIDAYLKEMSKHTGNPTSSFHEENLICSTLDLFFAGTETTSTTLRWALLYMALYPEIQEKVQAEIDRVIGQGQQPSTAARESMPYTNAVIHEVQRMGNIIPLNVPREVTVDTTLAGYHLPKGTMILTNLTALHRDPTEWATPDTFNPDHFLENGQFKKREAFMPFSIGKRACLGEQLARTELFIFFTSLMQKFTFRPPNNEKLSLKFRMGITISPVSHRLCAVPQV

SEQ ID NO: 6102 - protein, 501 aa, unidentified
MWKLWRAEEGAAALGGALFLLLFALGVRQLLKQRRPMGFPPGPPGLPFIGNIYSLAASSELPHVYMRKQSQVYGEIFSLDLGGISTVVLNGYDVVKECLVHQSEIFADRPCLPLFMKMTKMGGLLNSRYGRGWVDHRRLAVNSFRYFGYGQKSFESKILEETKFFNDAIETYKGRPFDFKQLITNAVSNITNLIIFGERFTYEDTDFQHMIELFSENVELAASASVFLYNAFPWIGILPFGKHQQLFRNAAVVYDFLSRLIEKASVNRKPQLPQHFVDAYLDEMDQGKNDPSSTFSKENLIFSVGELIIAGTETTTNVLRWAILFMALYPNIQGQVQKEIDLIMGPNGKPSWDDKCKMPYTEAVLHEVLRFCNIVPLGIFHATSEDAVVRGYSIPKGTTVITNLYSVHFDEKYWRDPEVFHPERFLDSSGYFAKKEALVPFSLGRRHCLGEHLARMEMFLFFTALLQRFHLHFPHELVPDLKPRLGMTLQPQPYLICAERR

SEQ ID NO: 6103 - protein, 504 aa, unidentified; identical to SEQ ID NO: 1187

SEQ ID NO: 6104 - protein, 490 aa, unidentified
MALLLLLFLGLLGLWGLLCACAQDPSPAARWPPGPRPLPLVGNLHLLRLSQQDRSLMELSERYGPVFTVHLGRQKTVVLTGFEAVKEALAGPGQELADRPPIAIFQLIQRGGGIFFSSGARWRAARQFTVRALHSLGVGREPVADKILQELKCLSGQLDGYRGRPFPLALLGWAPSNITFALLFGRRFDYRDPVFVSLLGLIDEVMVLLGSPGLQLFNVYPWLGALLQLHRPVLRKIEEVRAILRTLLEARRPHVCPGDPVCSYVDALIQQGQGDDPEGLFAEANAVACTLDMVMAGTETTSATLQWAALLMGRHPDVQGRVQEELDRVLGPGRTPRLEDQQALPYTSAVLHEVQRFITLLPHVPRCTAADTQLGGFLLPKGTPVIPLLTSVLLDETQWQTPGQFNPGHFLDANGHFVKREAFLPFSAGRRVCVGERLARTELFLLFAGLLQRYRLLPPPGVSPASLDTTPARAFTMRPRAQALCAVPRP

SEQ ID NO: 6105 - protein, 500 aa, unidentified
MSPGLLLLGSAVLLAFGLCCTFVHRARSRYEHIPGPPRPSFLLGHLPCFWKKDEVGGRVLQDVFLDWAKKYGPVVRVNVFHKTSVIVTSPESVKKFLMSTKYNKDSKMYRALQTVFGERLFGQGLVSECNYERWHKQRRVIDLAFSRSSLVSLMETFNEKAEQLVEILEAKADGQTPVSMQDMLTYTAMDILAKAAFGMETSMLLGAQKPLSQAVKLMLEGITASRNTLAKFLPGKRKQLREVRESIRFLRQVGRDWVQRRREALKRGEEVPADILTQILKAEEGAQDDEGLLDNFVTFFIAGHETSANHLAFTVMELSRQPEIVARLQAEVDEVIGSKRYLDFEDLGRLQYLSQVLKESLRLYPPAWGTFRLLEEETLIDGVRVPGNTPLLFSTYVMGRMDTYFEDPLTFNPDRFGPGAPKPRFTYFPFSLGHRSCIGQQFAQMEVKVVMAKLLQRLEFRLVPGQRFGLQEQATLKPLDPVLCTLRPRGWQPAPPPPPC

SEQ ID NO: 6106 - protein, 524 aa, unidentified
MPQLSLSWLGLGPVAASPWLLLLLVGGSWLLARVLAWTYTFYDNCRRLQCFPQPPKQNWFWGHQGLVTPTEEGMKTLTQLVTTYPQGFKLWLGPTFPLLILCHPDIIRPITSASAAVAPKDMIFYGFLKPWLGDGLLLSGGDKWSRHRRMLTPAFHFNILKPYMKIFNKSVNIMHDKWQRLASEGSARLDMFEHISLMTLDSLQKCVFSFESNCQEKPSEYIAAILELSAFVEKRNQQILLHTDFLYYLTPDGQRFRRACHLVHDFTDAVIQERRCTLPTQGIDDFLKNKAKSKTLDFIDVLLLSKDEDGKELSDEDIRAEADTFMFEGHDTTASGLSWVLYHLAKHPEYQEQCRQEVQELLKDREPIEIEWDDLAQLPFLTMCIKESLRLHPPVPVISRCCTQDFVLPDGRVIPKGIVCLINIIGIHYNPTVWPDPEVYDPFRFDQENIKERSPLAFIPFSAGPRNCIGQAFAMAEMKVVLALTLLHFRILPTHTEPRRKPELILRAEGGLWLRVEPLGANSQ

SEQ ID NO: 6107 - protein, 520 aa, unidentified; identical to SEQ ID NO: 1198

SEQ ID NO: 6108 - protein, 381 aa, unidentified [sequence omitted]

SEQ ID NO: 6109 - protein, 136 aa, unidentified
MRTPGPLPVLLLLLAGAPAARPTPPTCYSRMRALSQEITRDFNLLQVSEPSEPCVRYLPRLYLDIHNYCVLDKLRDFVASPPCWKVAQVDSLKDKARKLYTIMNSFCRRDLVFLLDDCNALEYPIPVTTVLPDRQR

SEQ ID NO: 6110 - protein, 521 aa, unidentified
MLPRRPLAWPAWLLRGAPGAAGSWGRPVGPLARRGCCSAPGTPEVPLTRERYPVRRLPFSTVSKQDLAAFERIVPGGVVTDPEALQAPNVDWLRTLRGCSKVLLRPRTSEEVSHILRHCHERNLAVNPQGGNTGMVGGSVPVFDEIILSTARMNRVLSFHSVSGILVCQAGCVLEELSRYVEERDFIMPLDLGAKGSCHIGGNVATNAGGLRFLRYGSLHGTVLGLEVVLADGTVLDCLTSLRKDNTGYDLKQLFIGSEGTLGIITTVSILCPPKPRAVNVAFLGCPGFAEVLQTFSTCKGMLGEILSAFEFMDAVCMQLVGRHLHLASPVQESPFYVLIETSGSNAGHDAEKLGHFLEHALGSGLVTDGTMATDQRKVKMLWALRERITEALSRDGYVYKYDLSLPVERLYDIVTDLRARLGPHAKHVVGYGHLGDGNLHLNVTAEAFSPSLLAALEPHVYEWTAGQQGSVSAEHGVGFRKRDVLGYSKPPGALQLMQQLKALLDPKGILNPYKTLPSQA

SEQ ID NO: 6111 - protein, 895 aa, unidentified; identical to SEQ ID NO: 1210

SEQ ID NO: 6112 - protein, 189 aa, unidentified
MLLGQLSTLLCLLSGALPTGSGRPEPQSPRPQSWAAANQTWALGPGALPPLVPASALGSWKAFLGLQKARQLGMGRLQRGQDEVAAVTLPLNPQEVIQGMCKAVPFVQVFSRPGCSAIRLRNHLCFGHCSSLYIPGSDPTPLVLCNSCMPARKRWAPVVLWCLTGSSASRRRVKISTMLIEGCHCSPKA

SEQ ID NO: 6113 - protein, 347 aa, unidentified
MRVVVIGAGVIGLSTALCIHERYHSVLQPLDIKVYADRFTPLTTTDVAAGLWQPYLSDPNNPQEADWSQQTFDYLLSHVHSPNAENLGLFLISGYNLFHEAIPDPSWKDTVLGFRKLTPRELDMFPDYGYGWFHTSLILEGKNYLQWLTERLTERGVKFFQRKVESFEEVAREGADVIVNCTGVWAGALQRDPLLQPGRGQIMKVDAPWMKHFILTHDPERGIYNSPYIIPGTQTVTLGGIFQLGNWSELNNIQDHNTIWEGCCRLEPTLKNARIIGERTGFRPVRPQIRLEREQLRTGPSNTEVIHNYGHGGYGLTIHWGCALEAAKLFGRILEEKKLSRMPPSHL

SEQ ID NO: 6114 - protein, 168 aa, unidentified
MNSKGQYPTQPTYPVQPPGNPVYPQTLHLPQAPPYTDAPPAYSELYRPSFVHPGAATVPTMSAAFPGASLYLPMAQSVAVGPLGSTIPMAYYPVGPIYPPGSTVLVEGGYDAGARFGAGATAGNIPPPPPGCPPNAAQLAVMQGANVLVTQRKGNFFMGGSDGGYTIW

SEQ ID NO: 6115 - protein, 617 aa, unidentified
MPALSRWASLPGPSMREAAFMYSTAVAIFLVILVAALQGSAPRESPLPYHIPLDPEGSLELSWNVSYTQEAIHFQLLVRRLKAGVLFGMSDRGELENADLVVLWTDGDTAYFADAWSDQKGQIHLDPQQDYQLLQVQRTPEGLTLLFKRPFGTCDPKDYLIEDGTVHLVYGILEEPFRSLEAINGSGLQMGLQRVQLLKPNIPEPELPSDACTMEVQAPNIQIPSQETTYWCYIKELPKGFSRHHIIKYEPIVTKGNEALVHHMEVFQCAPEMDSVPHFSGPCDSKMKPDRLNYCRHVLAAWALGAKAFYYPEEAGLAFGGPGSSRYLRLEVHYHNPLVIEGRNDSSGIRLYYTAKLRRFNAGIMELGLVYTPVMAIPPRETAFILTGYCTDKCTQLALPPSGIHIFASQLHTHLTGRKVVTVLVRDGREWEIVNQDNHYSPHFQEIRMLKKVVSVHPGDVLITSCTYNTEDRELATVGGFGILEEMCVNYVHYYPQTQLELCKSAVDAGFLQKYFHLINRFNNEDVCTCPQASVSQQFTSVPWNSFNRDVLKALYSFAPISMHCNKSSAVRFQGEWNLQPLPKVISTLEEPTPQCPTSQGRSPAGPTVVSIGGGKG

SEQ ID NO: 6116 - protein, 430 aa, unidentified
MAANLSRNGPALQEAYVRVVTEKSPTDWALFTYEGNSNDIRVAGTGEGGLEEMVEELNSGKVMYAFCRVKDPNSGLPKFVLINWTGEGVNDVRKGACASHVSTMASFLKGAHVTINARAEEDVEPECIMEKVAKASGANYSFHKESGRFQDVGPQAPVGSVYQKTNAVSEIKRVGKDSFWAKAEKEEENRRLEEKRRAEEAQRQLEQERRERELREAARREQRYQEQGGEASPQRTWEQQQEVVSRNRNEQESAVHPREIFKQKERAMSTTSISSPQPGKLRSPFLQKQLTQPETHFGREPAAAISRPRADLPAEEPAPSTPPCLVQAEEEAVYEEPPEQETFYEQPPLVQQQGAGSEHIDHHIQGQGLSGQGLCARALYDYQAADDTEISFDPENLITGIEVIDEGWWRGYGPDGHFGMFPANYVELIE

SEQ ID NO: 6117 - protein, 110 aa, unidentified
MRFMTLLFLTALAGALVCAYDPEAASAPGSGNPCHEASAAQKENAGEDPGLARQAPKPRKQRSSLLEKGLDGAKKAVGGLGKLGKDAVEDLESVGKGAVHDVKDVLDSVL

SEQ ID NO: 6118 - protein, 359 aa, unidentified
MKATIILLLLAQVSWAGPFQQRGLFDFMLEDEASGIGPEVPDDRDFEPSLGPVCPFRCQCHLRVVQCSDLGLDKVPKDLPPDTTLLDLQNNKITEIKDGDFKNLKNLHALILVNNKISKVSPGAFTPLVKLERLYLSKNQLKELPEKMPKTLQELRAHENEITKVRKVTFNGLNQMIVIELGTNPLKSSGIENGAFQGMKKLSYIRIADTNITSIPQGLPPSLTELHLDGNKISRVDAASLKGLNNLAKLGLSFNSISAVDNGSLANTPHLRELHLDNNKLTRVPGGLAEHKYIQVVYLHNNNISVVGSSDFCPPGHNTKKASYSGVSLFSNPVQYWEIQPSTFRCVYVRSAIQLGNYK

SEQ ID NO: 6119 - protein, 998 aa, unidentified
MNRRRKFLLASVLALQNSSFIYPSCQKCFSRIILVSKRSNCPKCGSTGESGNANYRYKLSLKVAESNKLFVITVFGSCLDTFFGLTATGLHRYIQDPNKIPETLDNDTTQNLLTKAVETCFVGQSFIFGVTNFENQPGQGSDASNFLQQCSDHKRKAKALVACQIVLPDPGIAGFTVIDYFHQLLQTFNFRKLQCDSQAPNNHLLALDHSNSDLSSIYTSDSTSDFFKSCSKDTFSKFWQPSLEFTCIVSQLTDNDDFSASEQSKAFGTLQQNRKSISIAEATGSSSCHDPIQDSWSLVSYMDKKSTAEKLGKELGLQAKELSAVHSSHHEIGVNDSNLFSLEMREPLESSNTKSFHSAVEIKNRSQHELPCFQHHGIDTPTSLQKRSACCPPSLLRLEETASSSQDGDPQIWDDLPFSESLNKFLAVLESEIAVTQADVSSRKHHVDNDIDKFHADHSRLSVTPQRTTGALHTPPIALRSSQVIVKANCSKDDFLFNCKGNLSPSVEKESQPDNKVEAVSVNHNGRDMSEYFLPNPYLSALSSSSKDLETIVTLKKTIRISPHRESDHSSLNNKYLNGCGEISVSEMNEKLTTLCYRKYNDVSDLCKLENKQYCRWSKNQDDSFTICRKLTYPLETLCNSPNRSTNTLKEMPWGHINNNVTQSYSIGYEGSYDASADLFDDIAKEMDIATEITKKSQDILLKWGTSLAESHPSESDFSLRSLSEDFIQPSQKLSLQSLSDSRHSRTCSPTPHFQSDSEYNFENSQDFVPCSQSTPISGFHQTRIHGINRAFKKPVFYSDLDGNYEKIRIFPENDKQQASPSCPKNIKTPSQKIRSPIVSGVSQPDVFNHYPFAECHETDSDEWVPPTTQKIFPSDMLGFQGIGLGKCLAAYHFPDQQELPRKKLKHIRQGTNKGLIKKKLKNMLAAVVTKKKTHKYNCKSSGWISKCPDIQVLAAPQLHPILGPDSCSEVKCCLPFSEKGPPSVCETRSAWSPELFS

SEQ ID NO: 6120 - protein, 456 aa, unidentified; identical to SEQ ID NO: 1232

SEQ ID NO: 6121 - protein, 913 aa, unidentified; identical to SEQ ID NO: 1233

SEQ ID NO: 6122 - protein, 855 aa, unidentified; identical to SEQ ID NO: 1234

SEQ ID NO: 6123 - protein, 729 aa, unidentified
MPTGFVAPILCVLLPSPTREAATVASATGDSASERESAAPAAAPTAEAPPPSVVTRPEPQALPSPAIRAPLPDLYPFGTMRGGGFGDRDRDRDRGGFGARGGGGLPPKKFGNPGERLRKKKWDLSELPKFEKNFYVEHPEVARLTPYEVDELRRKKEITVRGGDVCPKPVFAFHHANFPQYVMDVLMDQHFTEPTPIQCQGFPLALSGRDMVGIAQTGSGKTLAYLLPAIVHINHQPYLERGDGPICLVLAPTRELAQQVQQVADDYGKCSRLKSTCIYGGAPKGPQIRDLERGVEICIATPGRLIDFLESGKTNLRRCTYLVLDEADRMLDMGFEPQIRKIVDQIRPDRQTLMWSATWPKEVRQLAEDFLRDYTQINVGNLELSANHNILQIVDVCMESEKDHKLIQLMEEIMAEKENKTIIFVETKRRCDDLTRRMRRDGWPAMCIHGDKSQPERDWVLNEFRSGKAPILIATDVASRGLDVEDVKFVINYDYPNSSEDYVHRIGRTARSTNKGTAYTFFTPGNLKQARELIKVLEEANQAINPKLMQLVDHRGGGGGGGGRSRYRTTSSANNPNLMYQDECDRRLRGVKDGGRRDSASYRDRSETDRAGYANGSGYGSPNSAFGAQAGQYTYGQGTYGAAAYGTSSYTAQEYGAGTYGASSTTSTGRSSQSSSQQFSGIGRSGQQPQPLMSQQFAQPPGATNMIGYMGQTAYQYPPPPPPPPPSRK

SEQ ID NO: 6124 - protein, 824 aa, unidentified
MAAAFEASGALAAVATAMPAEHVAVQVPAPEPTPGPVRILRTAQDLSSPRTRTGDVLLAEPADFESLLLSRPVLEGLRAAGFERPSPVQLKAIPLGRCGLDLIVQAKSGTGKTCVFSTIALDSLVLENLSTQILILAPTREIAVQIHSVITAIGIKMEGLECHVFIGGTPLSQDKTRLKKCHIAVGSPGRIKQLIELDYLNPGSIRLFILDEADKLLEEGSFQEQINWIYSSLPASKQMLAVSATYPEFLANALTKYMRDPTFVRLNSSDPSLIGLKQYYKVVNSYPLAHKVFEEKTQHLQELFSRIPFNQALVFSNLHSRAQHLADILSSKGFPAECISGNMNQNQRLDAMAKLKHFHCRVLISTDLTSRGIDAEKVNLVVNLDVPLDWETYMHRIGRAGRFGTLGLTVTYCCRGEEENMMMRIAQKCNINLLPLPDPIPSGLMEECVDWDVEVKAAVHTYGIASVPNQPLKKQIQKIERTLQIQKAHGDHMASSRNNSVSGLSVKSKNNTKQKLPVKSHSECGIIEKATSPKELGCDRQSEEQMKNSVQTPVENSTNSQHQVKEALPVSLPQIPCLSSFKIHQPYTLTFAELVEDYEHYIKEGLEKPVEIIRHYTGPGDQTVNPQNGFVRNKVIEQRVPVLASSSQSGDSESDSDSYSSRTSSQSKGNKSYLEGSSDNQLKDSESTPVDDRISLEQPPNGSDTPNPEKYQESPGIQMKTRLKEGASQRAKQSRRNLPRRSSFRLQTEAQEDDWYDCHREIRLSFSDTYQDYEEYWRAYYRAWQEYYAAASHSYYWNAQRHPSWMAAYHMNTIYLQEMMHSNQ

SEQ ID NO: 6125 - protein, 483 aa, unidentified
MASLLWGGDAGAAESERLNSHFSNLSQPRKNLWGIKSTAVRNIDGSINNINEDDEEDVVDLAANSLLNKLIHQSLVESSHRVEVLQKDPSSPLYSVKTFEELRLKEELLKGIYAMGFNRPSKIQEMALPMMLAHPPQNLIAQSQSGTGKTAAFVLAMLSRVNALELFPQCLCLAPTYELALQTGRVVEQMGKFCVDVQVMYAIRGNRIPRGTDITKQIIIGTPGTVLDWCFKLKLIDLTKIRVFVLDEADVMIDTQGFSDHSIRIQRALPSECQMLLFSATFEDSVWHFAERIIPDPNVIKLRKEELTLNNIRQYYVLCEHRKDKYQALCNIYGSITIGQAIIFCQTRRNAKWLTVEMIQDGHQVSLLSGELTVEQRASIIQRFRDGKEKVLITTNVCARGIDVKQVTIVVNFDLPVKQGEEPDYETYLHRIGRTGRFGKKGLAFNMIEVDELPSLMKIQDHFNSSIKQLNAEDMDEIEKIDY

SEQ ID NO: 6126 - protein, 540 aa, unidentified
MALTRPVRLFSLVTRLLLAPRRGLTVRSPDEPLPVVRIPVALQRQLEQRQSRRRNLPRPVLVRPGPLLVSARRPELNQPARLTLGRWERAPLASQGWKSRRARRDHFSIERAQQEAPAVRKLSSKGSFADLGLEPRVLHALQEAAPEVVQPTTVQSSTIPSLLRGRHVVCAAETGSGKTLSYLLPLLQRLLGQPSLDSLPIPAPRGLVLVPSRELAQQVRAVAQPLGRSLGLLVRDLEGGHGMRRIRLQLSRQPSADVLVATPGALWKALKSRLISLEQLSFLVLDEADTLLDESFLELVDYILEKSHIAEGPADLEDPFNPKAQLVLVGATFPEGVGQLLNKVASPDAVTTITSSKLHCIMPHVKQTFLRLKGADKVAELVHILKHRDRAERTGPSGTVLVFCNSSSTVNWLGYILDDHKIQHLRLQGQMPALMRVGIFQSFQKSSRDILLCTDIASRGLDSTGVELVVNYDFPPTLQDYIHRAGRVGRVGSEVPGTVISFVTHPWDVSLVQKIELAARRRRSLPGLASSVKEPLPQAT

SEQ ID NO: 6127 - protein, 565 aa, unidentified
MEDSDSAAKQLGLAEAAAVAAAAAVAAAAAAAAGGEAEEPVLSRDEDSEEDADSEAERETPRVTAVAVMAAEPGHMDMGAEALPGPDEAAAAAAFAEVTTVTVANVGAAADNVFTTSVANAASISGHVLSGRTALQIGDSLNTEKATLIVVHTDGSIVETTGLKGPAAPLTPGPQSPPTPLAPGQEKGGTKYNWDPSVYDSELPVRCRNISGTLYKNRLGSGGRGRCIKQGENWYSPTEFEAMAGRASSKDWKRSIRYAGRPLQCLIQDGILNPHAASCTCAACCDDMTLSGPVRLFVPYKRRKKENELPTTPVKKDSPKNITLLPATAATTFTVTPSGQITTSGALTFDRASTVEATAVISESPAQGDVFAGATVQEASVQPPCRASHPEPHYPGYQDSCQIAPFPEAALPTSHPKIVLTSLPALAVPPPTPTKAAPPALVNGLELSEPRSWLYLEEMVNSLLNTAQQLKTLFEQAKHASTYREAATNQAKIHADAERKEQSCVNCGREAMSECTGCHKVNYCSTFCQRKDWKDHQHICGQSAAVTVQADEVHVAESVMEKVTV

SEQ ID NO: 6128 - protein, 512 aa, unidentified
MAILSLRAPGPWQAMQVWADRTLLTPHTGVTSQVLGVAAAVMTPLPGGHAAGRTREARWDAMEYDEKLARFRQAHLNPFNKQSGPRQHEQGPGEEVPDVTPEEALPELPPGEPEFRCPERVMDLGLSEDHFSRPVGLFLASDVQQLRQAIEECKQVILELPEQSEKQKDAVVRLIHLRLKLQELKDPNEDEPNIRVLLEHRFYKEKSKSVKQTCDKCNTIIWGLIQTWYTCTGCYYRCHSKCLNLISKPCVSSKVSHQAEYELNICPETGLDSQDYRCAECRAPISLRGVPSEARQCDYTGQYYCSHCHWNDLAVIPARVVHNWDFEPRKVSRCSMRYLALMVSRPVLRLREINPLLFSYVEELVEIRKLRQDILLMKPYFITCREAMEARLLLQLQDRQHFVENDEMYSVQDLLDVHAGRLGCSLTEIHTLFAKHIKLDCERCQAKGFVCELCREGDVLFPFDSHTSVCADCSAVFHRDCYYDNSTTCPKCARLSLRKQSLFQEPGPDVEA

SEQ ID NO: 6129 - protein, 94 aa, unidentified
MRTLAILAAILLVALQAQAEPLQARADEVAAAPEQIAADIPEVVVSLAWDESLAPKHPGSRKNMACYCRIPACIAGERRYGTCIYQGRLWAFCC

SEQ ID NO: 6130 - protein, 94 aa, unidentified; identical to SEQ ID NO: 6129

SEQ ID NO: 6131 - protein, 94 aa, unidentified
MRTLAILAAILLVALQAQAEPLQARADEVAAAPEQIAADIPEVVVSLAWDESLAPKHPGSRKNMDCYCRIPACIAGERRYGTCIYQGRLWAFCC

SEQ ID NO: 6132 - protein, 97 aa, unidentified
MRIIALLAAILLVALQVRAGPLQARGDEAPGQEQRGPEDQDISISFAWDKSSALQVSGSTRGMVCSCRLVFCRRTELRVGNCLIGGVSFTYCCTRVD

SEQ ID NO: 6133 - protein, 94 aa, unidentified
MRTIAILAAILLVALQAQAESLQERADEATTQKQSGEDNQDLAISFAGNGLSALRTSGSQARATCYCRTGRCATRESLSGVCEISGRLYRLCCR

SEQ ID NO: 6134 - protein, 100 aa, unidentified
MRTLTILTAVLLVALQAKAEPLQAEDDPLQAKAYEADAQEQRGANDQDFAVSFAEDASSSLRALGSTRAFTCHCRRSCYSTEYSYGTCTVMGINHRFCCL

SEQ ID NO: 6135 - protein, 68 aa, unidentified
MRTSYLLLFTLCLLLSEMASGGNFLTGLGHRSDHYNCVSSGGQCLYSACPIFTKIQGTCYRGKAKCCK

SEQ ID NO: 6136 - protein, 67 aa, unidentified
MRIHYLLFALLFLFLVPVPGHGGIINTLQKYYCRVRGGRCAVLSCLPKEEQIGKCSTRGRKCCRRKK

SEQ ID NO: 6137 - protein, 67 aa, unidentified; identical to SEQ ID NO: 6136

SEQ ID NO: 6138 - protein, 72 aa, unidentified
MQRLVLLLAISLLLYQDLPVRSEFELDRICGYGTARCRKKCRSQEYRIGRCPNTYACCLRKWDESLLNRTKP

SEQ ID NO: 6139 - protein, 72 aa, unidentified; identical to SEQ ID NO: 6138

SEQ ID NO: 6140 - protein, 78 aa, unidentified
MALIRKTFYFLFAMFFILVQLPSGCQAGLDFSQPFPSGEFAVCESCKLGRGKCRKECLENEKPDGNCRLNFLCCRQRI

SEQ ID NO: 6141 - protein, 78 aa, unidentified; identical to SEQ ID NO: 6140

SEQ ID NO: 6142 - protein, 65 aa, unidentified
MRTFLFLFAVLFFLTPAKNAFFDEKCNKLKGTCKNNCGKNEELIALCQKSLKCCRTIQPCGSIID

SEQ ID NO: 6143 - protein, 65 aa, unidentified; identical to SEQ ID NO: 6142

SEQ ID NO: 6144 - protein, 70 aa, unidentified
MPGAMKIFVFILAALILLAQIFQARTAIHRALISKRMEGHCEAECLTFEVKIGGCRAELAPFCCKNRKKH

SEQ ID NO: 6145 - protein, 70 aa, unidentified; identical to SEQ ID NO: 6144

SEQ ID NO: 6146 - protein, 73 aa, unidentified
MRIAVLLFAIFFFMSQVLPARGKFKEICERPNGSCRDFCLETEIHVGRCLNSQPCCLPLGHQPRIESTTPKKD

SEQ ID NO: 6147 - protein, 67 aa, unidentified
MKIQLFFFILHFWVTILPAKKKYPEYGSLDLRRECRIGNGQCKNQCHENEIRIAYCIRPGTHCCLQQ

SEQ ID NO: 6148 - protein, 82 aa, unidentified
MKILCIFLTFVFTVSCGPSVPQKKTREVAERKRECQLVRGACKPECNSWEYVYYYCNVNPCCAVWEYQKPIINKITSKLHQK

SEQ ID NO: 6149 - protein, 69 aa, unidentified
MRIFYYLHFLCYVTFILPATCTLVNADRCTKRYGRCKRDCLESEKQIDICSLPRKICCTEKLYEEDDMF

SEQ ID NO: 6150 - protein, 88 aa, unidentified
MLPDHFSPLSGDIKLSVLALVVLVVLAQTAPDGWIRRCYYGTGRCRKSCKEIERKKEKCGEKHICCVPKEKDKLSHIHDQKETSELYI

SEQ ID NO: 6151 - protein, 102 aa, unidentified
MSVMKPCLMTIAILMILAQKTPGGLFRSHNGKSREPWNPCELYQGMCRNACREYEIQYLTCPNDQKCCLKLSVKITSSKNVKEDYDSNSNLSVTNSSSYSHI

SEQ ID NO: 6152 - protein, 123 aa, unidentified
MKLLLLALPMLVLLPQVIPAYSGEKKCWNRSGHCRKQCKDGEAVKDTCKNLRACCIPSNEDHRRVPATSPTPLSDSTPGIIDDILTVRFTTDYFEVSSKKDMVEESEAGRGTETSLPNVHHSS

SEQ ID NO: 6153 - protein, 84 aa, unidentified
MKLLYLFLAILLAIEEPVISGKRHILRCMGNSGICRASCKKNEQPYLYCRNCQSCCLQSYMRISISGKEENTDWSYEKQWPRLP

SEQ ID NO: 6154 - protein, 76 aa, unidentified
MKLLLLLLTVTLLLAQVTPVMKCWGKSGRCRTTCKESEVYYILCKTEAKCCVDPKYVPVKPKLTDTNTSLESTSAV

SEQ ID NO: 6155 - protein, 67 aa, unidentified
MKLLLLTLTVLLLLSQLTPGGTQRCWNLYGKCRYRCSKKERVYVYCINNKMCCVKPKYQPKERWWPF

SEQ ID NO: 6156 - protein, 71 aa, unidentified
MTQLLLFLVALLVLGHVPSGRSEFKRCWKGQGACQTYCTRQETYMHLCPDASLCCLSYALKPPPVPKHEYE

SEQ ID NO: 6157 - protein, 156 aa, unidentified
MNILMLTFIICGLLTRVTKGSFEPQKCWKNNVGHCRRRCLDTERYILLCRNKLSCCISIISHEYTRRPAFPVIHLEDITLDYSDVDSFTGSPVSMLNDLITFDTTKFGETMTPETNTPETTMPPSEATTPETTMPPSETATSETMPPPSQTALTHN

SEQ ID NO: 6158 - protein, 111 aa, unidentified
MKSLLFTLAVFMLLAQLVSGNWYVKKCLNDVGICKKKCKPEEMHVKNGWAMCGKQRDCCVPADRRANYPVFCVQTKTTRISTVTATTATTTLMMTTASMSSMAPTPVSPTG

SEQ ID NO: 6159 - protein, 99 aa, unidentified
MGLFMIIAILLFQKPTVTEQLKKCWNNYVQGHCRKICRVNEVPEALCENGRYCCLNIKELEACKKITKPPRPKPATLALTLQDYVTIIENFPSLKTQST

SEQ ID NO: 6160 - protein, 93 aa, unidentified
MKLFLVLIILLFEVLTDGARLKKCFNKVTGYCRKKCKVGERYEIGCLSGKLCCANDEEEKKHVSFKKPHQHSGEKLSVLQDYIILPTITIFTV

SEQ ID NO: 6161 - protein, 183 aa, unidentified
MKLLFPIFASLMLQYQVNTEFIGLRRCLMGLGRCRDHCNVDEKEIQKCKMKKCCVGPKVVKLIKNYLQYGTPNVLNEDVQEMLKPAKNSSAVIQRKHILSVLPQIKSTSFFANTNFVIIPNATPMNSATISTMTPGQITYTATSTKSNTKESRDSATASPPPAPPPPNILPTPSLELEEAEEQ

SEQ ID NO: 6162 - protein, 70 aa, unidentified
MRVLFFVFGVLSLMFTVPPARSFISNDECPSEYYHCRLKCNADEHAIRYCADFSICCKLKIIEIDGQKKW

SEQ ID NO: 6163 - protein, 95 aa, unidentified
MKFLLLVLAALGFLTQVIPASAGGSKCVSNTPGYCRTCCHWGETALFMCNASRKCCISYSFLPKPDLPQLIGNHWQSRRRNTQRKDKKQQTTVTS

SEQ ID NO: 6164 - protein, 61 aa, unidentified
MKIHVFLFVLFFFLVPIATRVKCAVKDTYSCFIMRGKCRHECHDFEKPIGFCTKLNANCYM

SEQ ID NO: 6165 - protein, 66 aa, unidentified
MKPLLVVFVFLFLWDPVLAGINSLSSEMHKKCYKNGICRLECYESEMLVAYCMFQLECCVKGNPAP

SEQ ID NO: 6166 - protein, 77 aa, unidentified
MATRSVLLALVVLNLLFYVPPGRSGPNVYIQKIFASCWRLQGTCRPKCLKNEQYRILCDTIHLCCVNPKYLPILTGK

SEQ ID NO: 6167 - protein, 78 aa, unidentified
MNLCLSALLFFLVILLPSGKGMFGNDGVKVRTCTSQKAVCFFGCPPGYRWIAFCHNILSCCKNMTRFQPPQAKDPWVH

SEQ ID NO: 6168 - protein, 64 aa, unidentified
MRVLYLLFSFLFIFLMPLPGVFGGIGDPVTCLKSGAICHPVFCPRRYKQIGTCGLPGTKCCKKP

SEQ ID NO: 6169 - protein, 64 aa, unidentified; identical to SEQ ID NO: 6168

SEQ ID NO: 6170 - protein, 496 aa, unidentified
MFAKATRNFLREVDADGDLIAVSNLNDSDKLQLLSLVTKKKRFWCWQRPKYQFLSLTLGDVLIEDQFPSPVVVESDFVKYEGKFANHVSGTLETALGKVKLNLGGSSRVESQSSFGTLRKQEVDLQQLIRDSAERTINLRNPVLQQVLEGRNEVLCVLTQKITTMQKCVISEHMQVEEKCGGIVGIQTKTVQVSATEDGNVTKDSNVVLEIPAATTIAYGVIELYVKLDGQFEFCLLRGKQGGFENKKRIDSVYLDPLVFREFAFIDMPDAAHGISSQDGPLSVLKQATLLLERNFHPFAELPEPQQTALSDIFQAVLFDDELLMVLEPVCDDLVSGLSPTVAVLGELKPRQQQDLVAFLQLVGCSLQGGCPGPEDAGSKQLFMTAYFLVSALAEMPDSAAALLGTCCKLQIIPTLCHLLRALSDDGVSDLEDPTLTPLKDTERFGIVQRLFASADISLERLKSSVKAVILKDSKVFPLLLCITLNGLCALGREHS

SEQ ID NO: 6171 - protein, 396 aa, unidentified
MALLTNLLPLCCLALLALPAQSCGPGRGPVGRRRYARKQLVPLLYKQFVPGVPERTLGASGPAEGRVARGSERFRDLVPNYNPDIIFKDEENSGADRLMTERCKERVNALAIAVMNMWPGVRLRVTEGWDEDGHHAQDSLHYEGRALDITTSDRDRNKYGLLARLAVEAGFDWVYYESRNHVHVSVKADNSLAVRAGGCFPGNATVRLWSGERKGLRELHRGDWVLAADASGRVVPTPVLLFLDRDLQRRASFVAVETEWPPRKLLLTPWHLVFAARGPAPAPGDFAPVFARRLRAGDSVLAPGGDALRPARVARVAREEAVGVFAPLTAHGTLLVNDVLASCYAVLESHQWAHRAFAPLRLLHALGALLPGGAVQPTGMHWYSRLLYRLAEELLG

SEQ ID NO: 6172 - protein, 339 aa, unidentified
MNWELLLWLLVLCALLLLLVQLLRFLRADGDLTLLWAEWQGRRPEWELTDMVVWVTGASSGIGEELAYQLSKLGVSLVLSARRVHELERVKRRCLENGNLKEKDILVLPLDLTDTGSHEAATKAVLQEFGRIDILVNNGGMSQRSLCMDTSLDVYRKLIELNYLGTVSLTKCVLPHMIERKQGKIVTVNSILGIISVPLSIGYCASKHALRGFFNGLRTELATYPGIIVSNICPGPVQSNIVENSLAGEVTKTIGNNGDQSHKMTTSRCVRLMLISMANDLKEVWISEQPFLLVTYLWQYMPTWAWWITNKMGKKRIENFKSGVDADSSYFKIFKTKHD

SEQ ID NO: 6173 - protein, 312 aa, unidentified
MGVMAMLMLPLLLLGISGLLFIYQEVSRLWSKSAVQNKVVVITDAISGLGKECARVFHTGGARLVLCGKNWERLENLYDALISVADPSKQTFTPKLVLLDLSDISCVPDVAKEVLDCYGCVDILINNASVKVKGPAHKISLELDKKIMDANYFGPITLTKALLPNMISRRTGQIVLVNNIQGKFGIPFRTTYAASKHAALGFFDCLRAEVEEYDVVISTVSPTFIRSYHVYPEQGNWEASIWKFFFRKLTYGVHPVEVAEEVMRTVRRKKQEVFMANPIPKAAVYVRTFFPEFFFAVVACGVKEKLNVPEEG

SEQ ID NO: 6174 - protein, 319 aa, unidentified; identical to SEQ ID NO: 1259

SEQ ID NO: 6175 - protein, 330 aa, unidentified
MSPLSAARAALRVYAVGAAVILAQLLRRCRGGFLEPVFPPRPDRVAIVTGGTDGIGYSTAKHLARLGMHVIIAGNNDSKAKQVVSKIKEETLNDKVEFLYCDLASMTSIRQFVQKFKMKKIPLHVLINNAGVMMVPQRKTRDGFEEHFGLNYLGHFLLTNLLLDTLKESGSPGHSARVVTVSSATHYVAELNMDDLQSSACYSPHAAYAQSKLALVLFTYHLQRLLAAEGSHVTANVVDPGVVNTDVYKHVFWATRLAKKLLGWLLFKTPDEGAWTSIYAAVTPELEGVGGHYLYNEKETKSLHVTYNQKLQQQLWSKSCEMTGVLDVTL

SEQ ID NO: 6176 - protein, 1369 aa, unidentified
MGGKNKKHKAPAAAVVRAAVSASRAKSAEAGIAGEAQSKKPVSRPATAAAAAAGSREPRVKQGPKIYSFNSTNDSSGPANLDKSILKVVINNKLEQRIIGVINEHKKQNNDKGMISGRLTAKKLQDLYMALQAFSFKTKDIEDAMTNTLLYGGDLHSALDWLCLNLSDDALPEGFSQEFEEQQPKSRPKFQSPQIQATISPPLQPKTKTYEEDPKSKPKKEEKNMEVNMKEWILRYAEQQNEEEKNENSKSLEEEEKFDPNERYLHLAAKLLDAKEQAATFKLEKNKQGQKEAQEKIRKFQREMETLEDHPVFNPAMKISHQQNERKKPPVATEGESALNFNLFEKSAAATEEEKDKKKEPHDVRNFDYTARSWTGKSPKQFLIDWVRKNLPKSPNPSFEKVPVGRYWKCRVRVIKSEDDVLVVCPTILTEDGMQAQHLGATLALYRLVKGQSVHQLLPPTYRDVWLEWSDAEKKREELNKMETNKPRDLFIAKLLNKLKQQQQQQQQHSENKRENSEDPEESWENLVSDEDFSALSLESANVEDLEPVRNLFRKLQSTPKYQKLLKERQQLPVFKHRDSIVETLKRHRVVVVAGETGSGKSTQVPHFLLEDLLLNEWEASKCNIVCTQPRRISAVSLANRVCDELGCENGPGGRNSLCGYQIRMESRACESTRLLYCTTGVLLRKLQEDGLLSNVSHVIVDEVHERSVQSDFLLIILKEILQKRSDLHLILMSATVDSEKFSTYFTHCPILRISGRSYPVEVFHLEDIIEETGFVLEKDSEYCQKFLEEEEEVTINVTSKAGGIKKYQEYIPVQTGAHADLNPFYQKYSSRTQHAILYMNPHKINLDLILELLAYLDKSPQFRNIEGAVLIFLPGLAHIQQLYDLLSNDRRFYSERYKVIALHSILSTQDQAAAFTLPPPGVRKIVLATNIAETGITIPDVVFVIDTGRTKENKYHESSQMSSLVETFVSKASALQRQGRAGRVRDGFCFRMYTRERFEGFMDYSVPEILRVPLEELCLHIMKCNLGSPEDFLSKALDPPQLQVISNAMNLLRKIGACELNEPKLTPLGQHLAALPVNVKIGKMLIFGAIFGCLDPVATLAAVMTEKSPFTTPIGRKDEADLAKSALAMADSDHLTIYNAYLGWKKARQEGGYRSEITYCRRNFLNRTSLLTLEDVKQELIKLVKAAGFSSSTTSTSWEGNRASQTLSFQEIALLKAVLVAGLYDNVGKIIYTKSVDVTEKLACIVETAQGKAQVHPSSVNRDLQTHGWLLYQEKIRYARVYLRETTLITPFPVLLFGGDIEVQHRERLLSIDGWIYFQAPVKIAVIFKQLRVLIDSVLRKKLENPKMSLENDKILQIITELIKTENN

SEQ ID NO: 6177 - protein, 1194 aa, unidentified
MFSLDSFRKDRAQHRQRQCKLPPPRLPPMCVNPTPGGTISRASRDLLKEFPQPKNLLNSVIGRALGISHAKDKLVYVHTNGPKKKKVTLHIKWPKSVEVEGYGSKKIDAERQAAAAACQLFKGWGLLGPRNELFDAAKYRVLADRFGSPADSWWRPEPTMPPTSWRQLNPESIRPGGPGGLSRSLGREEEEDEEEELEEGTIDVTDFLSMTQQDSHAPLRDSRGSSFEMTDDDSAIRALTQFPLPKNLLAKVIQIATSSSTAKNLMQFHTVGTKTKLSTLTLLWPCPMTFVAKGRRKAEAENKAAALACKKLKSLGLVDRNNEPLTHAMYNLASLRELGETQRRPCTIQVPEPILRKIETFLNHYPVESSWIAPELRLQSDDILPLGKDSGPLSDPITGKPYVPLLEAEEVRLSQSLLELWRRRGPVWQEAPQLPVDPHRDTILNAIEQHPVVVISGDTGCGKTTRIPQLLLERYVTEGRGARCNVIITQPRRISAVSVAQRVSHELGPSLRRNVGFQVRLESKPPSRGGALLFCTVGILLRKLQSNPSLEGVSHVIVDEVHERDVNTDFLLILLKGLQRLNPALRLVLMSATGDNERFSRYFGGCPVIKVPGFMYPVKEHYLEDILAKLGKHQYLHRHRHHESEDECALDLDLVTDLVLHIDARGEPGGILCFLPGWQEIKGVQQRLQEALGMHESKYLILPVHSNIPMMDQKAIFQQPPVGVRKIVLATNIAETSITINDIVHVVDSGLHKEERYDLKTKVSCLETVWVSRANVIQRRGRAGRCQSGFAYHLFPRSRLEKMVPFQVPEILRTPLENLVLQAKIHMPEKTAVEFLSKAVDSPNIKAVDEAVILLQEIGVLDQREYLTTLGQRLAHISTDPRLAKAIVLAAIFRCLHPLLVVVSCLTRDPFSSSLQNRAEVDKVKALLSHDSGSDHLAFVRAVAGWEEVLRWQDRSSRENYLEENLLYAPSLRFIHGLIKQFSENIYEAFLVGKPSDCTLASAQCNEYSEEEELVKGVLMAGLYPNLIQVRQGKVTRQGKFKPNSVTYRTKSGNILLHKSTINREATRLRSRWLTYFMAVKSNGSVFVRDSSQVHPLAVLLLTDGDVHIRDDGRRATISLSDSDLLRLEGDSRTVRLLKELRRALGRMVERSLRSELAALPPSVQEEHGQLLALLAELLRGPCGSFDVRKTADD

SEQ ID NO: 6178 - protein, 1220 aa, unidentified [sequence omitted]

SEQ ID NO: 6179 - protein, 273 aa, unidentified; identical to SEQ ID NO: 1263

SEQ ID NO: 6180 - protein, 683 aa, unidentified
MLACLTRGNLLDVLQEGFNEQQLQAYVAWVNAQLKKRPAVKPVQDLRQDLRDGVILAYLIEIVAGEKLSGVQLSPGNQQEMKNNVEKVLQFVASKKIRMHQTSAKDIVDGNLKSIMRLVLALAAHFKPGSSRTVNQGRDSRAPLQSHRPHCATAVAQGAAAALADVCHDMSRSGRDVFRYRQRNSSMDEEIENPYWSVRALVQQYEGQQRSPSESSCSSLTSPSPIHSAKSESIITQSEEKADFVIIPAEGIENRTEGTDSPLSRDWRPGSPGTYLETSWEEQLLEQQEYLEKEMEEAKKMISGLQALLLNGSLPEDEQERPLALCEPGVNPEEQLIIIQSRLDQSMEENQDLKKELLKCKQEARNLQGIKDALQQRLTQQDTSVLQLKQELLRANMDKDELHNQNVDLQRKLDERNRLLGEYKKELGQKDRLLQQHQAKLEEALRKLSDVSYHQVDLERELEHKDVLLAHCMKREADEATNYNSHNSQSNGFLLPTAGKGATSVSNRGTSDLQLVRDALRSLRNSFSGHDPQHHTIDSLEQGISSLMERLHVMETQKKQERKVRVKSPRTQVGSEYRESWPPNSKLPHSQSSPTVSSTCTKVLYFTDRSLTPFMVNIPKRLEEVTLKDFKAAIDREGNHRYHFKALDPEFGTVKEEIFHDDDAIPGWEGKIVAWVEEDHGEN

SEQ ID NO: 6181 - protein, 266 aa, unidentified
MMALGAAGATRVFVAMVAAALGGHPLLGVSATLNSVLNSNAIKNLPPPLGGAAGHPGSAVSAAPGILYPGGNKYQTIDNYQPYPCAEDEECGTDEYCASPTRGGDAGVQICLACRKRRKRCMRHAMCCPGNYCKNGICVSSDQNHFRGEIEETITESFGNDHSTLDGYSRRTTLSSKMYHTKGQEGSVCLRSSDCASGLCCARHFWSKICKPVLKEGQVCTKHRRKGSHGLEIFQRCYCGEGLSCRIQKDHHQASNSSRLHTCQRH

SEQ ID NO: 6182 - protein, 259 aa, unidentified
MAALMRSKDSSCCLLLLAAVLMVESSQIGSSRAKLNSIKSSLGGETPGQAANRSAGMYQGLAFGGSKKGKNLGQAYPCSSDKECEVGRYCHSPHQGSSACMVCRRKKKRCHRDGMCCPSTRCNNGICIPVTESILTPHIPALDGTRHRDRNHGHYSNHDLGWQNLGRPHTKMSHIKGHEGDPCLRSSDCIEGFCCARHFWTKICKPVLHQGEVCTKQRKKGSHGLEIFQRCDCAKGLSCKVWKDATYSSKARLHVCQKI

SEQ ID NO: 6183 - protein, 350 aa, unidentified
MQRLGATLLCLLLAAAVPTAPAPAPTATSAPVKPGPALSYPQEEATLNEMFREVEELMEDTQHKLRSAVEEMEAEEAAAKASSEVNLANLPPSYHNETNTDTKVGNNTIHVHREIHKITNNQTGQMVFSETVITSVGDEEGRRSHECIIDEDCGPSMYCQFASFQYTCQPCRGQRMLCTRDSECCGDQLCVWGHCTKMATRGSNGTICDNQRDCQPGLCCAFQRGLLFPVCTPLPVEGELCHDPASRLLDLITWELEPDGALDRCPCASGLLCQPHSHSLVYVCKPTFVGSRDQDGEILLPREVPDEYEVGSFMEEVRQELEDLERSLTEEMALREPAAAAAALLGGEEI

SEQ ID NO: 6184 - protein, 224 aa, unidentified
MVAAVLLGLSWLCSPLGALVLDFNNIRSSADLHGARKGSQCLSDTDCNTRKFCLQPRDEKPFCATCRGLRRRCQRDAMCCPGTLCVNDVCTTMEDATPILERQLDEQDGTHAEGTTGHPVQENQPKRKPSIKKSQGRKGQEGESCLRTFDCGPGLCCARHFWTKICKPVLLEGQVCSRRGHKDTAQAPEIFQRCDCGPGLLCRSQLTSNRQHARLRVCQKIEKL

SEQ ID NO: 6185 - protein, 242 aa, unidentified
MGEASPPAPARRHLLVLLLLLSTLVIPSAAAPIHDADAQESSLGLTGLQSLLQGFSRLFLKGNLLRGIDSLFSAPMDFRGLPGNYHKEENQEHQLGNNTLSSHLQIDKMTDNKTGEVLISENVVASIQPAEGSFEGDLKVPRMEEKEALVPIQKATDSFHTELHPRVAFWIIKLPRRRSHQDALEGGHWLSEKRHRLQAIRDGLRKGTHKDVLEEGTESSSHSRLSPRKTHLLYILRPSRQL

SEQ ID NO: 6186 - protein, 724 aa, unidentified
MDCLCIVTTKKYRYQDEDTPPLEHSPAHLPNQANSPPVIVNTDTLEAPGYELQVNGTEGEMEYEEITLERGNSGLGFSIAGGTDNPHIGDDPSIFITKIIPGGAAAQDGRLRVNDSILFVNEVDVREVTHSAAVEALKEAGSIVRLYVMRRKPPAEKVMEIKLIKGPKGLGFSIAGGVGNQHIPGDNSIYVTKIIEGGAAHKDGRLQIGDKILAVNSVGLEDVMHEDAVAALKNTYDVVYLKVAKPSNAYLSDSYAPPDITTSYSQHLDNEISHSSYLGTDYPTAMTPTSPRRYSPVAKDLLGEEDIPREPRRIVIHRGSTGLGFNIVGGEDGEGIFISFILAGGPADLSGELRKGDQILSVNGVDLRNASHEQAAIALKNAGQTVTIIAQYKPEEYSRFEAKIHDLREQLMNSSLGSGTASLRSNPKRGFYIRALFDYDKTKDCGFLSQALSFRFGDVLHVIDASDEEWWQARRVHSDSETDDIGFIPSKRRVERREWSRLKAKDWGSSSGSQGREDSVLSYETVTQMEVHYARPIIILGPTKDRANDDLLSEFPDKFGSCVPHTTRPKREYEIDGRDYHFVSSREKMEKDIQAHKFIEAGQYNSHLYGTSVQSVREVAEQGKHCILDVSANAVRRLQAAHLHPIAIFIRPRSLENVLEINKRITEEQARKAFDRATKLEQEFTECFSAIVEGDSFEEIYHKVKRVIEDLSGPYIWVPARERL

SEQ ID NO: 6187 - protein, 383 aa, unidentified; identical to SEQ ID NO: 1271

SEQ ID NO: 6188 - protein, 723 aa, unidentified; identical to SEQ ID NO: 1273

SEQ ID NO: 6189 - protein, 618 aa, unidentified; identical to SEQ ID NO: 1274

SEQ ID NO: 6190 - protein, 2413 aa, unidentified
MGISTVILEMCLLWGQVLSTGGWIPRTTDYASLIPSEVPLDPTVAEGSPFPSESTLESTVAEGSPISLESTLESTVAEGSLIPSESTLESTVAEGSDSGLALRLVNGDGRCQGRVEILYRGSWGTVCDDSWDTNDANVVCRQLGCGWAMSAPGNAWFGQGSGPIALDDVRCSGHESYLWSCPHNGWLSHNCGHGEDAGVICSAAQPQSTLRPESWPVRISPPVPTEGSESSLALRLVNGGDRCRGRVEVLYRGSWGTVCDDYWDTNDANVVCRQLGCGWAMSAPGNAQFGQGSGPIVLDDVRCSGHESYLWSCPHNGWLTHNCGHSEDAGVICSAPQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYRGSWGTVCDDSWDTNDANVVCRQLGCGWAMLAPGNARFGQGSGPIVLDDVRCSGNESYLWSCPHNGWLSHNCGHSEDAGVICSGPESSLALRLVNGGDRCQGRVEVLYRGSWGTVCDDSWDTNDANVVCRQLGCGWATSAPGNARFGQGSGPIVLDDVRCSGHESYLWSCPNNGWLSHNCGHHEDAGVICSAAQSRSTPRPDTLSTITLPPSTVGSESSLTLRLVNGSDRCQGRVEVLYRGSWGTVCDDSWDTNDANVVCRQLGCGWATSAPGNARFGQGSGPIVLDDVRCSGHESYLWSCPHNGWLSHNCGHHEDAGVICSVSQSRPTPSPDTWPTSHASTAGPESSLALRLVNGGDRCQGRVEVLYRGSWGTVCDDSWDTSDANVVCRQLGCGWATSAPGNARFGQGSGPIVLDDVRCSGYESYLWSCPHNGWLSHNCQHSEDAGVICSAAHSWSTPSPDTLPTITLPASTVGSESSLALRLVNGGDRCQGRVEVLYQGSWGTVCDDSWDTNDANVVCRQLGCGWAMSAPGNARFGQGSGPIVLDDVRCSGHESYLWSCPHNGWLSHNCGHSEDAGVICSASQSRPTPSPDTWPTSHASTAGSESSLALRLVNGGDRCQGRVEVLYRGSWGTVCDDYWDTNDANVVCRQLGCGWAMSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSHASTAGSESSLALRLVNGGDRCQGRVEVLYRGSWGTVCDDYWDTNDANVVCRQLGCGWATSAPGNARFGQGSGPIVLDDVRCSGHESYLWSCPHNGWLSHNCGHHEDAGVICSASQSQPTPSPDTWPTSRASTAGSESTLALRLVNGGDRCRGRVEVLYQGSWGTVCDDYWDTNDANVVCRQLGCGWAMSAPGNAQFGQGSGPIVLDDVRCSGHESYLWSCPHNGWLSHNCGHHEDAGVICSAAQSQSTPRPDTWLTTNLPALTVGSESSLALRLVNGGDRCRGRVEVLYRGSWGTVCDDSWDTNDANVVCRQLGCGWAMSAPGNARFGQGSGPIVLDDVRCSGNESYLWSCPHKGWLTHNCGHHEDAGVICSATQINSTTTDWWHPTTTTTARPSSNCGGFLFYASGTFSSPSYPAYYPNNAKCVWEIEVNSGYRINLGFSNLKLEAHHNCSFDYVEIFDGSLNSSLLLGKICNDTRQIFTSSYNRMTIHFRSDISFQNTGFLAWYNSFPSDATLRLVNLNSSYGLCAGRVEIYHGGTWGTVCDDSWTIQEAEVVCRQLGCGRAVSALGNAYFGSGSGPITLDDVECSGTESTLWQCRNRGWFSHNCNHREDAGVICSGNHLSTPAPFLNITRPNTDYSCGGFLSQPSGDFSSPFYPGNYPNNAKCVWDIEVQNNYRVTVIFRDVQLEGGCNYDYIEVFDGPYRSSPLIARVCDGARGSFTSSSNFMSIRFISDHSITRRGFRAEYYSSPSNDSTNLLCLPNHMQASVSRSYLQSLGFSASDLVISTWNGYYECRPQITPNLVIFTIPYSGCGTFKQADNDTIDYSNFLTAAVSGGIIKRRTDLRIHVSCRMLQNTWVDTMYIANDTIHVANNTIQVEEVQYGNFDVNISFYTSSSFLYPVTSRPYYVDLNQDLYVQAEILHSDAVLTLFVDTCVASPYSNDFTSLTYDLIRSGCVRDDTYGPYSSPSLRIARFRFRAFHFLNRFPSVYLRCKMVVCRAYDPSSRCYRGCVLRSKRDVGSYQEKVDVVLGPIQLQTPPRREEEPR

SEQ ID NO: 6191 - protein, 476 aa, unidentified
MKFQGPLACLLLALCLGSGEAGPLQSGEESTGTNIGEALGHGLGDALSEGVGKAIGKEAGGAAGSKVSEALGQGTREAVGTGVRQVPGFGVADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGGSSGGSSGGSSGNSGGSRGDSGSESSWGSSTGSSSGNHGGSGGGNGHKPGCEKPGNEARGSGESGIQNSETSPGMFNFDTFWKNFKSKLGFINWDAINKNQVPPPSTRALLYFSRLWEDFKQNTPFLNWKAIIEGADASSLQKRAGRDDQNYNYNQHAYPTAYGGKYSVKTPAKGGVSPSSSASRVQPGLLQWVKFW

SEQ ID NO: 6192 - protein, 513 aa, unidentified
MKISILLMFLWGLSCALPVTRYQNNESEDSEEWKGHLAQAPTPPLESSESSEGSKVSSEEQANEDPSDSTQSEEGLGSDDHQYIYRLAGGFSRSTGKGGDDKDDDEDDSGDDTFGDDDSGPGPKDRQEGGNSRLGSDEDSDDTIQASEESAPQGQDSAQDTTSESRELDNEDRVDSKPEGGDSTQESESEEHWVGGGSDGESSHGDGSELDDEGMQSDDPESIRSERGNSRMNSAGMKSKESGENSEQANTQDSGGSQLLEHPSRKIFRKSRISEEDDRSELDDNNTMEEVKSDSTENSNSRDTGLSQPRRDSKGDSQEDSKENLSQEESQNVDGPSSESSQEANLSSQENSSESQEEVVSESRGDNPDPTTSYVEDQEDSDSSEEDSSHTLSHSKSESREEQADSESSESLNFSEESPESPEDENSSSQEGLQSHSSSAESQSEESHSEEDDSDSQDSSRSKEDSNSTESKSSSEEDGQLKNIEIESRKLTVDAYHNKPIGDQDDNDCQDGY

SEQ ID NO: 6193 - protein, 542 aa, unidentified
MELRSELPSVPGAATAAAATATGPPVASVASVAAAAAAAASLPVSVAGGLLRGPPLLLRAAEKYPRTPKCARCRNHGVVSALKGHKRYCRWKDCLCAKCTLIAERQRVMAAQVALRRQQAQEENEARELQLLYGTAEGLALAAANGIIPPRPAYEVFGSVCAADGGGPGAGAPAGTGGGAAGAGGSEAKLQKFDLFPKTLLQAGRPGSPLPPPVKPLSPDGADSGPGTSSPEVRPGSGSENGDGESFSGSPLARASKEAGGSCPGSAGPGGGGEEDSPGSASPLGSESGSEADKEEGEAAPAPGLGGGSGPRQRTPLDILTRVFPGHRRGVLELVLQGCGGDVVQAIEQVLNHHRGGLAAGLGPAAPPDKAAVGAAAAADDAWPSRVDAAAAAAAAAGGPGLPAPLQAGPAAPPHHRPLLAGAMAPGALGSLSSRSAFSPLQPNASHFGADAGAYPLGAPLGLSPLRLAYSAAAAHSRGLAFMAPYSTAGLVPTLGFRPPMDYAFSDLMRDRSAAAAAAVHKEPTYGGGLYGPMVNGAPEKQ

SEQ ID NO: 6194 - protein, 3507 aa, unidentified
MGRRSQWIWAMRCQMLVPVLSLHIGLARALGCGCIASKIECLIRCNAPFPLLDAVGSVASQELQSLTGTVGVTSGAAAYPRWNLARARAPPHLPGTQDPLRRVRDPTPIVASSPGRRRGSWSGGYGQEASEPGVVGLCCAVLPIHPSLALAGVGGPDLRRFQEGPQRPSDHGAAEKHMETFIPIDLTTENQEMDKEETKTKPRLLRYEEKKYEDVKPLETQPAEIAEKETLEYKTVRTFSESLKSEKTEEPKDDDVIRNIIRLREKLGWQTILPQHSLKYGSSKIAIQKITLKKPLEDDGEFVYCLPRKSPKSLYNPYDLQVVSAHTAKHCKEFWVITASFISKLDSSRTYSLDEFCEEQLQQATQALKQLEDIRNKAISEMKSTFLKVAEKNEIKEYFESKLSEDDTTHFKLPKYRRLLETFFKFVMLVDYIFQELIRQLMNTAVTLLLELFNGSAGMPFSVEKKNENLIRTFKDNSFPTGKTTNDCEELVDNSKLHAISVQKSEVKTDTDINEILNSVEVGKDLRKTYAPIFEVNLCLRIPAESDSSENSKENFHESDQCPEECVMFEDEMSENKDNCVKKHSSEELLPKAKKSKEISYNLEDIISATITPLCQDPQLSIFIDLVSIMDLPNKTGSIIHYKEQTRWPDCHILFETDPAYQNIIVNLLTIIGNSMGLVNAYSHKFIKYCTMTEKAKIMSMKISSMGELTSKEFEAILNRFRNYFRHIVNMAIEKRIGIFNVVVESSLQQLECDPTEIEEFLEHFIFLNAISSKISKLEKEFLTMSQLYSVAKHHQIHISEEQIAIFQVLLLKFSQLKSSMKLSKINKDTAITKFRDNLEACISGLHVDVGNLKAKIRTPLLLCAGTQVSTAMEMIQTLSGEAASLTNKAKAYSHYQDCFSDSQSHMHSVNVEEITQIVLSEISDIEGDLTLRKKLWEAQEEWKRASWEWRNSSLQSIDVESVQRNVSKLMHIISVLEKEIYSIFIIPSIDDISAQLEESQVILATIKGSPHIGPIKSQIMFYNDCVKSFVSSYSREKLEKVHAGLMCHLEEVADLVVLDTSNSRTKAILGALLILYVHCRDIVINLLLKNIFNAEDFEWTRHLQYKWNEKQKLCYVSQGNASFTYGYEYLGCTSRLVITPLTDRCWLTLMEALHLNLGGCPAGPAGTGKTETVKDLAKCALFAFKCNTALIKLPNSLIVLTCFGLEKTVLVMNTVMSFRFVLEGKEIRINMSCAVFITMNPRYGGGVELPDNLKSLFRPVAMMVPHYQMIAEIILFSFGFKSANSLSGKLTNLYELARKQLSQQDHYNFGLRSLKIVLIMAGTKKREFKCDTSDSLSEADETLIVIEAIREASLPKCPPEDVPLFENIIGDIFPEVTVLKVNQLALEKVIYTATQQLGLQNWSSQKEKIIQFYNQLQVCVGVMLVGPTGGGKTTVRRILEKALTLLPIADFLSVAERKSASKISERKGKVDICVLNPKCVTLSELYGQLDPNTMEWTDGLLSATIRSYVYFNTPKNTKKDIDLRLKSRISDLSNVFKLDSSDTTETDDNIFEEIEKVVKIPENHNFDWQWIILDGPVDTFWVENLNSVLDDTRTLCLANSERIALTNKIRVIFEVDNLSQASPATVSRCAMVYMDPVDLGWEPYVKSWLLKTSKIISQSGVDCLEFMIKNSVTDGLQFIRNRQKFQPYPMEDITVVITLCRILDAFFDFMGKNGGFEQSDDLNDTSSKEANSQRESVTFKDIEKRDENTWYPEKNPDKLTKIIQKLFVFAFTWAFGGALNREDEHRENIPFCPSLEPDSLAKVTYDFDKLVHELFGNSSQVGINLPTGECSIFGYFVDIEQCEFIPWSDLVPNDQTLIQRDNPTKKPEVRTNKKLLKNNDHKGVVVSTINFSTNVTAAKTKEMILKKLIRRTKDTLGAPKNNRILIFIDDMNMPVSDMYGAQPPLELIRQLLDLGGVYDTEKNTWKNIQDLSIVAACVPVVNDISPRLLKHFSMLVLPHPSQDILCTIFQIGIDGCGKKTCATLACYLTDNKLYRVPISHKCAYIEFKEVFKKVFIHAGLKGKPTVLMVPNLNIEQDSFLEDLNYIISSGRIPDLFENVELDSIAMKIRYLTEQSGHMDNRQSLLSFFQKRIYKNLHIFVIMSPEGPSFRQNCRVYPSMISSCTIDWYERWPEEALLIVANSFLKEKVNFENRENLKEKLAPTCVQIHKSMKDLNRKYFEETGRFYYTTPNSYLQFMETFAHILRAREEEMQTKRDRFHMGLSTILEATTLVTEMQEELLILGPQVEQKTKETETLMEKLRKDSQVVEKVQMLVKQDEEIVAEEVRIVEDYAQKTANELKSVLPAFDKAIVALNALDKADVAELRVYTRPPFLVLTVMNAVCILLQKKPNWATAKLLLSETGFLKKLINLDKDSIPDKVFVKLKKIVTLPDFNPHKISLVSVACCSLCQWVIALNNYHEVQKVVGPKQIQVAEAQNVLKIARQRLAEKQRGLQLISRWHNQGLPHGQYSVENAILIKNGQQWPLLIDPHRQAHKWIRQMEGSRLQKLSIEDSNYTKKIENAMKTGGSVLLQSCQASTWRKKLYLSTEIDNPHFLPSVYNFVTMINFTVTFQGLQDQLLSTVVTHEVPHLEDQRSKLLESISLDAITLEELEEKTLNLLQKALGSILDDDKIVDTLRKSKMTSNEISKRIEATKKAESEIQAIRKNYLPIATRGALLYFLVADLTQINYMYQFSLDWFHQVFVSSVVSKSKEQEHSFKREKVSPKEVHEFISISKEPNLENEKNLLDKHIKSAIDMLTKSIFKVVSSALFNEDKLCFSFRLCTVIMQNNANGNLIQDDIGFLPEEEWNIFLYSGILINIKSALSQSRLTSTFEIGESQHLQWLSDSRWRQCQYVSTHLEPFSLLCKSLLSNVSQWDTFKNSKAVYSLISTPFSSENASLEENTKPPEEKHTFCLLLRAINHTGTDLGPVGRGQWLTSTACDRHTDVCSFSFALNDGVPDVEHVQDIFYGHCVDKYHVKVLRPESLNNSVRKFITEKMGNKYLQRTGVNLKDAYKGSNARTPLILIQTHGSASIKDYIHIIQSLPDDDLPEVLGIHPEAIRSCWETQGEKFIENLIAMQPKTTTANLMIRPEQSKDELVMEILSDLLKRLPLTVEKEEIAVGTPSTLKSMMSSSIWESLSKNLKDHDPLIHCVLLTFLKQEIKRFDKLLFVIHKSLKDLQLAIKGEIILTQELEEIFNSFLNMRVPTLWQKHAYRSCKPLSSWIDDLIQRLNFFNTWAKVAYTAIQRRYMRFVTVWKQSIPSTSQKCKHPEDSENNFFEGFPSRYWLPAFFFPQAFLAAVLQDYGRSRGIAVDALTFTHHVISNTTDKDEKFSVFMPKKLNIVRRAFKGSASSHTGVYIFGLFIEGARWNREQKILEDSLPLEMCCDFPDIYFLPTKISTKTPNASNQTDSELYAFECPVYQTPERSRILATTGLPTNFLTSVYLSTKKPPSHWITMRVALLCEKNEK

SEQ ID NO: 6195 - protein, 358 aa, unidentified
MAPQNLSTFCLLLLYLIGAVIAGRDFYKILGVPRSASIKDIKKAYRKLALQLHPDRNPDDPQAQEKFQDLGAAYEVLSDSEKRKQYDTYGEEGLKDGHQSSHGDIFSHFFGDFGFMFGGTPRQQDRNIPRGSDIIVDLEVTLEEVYAGNFVEVVRNKPVARQAPGKRKCNCRQEMRTTQLGPGRFQMTQEVVCDECPNVKLVNEERTLEVEIEPGVRDGMEYPFIGEGEPHVDGEPGDLRFRIKVVKHPIFERRGDDLYTNVTISLVESLVGFEMDITHLDGHKVHISRDKITRPGAKLWKKGEGLPNFDNNNIKGSLIITFDVDFPKEQLTEEAREGIKQLLKQGSVQKVYNGLQGY

SEQ ID NO: 6196 - protein, 223 aa, unidentified
MATPQSIFIFAICILMITELILASKSYYDILGVPKSASERQIKKAFHKLAMKYHPDKNKSPDAEAKFREIAEAYETLSDANRRKEYDTLGHSAFTSGKGQRGSGSSFEQSFNFNFDDLFKDFGFFGQNQNTGSKKRFENHFQTRQDGGSSRQRHHFQEFSFGGGLFDDMFEDMEKMFSFSGFDSTNQHTVQTENRFHGSSKHCRTVTQRRGNMVTTYTDCSGQ

SEQ ID NO: 6197 - protein, 504 aa, unidentified
MVAPGSVTSRLGSVFPFLLVLVDLQYEGAECGVNADVEKHLELGKKLLAAGQLADALSQFHAAVDGDPDNYIAYYRRATVFLAMGKSKAALPDLTKVIQLKMDFTAARLQRGHLLLKQGKLDEAEDDFKKVLKSNPSENEEKEAQSQLIKSDEMQRLRSQALNAFGSGDYTAAIAFLDKILEVCVWDAELRELRAECFIKEGEPRKAISDLKAASKLKNDNTEAFYKISTLYYQLGDHELSLSEVRECLKLDQDHKRCFAHYKQVKKLNKLIESAEELIRDGRYTDATSKYESVMKTEPSIAEYTVRSKERICHCFSKDEKPVEAIRVCSEVLQMEPDNVNALKDRAEAYLIEEMYDEAIQDYETAQEHNENDQQIREGLEKAQRLLKQSQKRDYYKILGVKRNAKKQEIIKAYRKLALQWHPDNFQNEEEKKKAEKKFIDIAAAKEVLSDPEMRKKFDDGEDPLDAESQQGGGGNPFHRSWNSWQGFNPFSSGGPFRFKFHFN

SEQ ID NO: 6198 - protein, 282 aa, unidentified [sequence omitted]

SEQ ID NO: 6199 - protein, 302 aa, unidentified
MHYPTALLFLILANGAQAFRICAFNAQRLTLAKVAREQVMDTLVRILARCDIMVLQEVVDSSGSAIPLLLRELNRFDGSGPYSTLSSPQLGRSTYMETYVYFYRSHKTQVLSSYVYNDEDDVFAREPFVAQFSLPSNVLPSLVLVPLHTTPKAVEKELNALYDVFLEVSQHWQSKDVILLGDFNADCASLTKKRLDKLELRTEPGFHWVIADGEDTTVRASTHCTYDRVVLHGERCRSLLHTAAAFDFPTSFQLTEEEALNISDHYPVEVELKLSQAHSVQPLSLTVLLLLSLLSPQLCPAA

SEQ ID NO: 6200 - protein, 299 aa, unidentified
MGGPRALLAALWALEAAGTAALRIGAFNIQSFGDSKVSDPACGSIIAKILAGYDLALVQEVRDPDLSAVSALMEQINSVSEHEYSFVSSQPLGRDQYKEMYLFVYRKDAVSVVDTYLYPDPEDVFSREPFVVKFSAPGTGERAPPLPSRRALTPPPLPAAAQNLVLIPLHAAPHQAVAEIDALYDVYLDVIDKWGTDDMLFLGDFNADCSYVRAQDWAAIRLRSSEVFKWLIPDSADTTVGNSDCAYDRIVACGARLRRSLKPQSATVHDFQEEFGLDQTQALAISDHFPVEVTLKFHR

SEQ ID NO: 6201 - protein, 305 aa, unidentified
MSRELAPLLLLLLSIHSALAMRICSFNVRSFGESKQEDKNAMDVIVKVIKRCDIILVMEIKDSNNRICPILMEKLNRNSRRGITYNYVISSRLGRNTYKEQYAFLYKEKLVSVKRSYHYHDYQDGDADVFSREPFVVWFQSPHTAVKDFVIIPLHTTPETSVKEIDELVEVYTDVKHRWKAENFIFMGDFNAGCSYVPKKAWKNIRLRTDPRFVWLIGDQEDTTVKKSTNCAYDRIVLRGQEIVSSVVPKSNSVFDFQKAYKLTEEEALDVSDHFPVEFKLQSSRAFTNSKKSVTLRKKTKSKRS

SEQ ID NO: 6202 - protein, 360 aa, unidentified
MIPLLLAALLCVPAGALTCYGDSGQPVDWFVVYKLPALRGSGEAAQRGLQYKYLDESSGGWRDGRALINSPEGAVGRSLQPLYRSNTSQLAFLLYNDQPPQPSKAQDSSMRGHTKGVLLLDHDGGFWLVHSVPNFPPPASSAAYSWPHSACTYGQTLLCVSFPFAQFSKMGKQLTYTYPWVYNYQLEGIFAQEFPDLENVVKGHHVSQEPWNSSITLTSQAGAVFQSFAKFSKFGDDLYSGWLAAALGTNLQVQFWHKTVGILPSNCSDIWQVLNVNQIAFPGPAGPSFNSTEDHSKWCVSPKGPWTCVGDMNRNQGEEQRGGGTLCAQLPALWKAFQPLVKNYQPCNGMARKPSRAYKI

SEQ ID NO: 6203 - protein, 361 aa, unidentified
MKQKMMARLLRTSFALLFLGLFGVLGAATISCRNEEGKAVDWFTFYKLPKRQNKESGETGLEYLYLDSTTRSWRKSEQLMNDTKSVLGRTLQQLYEAYASKSNNTAYLIYNDGVPKPVNYSRKYGHTKGLLLWNRVQGFWLIHSIPQFPPIPEEGYDYPPTGRRNGQSGICITFKYNQYEAIDSQLLVCNPNVYSCSIPATFHQELIHMPQLCTRASSSEIPGRLLTTLQSAQGQKFLHFAKSDSFLDDIFAAWMAQRLKTHLLTETWQRKRQELPSNCSLPYHVYNIKAIKLSRHSYFSSYQDHAKWCISQKGTKNRWTCIGDLNRSPHQAFRSGGFICTQNWQIYQAFQGLVLYYESCK

SEQ ID NO: 6204 - protein, 411 aa, unidentified
MWSGWWLWPLVAVCTADFFRDEAERIMRDSPVIDGHNDLPWQLLDMFNNRLQDERANLTTLAGTHTNIPKLRAGFVGGQFWSVYTPCDTQNKDAVRRTLEQMDVVHRMCRMYPETFLYVTSSAGIRQAFREGKVASLIGVEGGHSIDSSLGVLRALYQLGMRYLTLTHSCNTPWADNWLVDTGDSEPQSQGLSPFGQRVVKELNRLGVLIDLAHVSVATMKATLQLSRAPVIFSHSSAYSVCASRRNVPDDVLRLVKQTDSLVMVNFYNNYISCTNKANLSQVADHLDHIKEVAGARAVGFGGDFDGVPRVPEGLEDVSKYPDLIAELLRRNWTEAEVKGALADNLLRVFEAVEQASNLTQAPEEEPIPLDQLGGSCRTHYGYSSGASSLHRHWGLLLASLAPLVLCLSLL

SEQ ID NO: 6205 - protein, 486 aa, unidentified; identical to SEQ ID NO: 1306

SEQ ID NO: 6206 - protein, 488 aa, unidentified
MQPTGREGSRALSRRYLRRLLLLLLLLLLRQPVTRAETTPGAPRALSTLGSPSLFTTPGVPSALTTPGLTTPGTPKTLDLRGRAQALMRSFPLVDGHNDLPQVLRQRYKNVLQDVNLRNFSHGQTSLDRLRDGLVGAQFWSASVSCQSQDQTAVRLALEQIDLIHRMCASYSELELVTSAEGLNSSQKLACLIGVEGGHSLDSSLSVLRSFYVLGVRYLTLTFTCSTPWAESSTKFRHHMYTNVSGLTSFGEKVVEELNRLGMMIDLSYASDTLIRRVLEVSQAPVIFSHSAARAVCDNLLNVPDDILQLLKKNGGIVMVTLSMGVLQCNLLANVSTVADHFDHIRAVIGSEFIGIGGNYDGTGRFPQGLEDVSTYPVLIEELLSRSWSEEELQGVLRGNLLRVFRQVEKVREESRAQSPVEAEFPYGQLSTSCHSHLVPQNGHQATHLEVTKQPTNRVPWRSSNASPYLVPGLVAAATIPTFTQWLC

SEQ ID NO: 6207 - protein, 378 aa, unidentified
MATVIHNPLKALGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDIPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSGHPTCLQFTLNMTEAVKTYKWQCIECKSCILCGTSENDDQLLFCDDCDRGYHMYCLNPPVAEPPEGSWSCHLCWELLKEKASAFGCQA

SEQ ID NO: 6208 - protein, 492 aa, unidentified [sequence omitted]

SEQ ID NO: 6209 - protein, 201 aa, unidentified
MDLSLLWVLLPLVTMAWGQYGDYGYPYQQYHDYSDDGWVNLNRQGFSYQCPQGQVIVAVRSIFSKKEGSDRQWNYACMPTPQSLGEPTECWWEEINRAGMEWYQTCSNNGLVAGFQSRYFESVLDREWQFYCCRYSKRCPYSCWLTTEYPGHYGEEMDMISYNYDYYIRGATTTFSAVERDRQWKFIMCRMTEYDCEFANV

SEQ ID NO: 6210 - protein, 349 aa, unidentified
MAGPAIHTAPMLFLVLLLPLELSLAGALAPGTPARNLPENHIDLPGPALWTPQASHHRRRGPGKKEWGPGLPSQAQDGAVVTATRQASRLPEAEGLLPEQSPAGLLQDKDLLLGLALPYPEKENRPPGWERTRKRSREHKRRRDRLRLHQGRALVRGPSSLMKKAELSEAQVLDAAMEESSTSLAPTMFFLTTFEAAPATEESLILPVTSLRPQQAQPRSDGEVMPTLDMALFDWTDYEDLKPDGWPSAKKKEKHRGKLSSDGNETSPAEGEPCDHHQDCLPGTCCDLREHLCTPHNRGLNNKCFDDCMCVEGLRCYAKFHRNRRVTRRKGRCVEPETANGDQGSFINV

SEQ ID NO: 6211 - protein, 958 aa, unidentified [sequence omitted]

SEQ ID NO: 6212 - protein, 1118 aa, unidentified; identical to SEQ ID NO: 1331

SEQ ID NO: 6213 - protein, 1301 aa, unidentified
MKIITYFCIWAVAWAIPVPQSKPLERHVEKSMNLHLLARSNVSVQDELNASGTIKESGVLVHEGDRGRQENTQDGHKGEGNGSKWAEVGGKSFSTYSTLANEEGNIEGWNGDTGKAETYGHDGIHGKEENITANGIQGQVSIIDNAGATNRSNTNGNTDKNTQNGDVGDAGHNEDVAVVQEDGPQVAGSNNSTDNEDEIIENSCRNEGNTSEITPQINSKRNGTKEAEVTPGTGEDAGLDNSDGSPSGNGADEDEDEGSGDDEDEEAGNGKDSSNNSKGQEGQDHGKEDDHDSSIGQNSDSKEYYDPEGKEDPHNEVDGDKTSKSEENSAGIPEDNGSQRIEDTQKLNHRESKRVENRITKESETHAVGKSQDKGIEIKGPSSGNRNITKEVGKGNEGKEDKGQHGMILGKGNVKTQGEVVNIEGPGQKSEPGNKVGHSNTGSDSNSDGYDSYDFDDKSMQGDDPNSSDESNGNDDANSESDNNSSSRGDASYNSDESKDNGNGSDSKGAEDDDSDSTSDTNNSDSNGNGNNGNDDNDKSDSGKGKSDSSDSDSSDSSNSSDSSDSSDSDSSDSNSSSDSDSSDSDSSDSSDSDSSDSSNSSDSSDSSDSSDSSDSSDSSDSKSDSSKSESDSSDSDSKSDSSDSNSSDSSDNSDSSDSSNSSNSSDSSDSSDSSDSSSSSDSSNSSDSSDSSDSSNSSESSDSSDSSDSDSSDSSDSSNSNSSDSDSSNSSDSSDSSNSSDSSDSSDSSNSSDSSDSSDSSNSSDSSDSSDSSDSSDSSNSSDSNDSSNSSDSSDSSNSSDSSNSSDSSDSSDSSDSDSSNSSDSSNSSDSSDSSNSSDSSDSSDSSDGSDSDSSNRSDSSNSSDSSDSSDSSNSSDSSDSSDSNESSNSSDSSDSSNSSDSDSSDSSNSSDSSDSSNSSDSSESSNSSDNSNSSDSSNSSDSSDSSDSSNSSDSSNSSDSSNSSDSSDSNSSDSSDSSNSSDSSDSSDSSDSSDSSDSSNSSDSSDSSDSSDSSNSSDSSNSSDSSNSSDSSDSSDSSDSSDSSDSSDSSDSSNSSDSSDSSDSSDSSDSSDSSDSSDSSESSDSSDSSNSSDSSDSSDSSDSSDSSDSSDSSDSSDSSNSSDSSDSSDSSDSSDSSNSSDSSDSSESSDSSDSSDSSDSSDSSDSSDSSDSSDSSNSSDSSDSSDSSDSSDSSDSSDSSDSSDSSDSSDSSDSSDSSDSSDSSDSSDSNESSDSSDSSDSSDSSNSSDSSDSSDSSDSTSDSNDESDSQSKSGNGNNNGSDSDSDSEGSDSNHSTSDD

SEQ ID NO: 6214 - protein, 1551 aa, unidentified; identical to SEQ ID NO: 1335

SEQ ID NO: 6215 - protein, 116 aa, unidentified
MEEYHRHCDEVGFNAEEAHNIVKECVDGVLGGEDYNHNNINQWTASIVEQSLTHLVKLGKAYKYIVTCAVVQKSAYGFHTASSCFWDTTSDGTCTVRWENRTMNCIVNVFAIAIVL

SEQ ID NO: 6216 - protein, 346 aa, unidentified; identical to SEQ ID NO: 1345

SEQ ID NO: 6217 - protein, 213 aa, unidentified
MAITQFRLFKFCTCLATVFSFLKRLICRSGRGRKLSGDQITLPTTVDYSSVPKQTDVEEWTSWDEDAPTSVKIEGGNGNVATQQNSLEQLEPDYFKDMTPTIRKTQKIVIKKREPLNFGIPDGSTGFSSRLAATQDLPFIHQSSELGDLDTWQENTNAWEEEEDAAWQAEEVLRQQKLADREKRAAEQQRKKMEKEAQRLMKKEQNKIGVKLS

SEQ ID NO: 6218 - protein, 229 aa, unidentified
MTPQLLLALVLWASCPPCSGRKGPPAALTLPRVQCRASRYPIAVDCSWTLPPAPNSTSPVSFIATYRLGMAARGHSWPCLQQTPTSTSCTITDVQLFSMAPYVLNVTAVHPWGSSSSFVPFITEHIIKPDPPEGVRLSPLAERQLQVQWEPPGSWPFPEIFSLKYWIRYKRQGAARFHRVGPIEATSFILRAVRPRARYYVQVAAQDLTDYGELSDWSLPATATMSLGK

SEQ ID NO: 6219 - protein, 307 aa, unidentified
MALKQEMAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGTPEDGMAVCMFMQNTLTRFMRLPLISVALVQGWALGGGAEFTTACDFRLMTPESKIRFVHKEMGIIPSWGGTTRLVEIIGSRQALKVLSGALKLDSKNALNIGMVEEVLQSSDETKSLEEAQEWLKQFIQGPPEVIRALKKSVCSGRELYLEEALQNERDLLGTVWGGPANLEAIAKKGKFNK

SEQ ID NO: 6220 - protein, 540 aa, unidentified
MGTTARAALVLTYLAVASAASEGGFTATGQRQLRPEHFQEVGYAAPPSPPLSRSLPMDHPDSSQHGPPFEGQSQVQPPPSQEATPLQQEKLLPAQLPAEKEVGPPLPQEAVPLQKELPSLQHPNEQKEGTPAPFGDQSHPEPESWNAAQHCQQDRSQGGWGHRLDGFPPGRPSPDNLNQICLPNRQHVVYGPWNLPQSSYSHLTRQGETLNFLEIGYSRCCHCRSHTNRLECAKLVWEEAMSRFCEAEFSVKTRPHWCCTRQGEARFSCFQEEAPQPHYQLRACPSHQPDISSGLELPFPPGVPTLDNIKNICHLRRFRSVPRNLPATDPLQRELLALIQLEREFQRCCRQGNNHTCTWKAWEDTLDKYCDREYAVKTHHHLCCRHPPSPTRDECFARRAPYPNYDRDILTIDIGRVTPNLMGHLCGNQRVLTKHKHIPGLIHNMTARCCDLPFPEQACCAEEEKLTFINDLCGPRRNIWRDPALCCYLSPGDEQVNCFNINYLRNVALVSGDTENAKGQGEQGSTGGTNISSTSEPKEE

SEQ ID NO: 6221 - protein, 699 aa, unidentified
MKIAVLFCFFLLIIFQTDFGKNEEIPRKQRRKIYHRRLRKSSTSHKHRSNRQLGIQQTTVFTPVARLPIVNFDYSMEEKFESFSSFPGVESSYNVLPGKKGHCLVKGITMYNKAVWSPEPCTTCLCSDGRVLCDETMCHPQRCPQTVIPEGECCPVCSATVSYSLLSGIALNDRNEFSGDSSEQREPTNLLHKQLPPPQVGMDRIVRKEALQSEEDEEVKEEDTEQKRETPESRNQGQLYSEGDSRGGDRKQRPGEERRLAHQQQRQGREEEEDEEEEGEEGEEDEEDEEDPVRGDMFRMPSRSPLPAPPRGTLRLPSGCSLSYRTISCINAMLTQIPPLTAPQITSLELTGNSIASIPDEAFNGLPNLERLDLSKNNITSSGIGPKAFKLLKKLMRLNMDGNNLIQIPSQLPSTLEELKVNENNLQAIDEESLSDLNQLVTLELEGNNLSEANVNPLAFKPLKSLAYLRLGKNKFRIIPQGLPGSIEELYLENNQIEEITEICFNHTRKINVIVLRYNKIEENRIAPLAWINQENLESIDLSYNKLYHVPSYLPKSLLHLVLLGNQIERIPGYVFGHMEPGLEYLYLSFNKLADDGMDRVSFYGAYHSLRELFLDHNDLKSIPPGIQEMKALHFLRLNNNKIRNILPEEICNAEEDDDSNLEHLHLENNYIKIREIPSYTFSCIRSYSSIVLKPQNIK

SEQ ID NO: 6222 - protein, 431 aa, unidentified
MSWVQATLLARGLCRAWGGTCGAALTGTSISQVPRRLPRGLHCSAAAHSSEQSLVPSPPEPRQRPTKALVPFEDLFGQAPGGERDKASFLQTVQKFAEHSVRKRGHIDFIYLALRKMREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELAMFGLRHMEPDLSARVTIYQVPLPKDSTGAADPPQPHIVGIQSPDQQAALARHNPARPVFVEGPFSLWLRNKCVYYHILRADLLPPEEREVEETPEEWNLYYPMQLDLEYVRSGWDNYEFDINEVEEGPVFAMCMAGAHDQATMAKWIQGLQETNPTLAQIPVVFRLAGSTRELQTSSAGLEEPPLPEDHQEEDDNLQRQQQGQS

SEQ ID NO: 6223 - protein, 147 aa, unidentified
MTSSLKIWGILLALLCILCRLCVYSNNIYWREFIKLHYLSPSREFKEYKCDVLMREKEALKGKSFHMFIYSLWFKIQRACINEKGSDRYRNAYVWAPGALKVLECHWEKYNNRYTESRSFSYIEFHCGVDGYVDNIEDLRIIEPISN

SEQ ID NO: 6224 - protein, 147 aa, unidentified
MASSLKIWGTLLALLCILCTLLVQSKEVSWREFMKQHYLSPSREFREYKCDVLMRENEALKDKSSHMFIYISWYKIEHICTSDNWMDRFRNAYVWVQNPLKVLKCHQENSKNSYTESRSFNYIEFHCSMDGYVDSIEDLKMVEPIGN

SEQ ID NO: 6225 - protein, 578 aa, unidentified
MPFRLLIPLGLLCALLPQHHGAPGPDGSAPDPAHYRERVKAMFYHAYDSYLENAFPFDELRPLTCDGHDTWGSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFDPTNFIHNNGSTFDAVITPYGECILGAGGYIFNTEAHPIDPAALHCCQRLKEEQWEVEDLMREFYSLKRSRSKFQKNTVSSGPWEPPARPGTLFSPENHDQARERKPAKQKVPLLSCPSQPFTSKLALLGQVFLDSS

SEQ ID NO: 6226 - protein, 932 aa, unidentified
MSEAGGRGCGSPVPQRARWRLVAATAAFCLVSATSVWTAGAEPMSREEKQKLGNQVLEMFDHAYGNYMEHAYPADELMPLTCRGRVRGQEPSRGDVDDALGKFSLTLIDSLDTLVVLNKTKEFEDAVRKVLRDVNLDNDVVVSVFETNIRVLGGLLGGHSLAIMLKEKGEYMQWYNDELLQMAKQLGYKLLPAFNTTSGLPYPRINLKFGIRKPEARTGTETDTCTACAGTLILEFAALSRFTGATIFEEYARKALDFLWEKRQRSSNLVGVTINIHTGDWVRKDSGVGAGIDSYYEYLLKAYVLLGDDSFLERFNTHYDAIMRYISQPPLLLDVHIHKPMLNARTWMDALLAFFPGLQVLKGDIRPAIETHEMLYQVIKKHNFLPEAFTTDFRVHWAQHPLRPEFAESTYFLYKATGDPYYLEVGKTLIENLNKYARVPCGFAAMKDVRTGSHEDRMDSFFLAEMFKYLYLLFADKEDIIFDIEDYIFTTEAHLLPLWLSTTNQSISKKNTTSEYTELDDSNFDWTCPNTQILFPNDPLYAQSIREPLKNVVDKSCPRGIIRVEESFRSGAKPPLRARDFMATNPEHLEILKKMGVSLIHLKDGRVQLVQHAIQAASSIDAEDGLRFMQEMIELSSQQQKEQQLPPRAVQIVSHPFFGRVVLTAGPAQFGLDLSKHKETRGFVASSKPSNGCSELTNPEAVMGKIALIQRGQCMFAEKARNIQNAGAIGGIVIDDNEGSSSDTAPLFQMAGDGKDTDDIKIPMLFLFSKEGSIILDAIREYEEVEVLLSDKAKDRDPEMENEEQPSSENDSQNQSGEQISSSSQEVDLVDQESSEENSLNSHPESLSLADMDNAASISPSEQTSNPTENHETTNLNGECTDLDNQLQEQSETEEDSNPNVSWGKKVQPIDSILADWNEDIEAFEMMEKDEL

SEQ ID NO: 6227 - protein, 480 aa, unidentified
MKRSVAVWLLVGLSLGVPQFGKGDICDPNPCENGGICLPGLADGSFSCECPDGFTDPNCSSVVEVASDEEEPTSAGPCTPNPCHNGGTCEISEAYRGDTFIGYVCKCPRGFNGIHCQHNINECEVEPCKNGGICTDLVANYSCECPGEFMGRNCQYKCSGPLGIEGGIISNQQITASSTHRALFGLQKWYPYYARLNKKGLINAWTAAENDRWPWIQINLQRKMRVTGVITQGAKRIGSPEYIKSYKIAYSNDGKTWAMYKVKGTNEDMVFRGNIDNNTPYANSFTPPIKAQYVRLYPQVCRRHCTLRMELLGCELSGCSEPLGMKSGHIQDYQITASSIFRTLNMDMFTWEPRKARLDKQGKVNAWTSGHNDQSQWLQVDLLVPTKVTGIITQGAKDFGHVQFVGSYKLAYSNDGEHWTVYQDEKQRKDKVFQGNFDNDTHRKNVIDPPIYARHIRILPWSWYGRITLRSELLGCTEEE

SEQ ID NO: 6228 - protein, 212 aa, unidentified
MDYLLMIFSLLFVACQGAPETAVLGAELSAVGENGGEKPTPSPPWRLRRSKRCSCSSLMDKECVYFCHLDIIWVNTPEHVVPYGLGSPRSKRALENLLPTKATDRENRCQCASQKDKKCWNFCQAGKELRAEDIMEKDWNNHKKGKDCSKLGKKCIYQQLVRGRKIRRSSEEHLRQTRSETMRNSVKSSFHDPKLKGKPSRERYVTHNRAHW

SEQ ID NO: 6229 - protein, 178 aa, unidentified
MVSVPTTWCSVALALLVALHEGKGQAAATLEQPASSSHAQGTHLRLRRCSCSSWLDKECVYFCHLDIIWVNTPEQTAPYGLGNPPRRRRRSLPRRCQCSSARDPACATFCLRRPWTEAGAVPSRKSPADVFQTGKTGATTGELLQRLRDISTVKSLFAKRQQEAMREPRSTHSRWRKR

SEQ ID NO: 6230 - protein, 238 aa, unidentified
MEPGLWLLFGLTVTSAAGFVPCSQSGDAGRRGVSQAPTAARSEGDCEETVAGPGEETVAGPGEGTVAPTALQGPSPGSPGQEQAAEGAPEHHRSRRCTCFTYKDKECVYYCHLDIIWINTPEQTVPYGLSNYRGSFRGKRSAGPLPGNLQLSHRPHLRCACVGRYDKACLHFCTQTLDVSSNSRTAEKTDKEEEGKVEVKDQQSKQALDLHHPKLMPGSGLALAPSTCPRCLFQEGAP

SEQ ID NO: 6231 - protein, 442 aa, unidentified; identical to SEQ ID NO: 1355

SEQ ID NO: 6232 - protein, 493 aa, unidentified
MLKALFLTMLTLALVKSQDTEETITYTQCTDGYEWDPVRQQCKDIDECDIVPDACKGGMKCVNHYGGYLCLPKTAQIIVNNEQPQQETQPAEGTSGATTGVVAASSMATSGVLPGGGFVASAAAVAGPEMQTGRNNFVIRRNPADPQRIPSNPSHRIQCAAGYEQSEHNVCQDIDECTAGTHNCRADQVCINLRGSFACQCPPGYQKRGEQCVDIDECTIPPYCHQRCVNTPGSFYCQCSPGFQLAANNYTCVDINECDASNQCAQQCYNILGSFICQCNQGYELSSDRLNCEDIDECRTSSYLCQYQCVNEPGKFSCMCPQGYQVVRSRTCQDINECETTNECREDEMCWNYHGGFRCYPRNPCQDPYILTPENRCVCPVSNAMCRELPQSIVYKYMSIRSDRSVPSDIFQIQATTIYANTINTFRIKSGNENGEFYLRQTSPVSAMLVLVKSLSGPREHIVDLEMLTVSSIGTFRTSSVLRLTIIVGPFSF

SEQ ID NO: 6233 - protein, 443 aa, unidentified
MLPCASCLPGSLLLWALLLLLLGSASPQDSEEPDSYTECTDGYEWDPDSQHCRDVNECLTIPEACKGEMKCINHYGGYLCLPRSAAVINDLHGEGPPPPVPPAQHPNPCPPGYEPDDQDSCVDVDECAQALHDCRPSQDCHNLPGSYQCTCPDGYRKIGPECVDIDECRYRYCQHRCVNLPGSFRCQCEPGFQLGPNNRSCVDVNECDMGAPCEQRCFNSYGTFLCRCHQGYELHRDGFSCSDIDECSYSSYLCQYRCINEPGRFSCHCPQGYQLLATRLCQDIDECESGAHQCSEAQTCVNFHGGYRCVDTNRCVEPYIQVSENRCLCPASNPLCREQPSSIVHRYMTITSERSVPADVFQIQATSVYPGAYNAFQIRAGNSQGDFYIRQINNVSAMLVLARPVTGPREYVLDLEMVTMNSLMSYRASSVLRLTVFVGAYTF

SEQ ID NO: 6234 - protein, 205 aa, unidentified
MEFLWAPLLGLCCSLAAADRHTVFWNSSNPKFRNEDYTIHVQLNDYVDIICPHYEDHSVADAAMEQYILYLVEHEEYQLCQPQSKDQVRWQCNRPSAKHGPEKLSEKFQRFTPFTLGKEFKEGHSYYYISKPIHQHEDRCLRLKVTVSGKITHSPQAHDNPQEKRLAADDPEVRVLHSIGHSAAPRLFPLAWTVLLLPLLLLQTP

SEQ ID NO: 6235 - protein, 213 aa, unidentified
MAPAQRPLLPLLLLLLPLPPPPFARAEDAARANSDRYAVYWNRSNPRFHAGAGDDGGGYTVEVSINDYLDIYCPHYGAPLPPAERMEHYVLYMVNGEGHASCDHRQRGFKRWECNRPAAPGGPLKFSEKFQLFTPFSLGFEFRPGHEYYYISATPPNAVDRPCLRLKVYVRPTNETLYEAPEPIFTSNNSCSSPGGCRLFLSTIPVLWTLLGS

SEQ ID NO: 6236 - protein, 201 aa, unidentified; identical to SEQ ID NO: 1360

SEQ ID NO: 6237 - protein, 553 aa, unidentified
MPLPWSLALPLLLSWVAGGFGNAASARHHGLLASARQPGVCHYGTKLACCYGWRRNSKGVCEATCEPGCKFGECVGPNKCRCFPGYTGKTCSQDVNECGMKPRPCQHRCVNTHGSYKCFCLSGHMLMPDATCVNSRTCAMINCQYSCEDTEEGPQCLCPSSGLRLAPNGRDCLDIDECASGKVICPYNRRCVNTFGSYYCKCHIGFELQYISGRYDCIDINECTMDSHTCSHHANCFNTQGSFKCKCKQGYKGNGLRCSAIPENSVKEVLRAPGTIKDRIKKLLAHKNSMKKKAKIKNVTPEPTRTPTPKVNLQPFNYEEIVSRGGNSHGGKKGNEEKMKEGLEDEKREEKALKNDIEERSLRGDVFFPKVNEAGEFGLILVQRKALTSKLEHKDLNISVDCSFNHGICDWKQDREDDFDWNPADRDNAIGFYMAVPALAGHKKDIGRLKLLLPDLQPQSNFCLLFDYRLAGDKVGKLRVFVKNSNNALAWEKTTSEDEKWKTGKIQLYQGTDATKSIIFEAERGKGKTGEIAVDGVLLVSGLCPDSLLSVDD

SEQ ID NO: 6238 - protein, 273 aa, unidentified
MRGSQEVLLMWLLVLAVGGTEHAYRPGRRVCAVRAHGDPVSESFVQRVYQPFLTTCDGHRACSTYRTIYRTAYRRSPGLAPARPRYACCPGWKRTSGLPGACGAAICQPPCRNGGSCVQPGRCRCPAGWRGDTCQSDVDECSARRGGCPQRCVNTAGSYWCQCWEGHSLSADGTLCVPKGGPPRVAPNPTGVDSAMKEEVQRLQSRVDLLEEKLQLVLAPLHSLASQALEHGLPDPGSLLVHSFQQLGRIDSLSEQISFLEEQLGSCSCKKDS

SEQ ID NO: 6239 - protein, 293 aa, unidentified
MGSRAELCTLLGGFSFLLLLIPGEGAKGGSLRESQGVCSKQTLVVPLHYNESYSQPVYKPYLTLCAGRRICSTYRTMYRVMWREVRREVQQTHAVCCQGWKKRHPGALTCEAICAKPCLNGGVCVRPDQCECAPGWGGKHCHVDVDECRTSITLCSHHCFNTAGSFTCGCPHDLVLGVDGRTCMEGSPEPPTSASILSVAVREAEKDERALKQEIHELRGRLERLEQWAGQAGAWVRAVLPVPPEELQPEQVAELWGRGDRIESLSDQVLLLEERLGACSCEDNSLGLGVNHR

SEQ ID NO: 6240 - protein, 1017 aa, unidentified
MDLIRGVLLRLLLLASSLGPGAVSLRAAIRKPGKVGPPLDIKLGALNCTAFSIQWKMPRHPGSPILGYTVFYSEVGADKSLQEQLHSVPLSRDIPTTEEVIGDLKPGTEYRVSIAAYSQAGKGRLSSPRHVTTLSQDSCLPPAAPQQPHVIVVSDSEVALSWKPGASEGSAPIQYYSVEFIRPDFDKKWTSIHERIQMDSMVIKGLDPDTNYQFAVRAMNSHGPSPRSWPSDIIRTLCPEEAGSGRYGPRYITDMGAGEDDEGFEDDLDLDISFEEVKPLPATKGGNKKFLVESKKMSISNPKTISRLIPPTSASLPVTTVAPQPIPIQRKGKNGVAIMSRLFDMPCDETLCSADSFCVNDYTWGGSRCQCTLGKGGESCSEDIVIQYPQFFGHSYVTFEPLKNSYQAFQITLEFRAEAEDGLLLYCGENEHGRGDFMSLAIIRRSLQFRFNCGTGVAIIVSETKIKLGGWHTVMLYRDGLNGLLQLNNGTPVTGQSQGQYSKITFRTPLYLGGAPSAYWLVRATGTNRGFQGCVQSLAVNGRRIDMRPWPLGKALSGADVGECSSGICDEASCIHGGTCTAIKADSYICLCPLGFKGRHCEDAFTLTIPQFRESLRSYAATPWPLEPQHYLSFMEFEITFRPDSGDGVLLYSYDTGSKDFLSINLAGGHVEFRFDCGSGTGVLRSEDPLTLGNWHELRVSRTAKNGILQVDKQKIVEGMAEGGFTQIKCNTDIFIGGVPNYDDVKKNSGVLKPFSGSIQKIILNDRTIHVKHDFTSGVNVENAAHPCVRAPCAHGGSCRPRKEGYDCDCPLGFEGLHCQKECGNYCLNTIIEAIEIPQFIGRSYLTYDNPDILKRVSGSRSNVFMRFKTTAKDGLLLWRGDSPMRPNSDFISLGLRDGALVFSYNLGSGVASIMVNGSFNDGRWHRVKAVRDGQSGKITVDDYGARTGKSPGMMRQLNINGALYVGGMKEIALHTNRQYMRGLVGCISHFTLSTDYHISLVEDAVDGKNINTCGAK

SEQ ID NO: 6241 - protein, 1210 aa, unidentified [sequence omitted]

SEQ ID NO: 6242 - protein, 1231 aa, unidentified
MASVWKRLQRVGKHASKFQFVASYQELMVECTKKWQPDKLVVVWTRRSRRKSSKAHSWQPGIKNPYRGVVVWPVPENIEITVTLFKDPHAEEFEDKEWTFVIENESPSGRRKALATSSINMKQYASPMPTQTDVKLKFKPLSKKVVSAALQFSLSCIFLREGKATDEDMQSLASLMSMKQADIGNLDDFEEDNEDDDENRVNQEEKAAKITEIVNQLNALSSLDEDQDDCIKQANMRSAKSASSSEELINKLNFLDEAEKDLATVNSNPFDDPDAAELNPFGDPDSEEPITETASPRKTEDSFYNNSYNPFKEVQTPQYLNPFDEPEAFVTIKDSPPQSTKRKNIRPVDMSKYLYADSSKTEEEELDESNPFYEPKSTPPPNNLVNPVQELETERRVKRKAPAPPVLSPKTGVLNENTVSAGKDLSTSPKPSPIPSPVLGRKPNASQSLLVWCKEVTKNYRGVKITNFTTSWRNGLSFCAILHHFRPDLIDYKSLNPQDIKENNKKAYDGFASIGISRLLEPSDMVLLAIPDKLTVMTYLYQIRAHFSGQELNVVQIEENSSKSTYKVGNYETDTNSSVDQEKFYAELSDLKREPELQQPISGAVDFLSQDDSVFVNDSGVGESESEHQTPDDHLSPSTASPYCRRTKSDTEPQKSQQSSGRTSGSDDPGICSNTDSTQAQVLLGKKRLLKAETLELSDLYVSDKKKDMSPPFICEETDEQKLQTLDIGSNLEKEKLENSRSLECRSDPESPIKKTSLSPTSKLGYSYSRDLDLAKKKHASLRQTESDPDADRTTLNHADHSSKIVQHRLLSRQEELKERARVLLEQARRDAALKAGNKHNTNTATPFCNRQLSDQQDEERRRQLRERARQLIAEARSGVKMSELPSYGEMAAEKLKERSKASGDENDNIEIDTNEEIPEGFVVGGGDELTNLENDLDTPEQNSKLVDLKLKKLLEVQPQVANSPSSAAQKAVTESSEQDMKSGTEDLRTERLQKTTERFRNPVVFSKDSTVRKTQLQSFSQYIENRPEMKRQRSIQEDTKKGNEEKAAITETQRKPSEDEVLNKGFKDTSQYVVGELAALENEQKQIDTRAALVEKRLRYLMDTGRNTEEEEAMMQEWFMLVNKKNALIRRMNQLSLLEKEHDLERRYELLNRELRAMLAIEDWQKTEAQKRREQLLLDELVALVNKRDALVRDLDAQEKQAEEEDEHLERTLEQNKGKMAKKEEKCVLQ

SEQ ID NO: 6243 - protein, 300 aa, unidentified
MILEGGGVMNLNPGNNLLHQPPAWTDSYSTCNVSSGFFGGQWHEIHPQYWTKYQVWEWLQHLLDTNQLDANCIPFQEFDINGEHLCSMSLQEFTRAAGTAGQLLYSNLQHLKWNGQCSSDLFQSTHNVIVKTEQTEPSIMNTWKDENYLYDTNYGSTVDLLDSKTFCRAQISMTTTSHLPVAESPDMKKEQDPPAKCHTKKHNPRGTHLWEFIRDILLNPDKNPGLIKWEDRSEGVFRFLKSEAVAQLWGKKKNNSSMTYEKLSRAMRYYYKREILERVDGRRLVYKFGKNARGWRENEN

SEQ ID NO: 6244 - protein, 1298 aa, unidentified
MAAADAEAVPARGEPQQDCCVKTELLGEETPMAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTACLPFVLAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYERIPIPCVNAVDSEPCPSNYKYVSQNCVTSPMNIDRNITHLQYCVCIDDCSSSNCMCGQLSMRCWYDKDGRLLPEFNMAEPPLIFECNHACSCWRNCRNRVVQNGLRARLQLYRTRDMGWGVRSLQDIPPGTFVCEYVGELISDSEADVREEDSYLFDLDNKDGEVYCIDARFYGNVSRFINHHCEPNLVPVRVFMAHQDLRFPRIAFFSTRLIEAGEQLGFDYGERFWDIKGKLFSCRCGSPKCRHSSAALAQRQASAAQEAQEDGLPDTSSAAAADPL

SEQ ID NO: 6245 - protein, 1210 aa, unidentified
MAAAAGAAAAAAAEGEAPAEMGALLLEKETRGATERVHGSLGDTPRSEETLPKATPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQPPVPEKRPPEIQHFRMSDDVHSLGKVTSDLAKRRKLNSGGGLSEELGSARRSGEVTLTKGDPGSLEEWETVVGDDFSLYYDSYSVDERVDSDSKSEVEALTEQLSEEEEEEEEEEEEEEEEEEEEEEEEDEESGNQSDRSGSSGRRKAKKKWRKDSPWVKPSRKRRKREPPRAKEPRGVNGVGSSGPSEYMEVPLGSLELPSEGTLSPNHAGVSNDTSSLETERGFEELPLCSCRMEAPKIDRISERAGHKCMATESVDGELSGCNAAILKRETMRPSSRVALMVLCETHRARMVKHHCCPGCGYFCTAGTFLECHPDFRVAHRFHKACVSQLNGMVFCPHCGEDASEAQEVTIPRGDGVTPPAGTAAPAPPPLSQDVPGRADTSQPSARMRGHGEPRRPPCDPLADTIDSSGPSLTLPNGGCLSAVGLPLGPGREALEKALVIQESERRKKLRFHPRQLYLSVKQGELQKVILMLLDNLDPNFQSDQQSKRTPLHAAAQKGSVEICHVLLQAGANINAVDKQQRTPLMEAVVNNHLEVARYMVQRGGCVYSKEEDGSTCLHHAAKIGNLEMVSLLLSTGQVDVNAQDSGGWTPIIWAAEHKHIEVIRMLLTRGADVTLTDNEENICLHWASFTGSAAIAEVLLNARCDLHAVNYHGDTPLHIAARESYHDCVLLFLSRGANPELRNKEGDTAWDLTPERSDVWFALQLNRKLRLGVGNRAIRTEKIICRDVARGYENVPIPCVNGVDGEPCPEDYKYISENCETSTMNIDRNITHLQHCTCVDDCSSSNCLCGQLSIRCWYDKDGRLLQEFNKIEPPLIFECNQACSCWRNCKNRVVQSGIKVRLQLYRTAKMGWGVRALQTIPQGTFICEYVGELISDAEADVREDDSYLFDLDNKDGEVYCIDARYYGNISRFINHLCDPNIIPVRVFMLHQDLRFPRIAFFSSRDIRTGEELGFDYGDRFWDIKSKYFTCQCGSEKCKHSAEAIALEQSRLARLDPHPELLPELGSLPPVNT

SEQ ID NO: 6246 - protein, 630 aa, unidentified
MQGGNSGVRKREEEGDGAGAVAAPPAIDFPAEGPDPEYDESDVPAEIQVLKEPLQQPTFPFAVANQLLLVSLLEHLSHVHEPNPLRSRQVFKLLCQTFIKMGLLSSFTCSDEFSSLRLHHNRAITHLMRSAKERVRQDPCEDISRIQKIRSREVALEAQTSRYLNEFEELAILGKGGYGRVYKVRNKLDGQYYAIKKILIKGATKTVCMKVLREVKVLAGLQHPNIVGYHTAWIEHVHVIQPRADRAAIELPSLEVLSDQEEDREQCGVKNDESSSSSIIFAEPTPEKEKRFGESDTENQNNKSVKYTTNLVIRESGELESTLELQENGLAGLSASSIVEQQLPLRRNSHLEESFTSTEESSEENVNFLGQTEAQYHLMLHIQMQLCELSLWDWIVERNKRGREYVDESACPYVMANVATKIFQELVEGVFYIHNMGIVHRDLKPRNIFLHGPDQQVKIGDFGLACTDILQKNTDWTNRNGKRTPTHTSRVGTCLYASPEQLEGSEYDAKSDMYSLGVVLLELFQPFGTEMERAEVLTGLRTGQLPESLRKRCPVQAKYIQHLTRRNSSQRPSAIQLLQSELFQNSGNVNLTLQMKIIEQEKEIAELKKQLNLLSQDKGVRDDGKDGGVG

SEQ ID NO: 6247 - protein, 267 aa, unidentified
MTLGRRLACLFLACVLPALLLGGTALASEIVGGRRARPHAWPFMVSLQLRGGHFCGATLIAPNFVMSAAHCVANVNVRAVRVVLGAHNLSRREPTRQVFAVQRIFENGYDPVNLLNDIVILQLNGSATINANVQVAQLPAQGRRLGNGVQCLAMGWGLLGRNRGIASVLQELNVTVVTSLCRRSNVCTLVRGRQAGVCFGDSGSPLVCNGLIHGIASFVRGGCASGLYPDAFAPVAQFVNWIDSIIQRSEDNPCPHPRDPDPASRTH

SEQ ID NO: 6248 - protein, 643 aa, unidentified
MAGLTAAAPRPGVLLLLLSILHPSRPGGVPGAIPGGVPGGVFYPGAGLGALGGGALGPGGKPLKPGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGPFGGPQPGVPLGYPIKAPKLPGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGAEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 6249 - protein, 826 aa, unidentified
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEVMCLQTLNFGNGFALALCLSFLPNTDVPILACGNDDCRIHIFAQQNDQFQKVLSLCGHEDWIRGVEWAAFGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEESGVWLEQVRVGEVGGNTLGFYDCQFNEDGSMIIAHAFHGALHLWKQNTVNPREWTPEIVISGHFDGVQDLVWDPEGEFIITVGTDQTTRLFAPWKRKDQSQVTWHEIARPQIHGYDLKCLAMINRFQFVSGADEKVLRVFSAPRNFVENFCAITGQSLNHVLCNQDSDLPEGATVPALGLSNKAVFQGDIASQPSDEEELLTSTGFEYQQVAFQPSILTEPPTEDHLLQNTLWPEVQKLYGHGYEIFCVTCNSSKTLLASACKAAKKEHAAIILWNTTSWKQVQNLVFHSLTVTQMAFSPNEKFLLAVSRDRTWSLWKKQDTISPEFEPVFSLFAFTNKITSVHSRIIWSCDWSPDSKYFFTGSRDKKVVVWGECDSTDDCIEHNIGPCSSVLDVGGAVTAVSVCPVLHPSQRYVVAVGLECGKICLYTWKKTDQVPEINDWTHCVETSQSQSHTLAIRKLCWKNCSGKTEQKEAEGAEWLHFASCGEDHTVKIHRVNKCAL

SEQ ID NO: 6250 - protein, 223 aa, unidentified [sequence omitted]

SEQ ID NO: 6251 - protein, 993 aa, unidentified; identical to SEQ ID NO: 1381

SEQ ID NO: 6252 - protein, 262 aa, unidentified; identical to SEQ ID NO: 1382

SEQ ID NO: 6253 - protein, 208 aa, unidentified
MGEVEISALAYVKMCLHAARYPHAAVNGLFLAPAPRSGECLCLTDCVPLFHSHLALSVMLEVALNQVDVWGAQAGLVVAGYYHANAAVNDQSPGPLALKIAGRIAEFFPDAVLIMLDNQKLVPQPRVPPVIVLENQGLRWVPKDKNLVMWRDWEESRQMVGALLEDRAHQHLVDFDCHLDDIRQDWTNQRLNTQITQWVGPTNGNGNA

SEQ ID NO: 6254 - protein, 261 aa, unidentified; identical to SEQ ID NO: 1387

SEQ ID NO: 6255 - protein, 441 aa, unidentified
MGGPRAWALLCLGLLLPGGGAAWSIGAAPFSGRRNWCSYVVTRTISCHVQNGTYLQRVLQNCPWPMSCPGSSYRTVVRPTYKVMYKIVTAREWRCCPGHSGVSCEEASSASLEPMWSGSTMRRMALRPTAFSGCLNCSKVSELTERLKVLEAKMTMLTVIEQPVPPTPATPEDPAPLWGPPPAQGSPGDGGLQDQVGAWGLPGPTGPKGDAGSRGPMGMRGPPGPQGPPGSPGRAGAVGTPGERGPPGPPGPPGPPGPPAPVGPPHARISQHGDPLLSNTFTETNNHWPQGPTGPPGPPGPMGPPGPPGPTGVPGSPGHIGPPGPTGPKGISGHPGEKGERGLRGEPGPQGSAGQRGEPGPKGDPGEKSHWGEGLHQLREALKILAERVLILETMIGLYEPELGSGAGPAGTGTPSLLRGKRGGHATNYRIVAPRSRDERG

SEQ ID NO: 6256 - protein, 1016 aa, unidentified
MAPRTLWSCYLCCLLTAAAGAASYPPRGFSLYTGSSGALSPGGPQAQIAPRPASRHRNWCAYVVTRTVSCVLEDGVETYVKYQPCAWGQPQCPQSIMYRRFLRPRYRVAYKTVTDMEWRCCQGYGGDDCAESPAPALGPASSTPRPLARPARPNLSGSSAGSPLSGLGGEGPGESEKVQQLEEQVQSLTKELQGLRGVLQGLSGRLAEDVQRAVETAFNGRQQPADAAARPGVHETLNEIQHQLQLLDTRVSTHDQELGHLNNHHGGSSSSGGSRAPAPASAPPGPSEELLRQLEQRLQESCSVCLAGLDGFRRQQQEDRERLRAMEKLLASVEERQRHLAGLAVGRRPPQECCSPELGRRLAELERRLDVVAGSVTVLSGRRGTELGGAAGQGGHPPGYTSLASRLSRLEDRFNSTLGPSEEQEESWPGAPGGLSHWLPAARGRLEQLGGLLANVSGELGGRLDLLEEQVAGAMQACGQLCSGAPGEQDSQVSEILSALERRVLDSEGQLRLVGSGLHTVEAAGEARQATLEGLQEVVGRLQDRVDAQDETAAEFTLRLNLTAARLGQLEGLLQAHGDEGCGACGGVQEELGRLRDGVERCSCPLLPPRGPGAGPGVGGPSRGPLDGFSVFGGSSGSALQALQGELSEVILSFSSLNDSLNELQTTVEGQGADLADLGATKDRIISEINRLQQEATEHATESEERFRGLEEGQAQAGQCPSLEGRLGRLEGVCERLDTVAGGLQGLREGLSRHVAGLWAGLRETNTTSQMQAALLEKLVGGQAGLGRRLGALNSSLQLLEDRLHQLSLKDLTGPAGEAGPPGPPGLQGPPGPAGPPGSPGKDGQEGPIGPPGPQGEQGVEGAPAAPVPQVAFSAALSLPRSEPGTVPFDRVLLNDGGYYDPETGVFTAPLAGRYLLSAVLTGHRHEKVEAVLSRSNQGVARVDSGGYEPEGLENKPVAESQPSPGTLGVFSLILPLQAGDTVCVDLVMGQLAHSEEPLTIFSGALLYGDPELEHA

SEQ ID NO: 6257 - protein, 1053 aa, unidentified
MWQPRRPWPRVPWRWALALLALVGAGLCHAGPQPGYPARPSARNKNWCAYIVNKNVSCSVLEGSESFIQAQYNCAWNQMPCPSALVYRVNFRPRYVTRYKTVTQLEWRCCPGFRGGDCQEGPKDPVKTLRPTPARPRNSLKKATDNEPSQFSEPRKTLSPTGTAQPSWGVDPKEGPQELQEKKIQVLEEKVLRLTRTVLDLQSSLAGVSENLKHATQDDASRTRAPGLSSQHPKPDTTVSGDTETGQSPGVFNTKESGMKDIKSELAEVKDTLKNKSDKLEELDGKVKGYEGQLRQLQEAAQGPTVTMTTNELYQAYVDSKIDALREELMEGMDRKLADLKNSCEYKLTGLQQQCDDYGSSYLGVIELIGEKETSLRKEINNLRARLQEPSAQANCCDSEKNGDIGQQIKTLDQKIERVAEATRMLNGRLDNEFDRLIVPEPDVDFDAKWNELDARINVTEKNAEEHCFYIEETLRGAINGEVGDLKQLVDQKIQSLEDRLGSVLLQMTNNTGAELSPPGAAALPGVSGSGDERVMMELNHLKDKVQVVEDICLLNIQGKPHGMEGALPNREDRAVRDSLHLLKSLNDTMHRKFQETEQTIQKLQQDFSFLYSQLNHTENDVTHLQKEMSNCRAGENAGMGRFTKVGEQERTVDTLPSPQHPVAHCCSQLEERWQRLQSQVISELDACKECTQGVQREVSMVEGRVSHMEKTCSKLDSISGNLQRIKEGLNKHVSSLWNCVRQMNGTLRSHSRDISGLKNSVQQFYSHVFQISTDLQDLVKFQPSAKAPSPPPPAEAPKEPLQPEPAPPRPSGPATAEDPGRRPVLPQRPPEERPPQPPGSTGVIAETGQAGPPAGAGVSGRGLPRGVDGQTGSGTVPGAEGFAGAPGYPKSPPVASPGAPVPSLVSFSAGLTQKPFPSDGGVVLFNKVLVNDGDVYNPSTGVFTAPYDGRYLITATLTPERDAYVEAVLSVSNASVAQLHTAGYRREFLEYHRPPGALHTCGGPGAFHLIVHLKAGDAVNVVVTGGKLAHTDFDEMYSTFSGVFLYPFLSHL

SEQ ID NO: 6258 - protein, 766 aa, unidentified
MGRRRLLVWLCAVAALLSGAQARGTPLLARPAPPGASRYSLYTTGWRPRLRPGPHKALCAYVVHRNVTCILQEGAESYVKAEYRQCRWGPKCPGTVTYRTVLRPKYKVGYKTVTDLAWRCCPGFTGKRCPEHLTDHGAASPQLEPEPQIPSGQLDPGPRPPSYSRAAPSPHGRKGPGLFGERLERLEGDVQRLAQTYGTLSGLVASHEDPNRMTGGPRAPAVPVGFGVIPEGLVGPGDRARGPLTPPLDEILSKVTEVSNTLQTKVQLLDKVHGLALGHEAHLQRLREAPPSPLTSLALLEEYVDRRLHRLWGSLLDGFEQKLQGVQSECDLRVQEVRRQCEEGQAASRRLHQSLDGRELALRQELSQLGSQLQGLSVSGRGSCCGQLALINARMDGLERALQAVTETQRGPGAPAGDELTRLSAAMLEGGVDGLLEGLETLNGTEGGARGCCLRLDMGGWGVGGFGTMLEERVQSLEERLATLAGELSHDSASPGRSARPLVQTELAVLEQRLVSLETSCTPSTTSAILDSLVAEVKAWQSRSEALLRQVASHAALLQQLNGTVAEVQGQLAEGTGSSLQGEITLLKVNLNSVSKSLTGLSDSVSQYSDAFLAANTSLDERERKVEAEVQAIQEQVSSQGSRLQAGHRQVLNLRGELEQLKAGVAKVASGLSRCQDTAQKLQHTVGHFDQRVAQVEGACRRLGLLAAGLDSLPTEPLRPREGLWSHVDQLNRTLAQHTQDIARLRDDLLDCQAQLAEQVRPGQAN

SEQ ID NO: 6259 - protein, 1142 aa, unidentified
MLVLRCRLGTSFPKLDNLVPKGKMKILLVFLGLLGNSVAMPMHMPRMPGFSSKSEEMMRYNQFNFMNGPHMAHLGPFFGNGLPQQFPQYQMPMWPQPPPNTWHPRKSSAPKRHNKTDQTQETQKPNQTQSKKPPQKRPLKQPSHNQPQPEEEAQPPQAFPPFGNGLFPYQQPPWQIPQRLPPPGYGRPPISNEEGGNPYFGYFGYHGFGGRPPYYSEEMFEQDFEKPKEEDPPKAESPGTEPTANSTVTETNSTQPNPKGSQGGNDTSPTGNSTPGLNTGNNPPAQNGIGPLPAVNASGQGGPGSQIPWRPSQPNIRENHPYPNIRNFPSGRQWYFTGTVMGHRQNRPFYRNQQVQRGPRWNFFAWERKQVARPGNPVYHKAYPPTSRGNYPNYAGNPANLRRKPQGPNKHPVGTTVAPLGPKPGPVVRNEKIQNPKEKPLGPKEQIIVPTKNPTSPWRNSQQYEVNKSNYKLPHSEGYMPVPNFNSVDQHENSYYPRGDSRKVPNSDGQTQSQNLPKGIVLGSRRMPYESETNQSELKHSSYQPAVYPEEIPSPAKEHFPAGRNTWDHQEISPPFKEDPGRQEEHLPHPSHGSRGSVFYPEYNPYDPRENSPYLRGNTWDERDDSPNTMGQKESPLYPINTPDQKEIVPYNEEDPVDPTGDEVFPGQNRWGEELSFKGGPTVRHYEGEQYTSNQPKEYLPYSLDNPSKPREDFYYSEFYPWSPDENFPSYNTASTMPPPIESRGYYVNNAAGPEESTLFPSRNSWDHRIQAQGQRERRPYFNRNIWDQATHLQKAPARPPDQKGNQPYYSNTPAGLQKNPIWHEGENLNYGMQITRMNSPEREHSSFPNFIPPSYPSGQKEAHLFHLSQRGSCCAGSSTGPKDNPLALQDYTPSYGLAPGENQDTSPLYTDGSHTKQTRDIISPTSILPGQRNSSEKRESQNPFRDDVSTLRRNTPCSIKNQLGQKEIMPFPEASSLQSKNTPCLKNDLGGDGNNILEQVFEDNQLNERTVDLTPEQLVIGTPDEGSNPEGIQSQVQENESERQQQRPSNILHLPCFGSKLAKHHSSTTGTPSSDGRQSPFDGDSITPTENPNTLVELATEEQFKSINVDPLDADEHSPFEFLQRGTNVQDQVQDCLLLQA

SEQ ID NO: 6260 - protein, 297 aa, unidentified
MRALRAGLTLASGAGLGAVVEGWRRRREDARAAPGLLGRLPVLPVAAAAELPPVPGGPRGPGELAKYGLPGLAQLKSRESYVLCYDPRTRGALWVVEQLRPERLRGDGDRRECDFREDDSVHAYHRATNADYRGSGFDRGHLAAAANHRWSQKAMDDTFYLSNVAPQVPHLNQNAWNNLEKYSRSLTRSYQNVYVCTGPLFLPRTEADGKSYVKYQVIGKNHVAVPTHFFKVLILEAAGGQIELRTYVMPNAPVDEAIPLERFLVPIESIERASGLLFVPNILARAGSLKAITAGSK

SEQ ID NO: 6261 - protein, 410 aa, unidentified
MRACISLVLAVLCGLAWAGKIESCASRCNEKFNRDAACQCDRRCLWHGNCCEDYEHLCTEDHKESEPLPQLEEETEEALASNLYSAPTSCQGRCYEAFDKHHQCHCNARCQEFGNCCKDFESLCSDHEVSHSSDAITKEEIQSISEKIYRADTNKAQKEDIVLNSQNCISPSETRNQVDRCPKPLFTYVNEKLFSKPTYAAFINLLNNYQRATGHGEHFSAQELAEQDAFLREIMKTAVMKELYSFLHHQNRYGSEQEFVDDLKNMWFGLYSRGNEEGDSSGFEHVFSGEVKKGKVTGFHNWIRFYLEEKEGLVDYYSHIYDGPWDSYPDVLAMQFNWDGYYKEVGSAFIGSSPEFEFALYSLCFIARPGKVCQLSLGGYPLAVRTYTWDKSTYGNGKKYIATAYIVSST

SEQ ID NO: 6262 - protein, 76 aa, unidentified
MGAAISQGALIAIVCNGLVGFLLLLLWVILCWACHSRSADVDSLSESSPNSSPGPCPEKAPPPQKPSHEGSYLLQP

SEQ ID NO: 6263 - protein, 440 aa, unidentified
MAVKLGTLLLALALGLAQPASARRKLLVFLLDGFRSDYISDEALESLPGFKEIVSRGVKVDYLTPDFPSLSYPNYYTLMTGRHCEVHQMIGNYMWDPTTNKSFDIGVNKDSLMPLWWNGSEPLWVTLTKAKRKVYMYYWPGCEVEILGVRPTYCLEYKNVPTDINFANAVSDALDSFKSGRADLAAIYHERIDVEGHHYGPASPQRKDALKAVDTVLKYMTKWIQERGLQDRLNVIIFSDHGMTDIFWMDKVIELNKYISLNDLQQVKDRGPVVSLWPAPGKHSEIYNKLSTVEHMTVYEKEAIPSRFYYKKGKFVSPLTLVADEGWFITENREMLPFWMNSTGRREGWQRGWHGYDNELMDMRGIFLAFGPDFKSNFRAAPIRSVDVYNVMCNVVGITPLPNNGSWSRVMCMLKGRASTAPPVWPSHCALALILLFLLA

SEQ ID NO: 6264 - protein, 458 aa, unidentified
MRGLAVLLTVALATLLAPGAGAPVQSQGSQNKLLLVSFDGFRWNYDQDVDTPNLDAMARDGVKARYMTPAFVTMTSPCHFTLVTGKYIENHGVVHNMYYNTTSKVKLPYHATLGIQRWWDNGSVPIWITAQRQGLRAGSFFYPGGNVTYQGVAVTRSRKEGIAHNYKNETEWRANIDTVMAWFTEEDLDLVTLYFGEPDSTGHRYGPESPERREMVRQVDRTVGYLRESIARNHLTDRLNLIITSDHGMTTVDKRAGDLVEFHKFPNFTFRDIEFELLDYGPNGMLLPKEGRLEKVYDALKDAHPKLHVYKKEAFPEAFHYANNPRVTPLLMYSDLGYVIHGRINVQFNNGEHGFDNKDMDMKTIFRAVGPSFRAGLEVEPFESVHVYELMCRLLGIVPEANDGHLATLLPMLHTESALPPDGRPTLLPKGRSALPPSSRPLLVMGLLGTVILLSEVA

SEQ ID NO: 6265 - protein, 428 aa, unidentified
MATSWGTVFFMLVVSCVCSAVSHRNQQTWFEGIFLSSMCPINVSASTLYGIMFDAGSTGTRIHVYTFVQKMPGQLPILEGEVFDSVKPGLSAFVDQPKQGAETVQGLLEVAKDSIPRSHWKKTPVVLKATAGLRLLPEHKAKALLFEVKEIFRKSPFLVPKGSVSIMDGSDEGILAWVTVNFLTGQLHGHRQETVGTLDLGGASTQITFLPQFEKTLEQTPRGYLTSFEMFNSTYKLYTHSYLGFGLKAARLATLGALETEGTDGHTFRSACLPRWLEAEWIFGGVKYQYGGNQEGEVGFEPCYAEVLRVVRGKLHQPEEVQRGSFYAFSYYYDRAVDTDMIDYEKGGILKVEDFERKAREVCDNLENFTSGSPFLCMDLSYITALLKDGFGFADSTVLQLTKKVNNIETGWALGATFHLLQSLGISH

SEQ ID NO: 6266 - protein, 495 aa, unidentified; identical to SEQ ID NO: 1405

SEQ ID NO: 6267 - protein, 527 aa, unidentified; identical to SEQ ID NO: 1406

SEQ ID NO: 6268 - protein, 314 aa, unidentified; identical to SEQ ID NO: 1409

SEQ ID NO: 6269 - protein, 224 aa, unidentified
MPGRAPLRTVPGALGAWLLGGLWAWTLCGLCSLGAVGAPRPCQAPQQWEGRQVMYQQSSGRNSRALLSYDGLNQRVRVLDERKALIPCKRLFEYILLYKDGVMFQIDQATKQCSKMTLTQPWDPLDIPQNSTFEDQYSIGGPQEQITVQEWSDRKSARSYETWIGIYTVKDCYPVQETFTINYSVILSTRFFDIQLGIKDPSVFTPPSTCQMAQLEKMSEDCSW

SEQ ID NO: 6270 - protein, 154 aa, unidentified; identical to SEQ ID NO: 1410

SEQ ID NO: 6271 - protein, 1008 aa, unidentified; identical to SEQ ID NO: 1412

SEQ ID NO: 6272 - protein, 983 aa, unidentified; identical to SEQ ID NO: 1414

SEQ ID NO: 6273 - protein, 986 aa, unidentified; identical to SEQ ID NO: 1415

SEQ ID NO: 6274 - protein, 998 aa, unidentified; identical to SEQ ID NO: 1418

SEQ ID NO: 6275 - protein, 1005 aa, unidentified; identical to SEQ ID NO: 1419

SEQ ID NO: 6276 - protein, 1055 aa, unidentified; identical to SEQ ID NO: 1421

SEQ ID NO: 6277 - protein, 987 aa, unidentified; identical to SEQ ID NO: 1423

SEQ ID NO: 6278 - protein, 360 aa, unidentified
MPELVVTALLAPSRLSLKLLRAFMWSLVFSVALVAAAVYGCIALTHVLCRPRRGCCGRRRSASPACLSDPSLGEHGFLNLKSSGLRLHYVSAGRGNGPLMLFLHGFPENWFSWRYQLREFQSRFHVVAVDLRGYGPSDAPRDVDCYTIDLLLVDIKDVILGLGYSKCILVAHDWGALLAWHFSIYYPSLVERMVVVSGAPMSVYQDYSLHHISQFFRSHYMFLFQLPWLPEKLLSMSDFQILKTTLTHRKTGIPCLTPSELEAFLYNFSQPGGLTGPLNYYRNLFRNFPLEPQELTTPTLLLWGEKDTYLELGLVEAIGSRFVPGRLEAHILPGIGHWIPQSNPQEMHQYMWAFLQDLLD

SEQ ID NO: 6279 - protein, 193 aa, unidentified
MGVHECPAWLWLLLSLLSLPLGLPVLGAPPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 6280 - protein, 133 aa, unidentified
MGSSGLLSLLVLFVLLANVQGPGLTDWLFPRRCPKIREECEFQERDVCTKDRQCQDNKKCCVFSCGKKCLDLKQDVCEMPKETGPCLAYFLHWWYDKKDNTCSMFVYGGCQGNNNNFQSKANCLNTCKNKRFP

SEQ ID NO: 6281 - protein, 133 aa, unidentified; identical to SEQ ID NO: 6280

SEQ ID NO: 6282 - protein, 896 aa, unidentified
MAAAAQLSLTQLSSGNPVYEKYYRQVDTGNTGRVLASDAAAFLKKSGLPDLILGKIWDLADTDGKGILNKQEFFVALRLVACAQNGLEVSLSSLNLAVPPPRFHDTSSPLLISGTSAAELPWAVKPEDKAKYDAIFDSLSPVNGFLSGDKVKPVLLNSKLPVDILGRVWELSDIDHDGMLDRDEFAVAMFLVYCALEKEPVPMSLPPALVPPSKRKTWVVSPAEKAKYDEIFLKTDKDMDGFVSGLEVREIFLKTGLPSTLLAHIWSLCDTKDCGKLSKDQFALAFHLISQKLIKGIDPPHVLTPEMIPPSDRASLQKNIIGSSPVADFSAIKELDTLNNEIVDLQREKNNVEQDLKEKEDTIKQRTSEVQDLQDEVQRENTNLQKLQAQKQQVQELLDELDEQKAQLEEQLKEVRKKCAEEAQLISSLKAELTSQESQISTYEEELAKAREELSRLQQETAELEESVESGKAQLEPLQQHLQDSQQEISSMQMKLMEMKDLENHNSQLNWCSSPHSILVNGATDYCSLSTSSSETANLNEHVEGQSNLESEPIHQESPARSSPELLPSGVTDENEVTTAVTEKVCSELDNNRHSKEEDPFNVDSSSLTGPVADTNLDFFQSDPFVGSDPFKDDPFGKIDPFGGDPFKGSDPFASDCFFRQSTDPFATSSTDPFSAANNSSITSVETLKHNDPFAPGGTVVAASDSATDPFASVFGNESFGGGFADFSTLSKVNNEDPFRSATSSSVSNVVITKNVFEETSVKSEDEPPALPPKIGTPTRPCPLPPGKRSINKLDSPDPFKLNDPFQPFPGNDSPKEKDPEIFCDPFTSATTTTNKEADPSNFANFSAYPSEEDMIEWAKRESEREEEQRLARLNQQEQEDLELAIALSKSEISEA

SEQ ID NO: 6283 - protein, 723 aa, unidentified
MSTATGPEAAPKPSAKSIYEQRKRYSTVVMADVSQYPVNHLVTFCLGEDDGVHTVEDASRKLAVMDSQGRVWAQEMLLRVSPDHVTLLDPASKEELESYPLGAIVRCDAVMPPGRSRSLLLLVCQEPERAQPDVHFFQGLRLGAELIREDIQGALHNYRSGRGERRAAALRATQEELQRDRSPAAETPPLQRRPSVRAVISTVERGAGRGRPQAKPIPEAEEAQRPEPVGTSSNADSASPDLGPRGPDLAVLQAEREVDILNHVFDDVESFVSRLQKSAEAARVLEHRERGRRSRRRAAGEGLLTLRAKPPSEAEYTDVLQKIKYAFSLLARLRGNIADPSSPELLHFLFGPLQMIVNTSGGPEFASSVRRPHLTSDAVALLRDNVTPRENELWTSLGDSWTRPGLELSPEEGPPYRPEFFSGWEPPVTDPQSRAWEDPVEKQLQHERRRRQQSAPQVAVNGHRDLEPESEPQLESETAGKWVLCNYDFQARNSSELSVKQRDVLEVLDDSRKWWKVRDPAGQEGYVPYNILTPYPGPRLHHSQSPARSLNSTPPPPPAPAPAPPPALARPRWDRPRWDSCDSLNGLDPSEKEKFSQMLIVNEELQARLAQGRSGPSRAVPGPRAPEPQLSPGSDASEVRAWLQAKGFSSGTVDALGVLTGAQLFSLQKEELRAVSPEEGARVYSQVTVQRSLLEDKEKVSELEAVMEKQKKKVEGEVEMEVI

SEQ ID NO: 6284 - protein, 715 aa, unidentified
MHLLPALAGVLATLVLAQPCEGTDPASPGAVETSVLRDCIAEAKLLVDAAYNWTQKSIKQRLRSGSASPMDLLSYFKQPVAATRTVVRAADYMHVALGLLEEKLQPQRSGPFNVTDVLTEPQLRLLSQASGCALRDQAERCSDKYRTITGRCNNKRRPLLGASNQALARWLPAEYEDGLSLPFGWTPSRRRNGFLLPLVRAVSNQIVRFPNERLTSDRGRALMFMQWGQFIDHDLDFSPESPARVAFTAGVDCERTCAQLPPCFPIKIPPNDPRIKNQRDCIPFFRSAPSCPQNKNRVRNQINALTSFVDASMVYGSEVSLSLRLRNRTNYLGLLAINQRFQDNGRALLPFDNLHDDPCLLTNRSARIPCFLAGDTRSTETPKLAAMHTLFMREHNRLATELRRLNPRWNGDKLYNEARKIMGAMVQIITYRDFLPLVLGKARARRTLGHYRGYCSNVDPRVANVFTLAFRFGHTMLQPFMFRLDSQYRASAPNSHVPLSSAFFASWRIVYEGGIDPILRGLMATPAKLNRQDAMLVDELRDRLFRQVRRIGLDLAALNMQRSRDHGLPGYNAWRRFCGLSQPRNLAQLSRVLKNQDLARKFLNLYGTPDNIDIWIGAIAEPLLPGARVGPLLACLFENQFRRARDGDRFWWQKRGVFTKRQRKALSRISLSRIICDNTGITTVSRDIFRANIYPRGFVNCSRIPRLNLSAWRGT

SEQ ID NO: 6285 - protein, 322 aa, unidentified
MKTLAGLVLGLVIFDAAVTAPTLESINYDSETYDATLEDLDNLYNYENIPVDKVEIEIATVMPSGNRELLTPPPQPEKAQEEEEEEESTPRLIDGSSPQEPEFTGVLGPHTNEDFPTCLLCTCISTTVYCDDHELDAIPPLPKNTAYFYSRFNRIKKINKNDFASLSDLKRIDLTSNLISEIDEDAFRKLPQLRELVLRDNKIRQLPELPTTLTFIDISNNRLGRKGIKQEAFKDMYDLHHLYLTDNNLDHIPLPLPENLRALHLQNNNILEMHEDTFCNVKNLTYIRKALEDIRLDGNPINLSKTPQAYMCLPRLPVGSLV

SEQ ID NO: 6286 - protein, 294 aa, unidentified; identical to SEQ ID NO: 1427

SEQ ID NO: 6287 - protein, 941 aa, unidentified
MVFLPLKWSLATMSFLLSSLLALLTVSTPSWCQSTEASPKRSDGTPFPWNKIRLPEYVIPVHYDLLIHANLTTLTFWGTTKVEITASQPTSTIILHSHHLQISRATLRKGAGERLSEEPLQVLEHPRQEQIALLAPEPLLVGLPYTVVIHYAGNLSETFHGFYKSTYRTKEGELRILASTQFEPTAARMAFPCFDEPAFKASFSIKIRREPRHLAISNMPLVKSVTVAEGLIEDHFDVTVKMSTYLVAFIISDFESVSKITKSGVKVSVYAVPDKINQADYALDAAVTLLEFYEDYFSIPYPLPKQDLAAIPDFQSGAMENWGLTTYRESALLFDAEKSSASSKLGITMTVAHELAHQWFGNLVTMEWWNDLWLNEGFAKFMEFVSVSVTHPELKVGDYFFGKCFDAMEVDALNSSHPVSTPVENPAQIREMFDDVSYDKGACILNMLREYLSADAFKSGIVQYLQKHSYKNTKNEDLWDSMASICPTDGVKGMDGFCSRSQHSSSSSHWHQEGVDVKTMMNTWTLQKGFPLITITVRGRNVHMKQEHYMKGSDGAPDTGYLWHVPLTFITSKSDMVHRFLLKTKTDVLILPEEVEWIKFNVGMNGYYIVHYEDDGWDSLTGLLKGTHTAVSSNDRASLINNAFQLVSIGKLSIEKALDLSLYLKHETEIMPVFQGLNELIPMYKLMEKRDMNEVETQFKAFLIRLLRDLIDKQTWTDEGSVSERMLRSQLLLLACVHNYQPCVQRAEGYFRKWKESNGNLSLPVDVTLAVFAVGAQSTEGWDFLYSKYQFSLSSTEKSQIEFALCRTQNKEKLQWLLDESFKGDKIKTQEFPQILTLIGRNPVGYPLAWQFLRKNWNKLVQKFELGSSSIAHMVMGTTNQFSTRTRLEEVKGFFSSLKENGSQLRCVQQTIETIEENIGWMDKNFDKIRVWLQSEKLERM

SEQ ID NO: 6288 - protein, 960 aa, unidentified
MFHSSAMVNSHRKPMFNIHRGFYCLTAILPQICICSQFSVPSSYHFTEDPGAFPVATNGERFPWQELRLPSVVIPLHYDLFVHPNLTSLDFVASEKIEVLVSNATQFIILHSKDLEITNATLQSEEDSRYMKPGKELKVLSYPAHEQIALLVPEKLTPHLKYYVAMDFQAKLGDGFEGFYKSTYRTLGGETRILAVTDFEPTQARMAFPCFDEPLFKANFSIKIRRESRHIALSNMPKVKTIELEGGLLEDHFETTVKMSTYLVAYIVCDFHSLSGFTSSGVKVSIYASPDKRNQTHYALQASLKLLDFYEKYFDIYYPLSKLDLIAIPDFAPGAMENWGLITYRETSLLFDPKTSSASDKLWVTRVIAHELAHQWFGNLVTMEWWNDIWLKEGFAKYMELIAVNATYPELQFDDYFLNVCFEVITKDSLNSSRPISKPAETPTQIQEMFDEVSYNKGACILNMLKDFLGEEKFQKGIIQYLKKFSYRNAKNDDLWSSLSNSCLESDFTSGGVCHSDPKMTSNMLAFLGENAEVKEMMTTWTLQKGIPLLVVKQDGCSLRLQQERFLQGVFQEDPEWRALQERYLWHIPLTYSTSSSNVIHRHILKSKTDTLDLPEKTSWVKFNVDSNGYYIVHYEGHGWDQLITQLNQNHTLLRPKDRVGLIHDVFQLVGAGRLTLDKALDMTYYLQHETSSPALLEGLSYLESFYHMMDRRNISDISENLKRYLLQYFKPVIDRQSWSDKGSVWDRMLRSALLKLACDLNHAPCIQKAAELFSQWMESSGKLNIPTDVLKIVYSVGAQTTAGWNYLLEQYELSMSSAEQNKILYALSTSKHQEKLLKLIELGMEGKVIKTQNLAALLHAIARRPKGQQLAWDFVRENWTHLLKKFDLGSYDIRMIISGTTAHFSSKDKLQEVKLFFESLEAQGSHLDIFQTVLETITKNIKWLEKNLPTLRTWLMVNT

SEQ ID NO: 6289 - protein, 1342 aa, unidentified; identical to SEQ ID NO: 1429

SEQ ID NO: 6290 - protein, 483 aa, unidentified
MEEGGGGVRSLVPGGPVLLVLCGLLEASGGGRALPQLSDDIPFRVNWPGTEFSLPTTGVLYKEDNYVIMTTAHKEKYKCILPLVTSGDEEEEKDYKGPNPRELLEPLFKQSSCSYRIESYWTYEVCHGKHIRQYHEEKETGQKINIHEYYLGNMLAKNLLFEKEREAEEKEKSNEIPTKNIEGQMTPYYPVGMGNGTPCSLKQNRPRSSTVMYICHPESKHEILSVAEVTTCEYEVVILTPLLCSHPKYRFRASPVNDIFCQSLPGSPFKPLTLRQLEQQEEILRVPFRRNKEEDLQSTKEERFPAIHKSIAIGSQPVLTVGTTHISKLTDDQLIKEFLSGSYCFRGGVGWWKYEFCYGKHVHQYHEDKDSGKTSVVVGTWNQEEHIEWAKKNTARAYHLQDDGTQTVRMVSHFYGNGDICDITDKPRQVTVKLKCKESDSPHAVTVYMLEPHSCQYILGVESPVICKILDTADENGLLSLPN

SEQ ID NO: 6291 - protein, 348 aa, unidentified
MNMTQARVLVAAVVGLVAVLLYASIHKIEEGHLAVYYRGGALLTSPSGPGYHIMLPFITTFRSVQTTLQTDEVKNVPCGTSGGVMIYIDRIEVVNMLAPYAVFDIVRNYTADYDKTLIFNKIHHELNQFCSAHTLQEVYIELFDQIDENLKQALQKDLNLMAPGLTIQAVRVTKPKIPEAIRRNFELMEAEKTKLLIAAQKQKVVEKEAETERKKAVIEAEKIAQVAKIRFQQKVMEKETEKRISEIEDAAFLAREKAKADAEYYAAHKYATSNKHKLTPEYLELKKYQAIASNSKIYFGSNIPNMFVDSSCALKYSDIRTGRESSLPSKEALEPSGENVIQNKESTG

SEQ ID NO: 6292 - protein, 339 aa, unidentified
MAQLGAVVAVASSFFCASLFSAVHKIEEGHIGVYYRGGALLTSTSGPGFHLMLPFITSYKSVQTTLQTDEVKNVPCGTSGGVMIYFDRIEVVNFLVPNAVYDIVKNYTADYDKALIFNKIHHELNQFCSVHTLQEVYIELFDQIDENLKLALQQDLTSMAPGLVIQAVRVTKPNIPEAIRRNYELMESEKTKLLIAAQKQKVVEKEAETERKKALIEAEKVAQVAEITYGQKVMEKETEKKISEIEDAAFLAREKAKADAECYTAMKIAEANKLKLTPEYLQLMKYKAIASNSKIYFGKDIPNMFMDSAGSVSKQFEGLADKLSFGLEDEPLETATKEN

SEQ ID NO: 6293 - protein, 977 aa, unidentified; identical to SEQ ID NO: 1438

SEQ ID NO: 6294 - protein, 926 aa, unidentified; identical to SEQ ID NO: 1439

SEQ ID NO: 6295 - protein, 468 aa, unidentified
MGRGWGFLFGLLGAVWLLSSGHGEEQPPETAAQRCFCQVSGYLDDCTCDVETIDRFNNYRLFPRLQKLLESDYFRYYKVNLKRPCPFWNDISQCGRRDCAVKPCQSDEVPDGIKSASYKYSEEANNLIEECEQAERLGAVDESLSEETQKAVLQWTKHDDSSDNFCEADDIQSPEAEYVDLLLNPERYTGYKGPDAWKIWNVIYEENCFKPQTIKRPLNPLASGQGTSEENTFYSWLEGLCVEKRAFYRLISGLHASINVHLSARYLLQETWLEKKWGHNITEFQQRFDGILTEGEGPRRLKNLYFLYLIELRALSKVLPFFERPDFQLFTGNKIQDEENKMLLLEILHEIKSFPLHFDENSFFAGDKKEAHKLKEDFRLHFRNISRIMDCVGCFKCRLWGKLQTQGLGTALKILFSEKLIANMPESGPSYEFHLTRQEIVSLFNAFGRISTSVKELENFRNLLQNIH

SEQ ID NO: 6296 - protein, 467 aa, unidentified
MSQGVRRAGAGQGVAAAVQLLVTLSFLRSVVEAQVTGVLDDCLCDIDSIDNFNTYKIFPKIKKLQERDYFRYYKVNLKRPCPFWAEDGHCSIKDCHVEPCPESKIPVGIKAGHSNKYLKMANNTKELEDCEQANKLGAINSTLSNQSKEAFIDWARYDDSRDHFCELDDERSPAAQYVDLLLNPERYTGYKGTSAWRVWNSIYEENCFKPRSVYRPLNPLAPSRGEDDGESFYTWLEGLCLEKRVFYKLISGLHASINLHLCANYLLEETWGKPSWGPNIKEFKHRFDPVETKGEGPRRLKNLYFLYLIELRALSKVAPYFERSIVDLYTGNAEEDADTKTLLLNIFQDTKSFPMHFDEKSMFAGDKKGAKSLKEEFRLHFKNISRIMDCVGCDKCRLWGKLQTQGLGTALKILFSEKEIQKLPENSPSKGFQLTRQEIVALLNAFGRLSTSIRDLQNFKVLLQHSR

SEQ ID NO: 6297 - protein, 273 aa, unidentified
MEAAPSRFMFLLFLLTCELAAEVAAEVEKSSDGPGAAQEPTWLTDVPAAMEFIAATEVAVIGFFQDLEIPAVPILHSMVQKFPGVSFGISTDSEVLTHYNITGNTICLFRLVDNEQLNLEDEDIESIDATKLSRFIEINSLHMVTEYNPVTVIGLFNSVIQIHLLLIMNKASPEYEENMHRYQKAAKLFQGKILFILVDSGMKENGKVISFFKLKESQLPALAIYQTLDDEWDTLPTAEVSVEHVQNFCDGFLSGKLLKENRESEGKTPKVEL

SEQ ID NO: 6298 - protein, 261 aa, unidentified
MAAAVPRAAFLSPLLPLLLGFLLLSAPHGGSGLHTKGALPLDTVTFYKVIPKSKFVLVKFDTQYPYGEKQDEFKRLAENSASSDDLLVAEVGISDYGDKLNMELSEKYKLDKESYPVFYLFRDGDFENPVPYTGAVKVGAIQRWLKGQGVYLGMPGCLPVYDALAGEFIRASGVEARQALLKQGQDNLSSVKETQKKWAEQYLKIMGKILDQGEDFPASEMTRIARLIEKNKMSDGKKEELQKSLNILTAFQKKGAEKEEL

SEQ ID NO: 6299 - protein, 406 aa, unidentified
MHPAVFLSLPDLRCSLLLLVTWVFTPVTTEITSLDTENIDEILNNADVALVNFYADWCRFSQMLHPIFEEASDVIKEEFPNENQVVFARVDCDQHSDIAQRYRISKYPTLKLFRNGMMMKREYRGQRSVKALADYIRQQKSDPIQEIRDLAEITTLDRSKRNIIGYFEQKDSDNYRVFERVANILHDDCAFLSAFGDVSKPERYSGDNIIYKPPGHSAPDMVYLGAMTNFDVTYNWIQDKCVPLVREITFENGEELTEEGLPFLILFHMKEDTESLEIFQNEVARQLISEKGTINFLHADCDKFRHPLLHIQKTPADCPVIAIDSFRHMYVFGDFKDVLIPGKLKQFVFDLHSGKLHREFHHGPDPTDTAPGEQAQDVASSPPESSFQKLAPSEYRYTLLRDRDEL

SEQ ID NO: 6300 - protein, 604 aa, unidentified
MLGMNMLLITLFLLLPLSMLKGEPWEGCLHCTHTTWSGNIMTKTLLYHTYYECAGTCLGTCTHNQTTYSVCDPGRGQPYVCYDPKSSPGTWFEIHVGSKEGDLLNQTKVFPSGKDVVSLYFDVCQIVSMGSLFPVIFSSMEYYSSCHKNRYAHPACSTDSPVTTCWDCTTWSTNQQSLGPIMLTKIPLEPDCKTSTCNSVNLTILEPDQPIWTTGLKAPLGARVSGEEIGPGAYVYLYIIKKTRTRSTQQFRVFESFYEHVNQKLPEPPPLASNLFAQLAENIASSLHVASCYVCGGMNMGDQWPWEARELMPQDNFTLTASSLEPAPSSQSIWFLKTSIIGKFCIARWGKAFTDPVGELTCLGQQYYNETLGKTLWRGKSNNSESPHPSPFSRFPSLNHSWYQLEAPNTWQAPSGLYWICGPQAYRQLPAKWSGACVLGTIRPSFFLMPLKQGEALGYPIYDETKRKSKRGITIGDWKDNEWPPERIIQYYGPATWAEDGMWGYRTPVYMLNRIIRLQAVLEIITNETAGALNLLAQQATKMRNVIYQNRLALDYLLAQEEGVCGKFNLTNCCLELDDEGKVIKEITAKIQKLAHIPVQTWKG

SEQ ID NO: 6301 - protein, 184 aa, unidentified
MKSVLLLTTLLVPAHLVAAWSNNYAVDCPQHCDSSECKSSPRCKRTVLDDCGCCRVCAAGRGETCYRTVSGMDGMKCGPGLRCQPSNGEDPFGEEFGICKDCPYGTFGMDCRETCNCQSGICDRGTGKCLKFPFFQYSVTKSSNRFVSLTEHDMASGDGNIVREEVVKENAAGSPVMRKWLNPR

SEQ ID NO: 6302 - protein, 681 aa, unidentified
MTASPDYLVVLFGITAGATGAKLGSDEKELILLFWKVVDLANKKVGQLHEVLVRPDQLELTEDCKEETKIDVESLSSASQLDQALRQFNQSVSNELNIGVGTSFCLCTDGQLHVRQILHPEASKKNVLLPECFYSFFDLRKEFKKCCPGSPDIDKLDVATMTEYLNFEKSSSVSRYGASQVEDMGNIILAMISEPYNHRFSDPERVNYKFESGTCSKMELIDDNTVVRARGLPWQSSDQDIARFFKGLNIAKGGAALCLNAQGRRNGEALVRFVSEEHRDLALQRHKHHMGTRYIEVYKATGEDFLKIAGGTSNEVAQFLSKENQVIVRMRGLPFTATAEEVVAFFGQHCPITGGKEGILFVTYPDGRPTGDAFVLFACEEYAQNALRKHKDLLGKRYIELFRSTAAEVQQVLNRFSSAPLIPLPTPPIIPVLPQQFVPPTNVRDCIRLRGLPYAATIEDILDFLGEFATDIRTHGVHMVLNHQGRPSGDAFIQMKSADRAFMAAQKCHKKNMKDRYVEVFQCSAEEMNFVLMGGTLNRNGLSPPPCKLPCLSPPSYTFPAPAAVIPTEAAIYQPSVILNPRALQPSTAYYPAGTQLFMNYTAYYPSPPGSPNSLGYFPTAANLSGVPPQPGTVVRMQGLAYNTGVKEILNFFQGYQYATEDGLIHTNDQARTLPKEWVCI

SEQ ID NO: 6303 - protein, 368 aa, unidentified
MAIKSIASRLRGSRRFLSGFVAGAVVGAAGAGLAALQFFRSQGAEGALTGKQPDGSAEKAVLEQFGFPLTGTEARCYTNHALSYDQAKRVPRWVLEHISKSKIMGDADRKHCKFKPDPNIPPTFSAFNEDYVGSGWSRGHMAPAGNNKFSSKAMAETFYLSNIVPQDFDNNSGYWNRIEMYCRELTERFEDVWVVSGPLTLPQTRGDGKKIVSYQVIGEDNVAVPSHLYKVILARRSSVSTEPLALGAFVVPNEAIGFQPQLTEFQVSLQDLEKLSGLVFFPHLDRTSDIRNICSVDTCKLLDFQEFTLYLSTRKIEGARSVLRLEKIMENLKNAEIEPDDYFMSRYEKKLEELKAKEQSGTQIRKPS

SEQ ID NO: 6304 - protein, 676 aa, unidentified
MQSWRRRKSLWLALSASWLLLVLLGGFSLLRLALPPRPRPGASQGWPRWLDAELLQSFSQPGELPEDAVSPPQAPHGGSCNWESCFDTSKCRGDGLKVFVYPAVGTISETHRRILASIEGSRFYTFSPAGACLLLLLSLDAQTGECSSMPLQWNRGRNHLVLRLHPAPCPRTFQLGQAMVAEASPTVDSFRPGFDVALPFLPEAHPLRGGAPGQLRQHSPQPGVALLALEEERGGWRTADTGSSACPWDGRCEQDPGPGQTQRQETLPNATFCLISGHRPEAASRFLQALQAGCIPVLLSPRWELPFSEVIDWTKAAIVADERLPLQVLAALQEMSPARVLALRQQTQFLWDAYFSSVEKVIHTTLEVIQDRIFGTSAHPSLLWNSPPGALLALSTFSTSPQDFPFYYLQQGSRPEGRFSALIWVGPPGQPPLKLIQAVAGSQHCAQILVLWSNERPLPSRWPETAVPLTVIDGHRKVSDRFYPYSTIRTDAILSLDARSSLSTSEVDFAFLVWQSFPERMVGFLTSSHFWDEAHGGWGYTAERTNEFSMVLTTAAFYHRYYHTLFTHSLPKALRTLADEAPTCVDVLMNFIVAAVTKLPPIKVPYGKQRQEAAPLAPGGPGPRPKPPAPAPDCINQIAAAFGHMPLLSSRLRLDPVLFKDPVSVQRKKYRSLEKP

SEQ ID NO: 6305 - protein, 330 aa, unidentified
MRCCHICKLPGRVMGIRVLRLSLVVILVLLLVAGALTALLPSVKEDKMLMLRREIKSQGKSTMDSFTLIMQTYNRTDLLLKLLNHYQAVPNLHKVIVVWNNIGEKAPDELWNSLGPHPIPVIFKQQTANRMRNRLQVFPELETNAVLMVDDDTLISTPDLVFAFSVWQQFPDQIVGFVPRKHVSTSSGIYSYGSFEMQAPGSGNGDQYSMVLIGASFFNSKYLELFQRQPAAVHALIDDTQNCDDIAMNFIIAKHIGKTSGIFVKPVNMDNLEKETNSGYSGMWHRAEHALQRSYCINKLVNIYDSMPLRYSNIMISQFGFPYANYKRKI

SEQ ID NO: 6306 - protein, 488 aa, unidentified
MGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 6307 - protein, 625 aa, unidentified
MIFLYQVVHFILFTSVSGECVTQLLKDTCFEGGDITTVFTPSAKYCQVVCTYHPRCLLFTFTAESPSEDPTRWFTCVLKDSVTETLPRVNRTAAISGYSFKQCSHQISACNKDIYVDLDMKGINYNSSVAKSAQECQERCTDDVHCHFFTYATRQFPSLEHRNICLLKHTQTGTPTRITKLDKVVSGFSLKSCALSNLACIRDIFPNTVFADSNIDSVMAPDAFVCGRICTHHPGCLFFTFFSQEWPKESQRNLCLLKTSESGLPSTRIKKSKALSGFSLQSCRHSIPVFCHSSFYHDTDFLGEELDIVAAKSHEACQKLCTNAVRCQFFTYTPAQASCNEGKGKCYLKLSSNGSPTKILHGRGGISGYTLRLCKMDNECTTKIKPRIVGGTASVRGEWPWQVTLHTTSPTQRHLCGGSIIGNQWILTAAHCFYGVESPKILRVYSGILNQSEIKEDTSFFGVQEIIIHDQYKMAESGYDIALLKLETTVNYTDSQRPICLPSKGDRNVIYTDCWVTGWGYRKLRDKIQNTLQKAKIPLVTNEECQKRYRGHKITHKMICAGYREGGKDACKGDSGGPLSCKHNEVWHLVGITSWGEGCAQRERPGVYTNVVEYVDWILEKTQAV

SEQ ID NO: 6308 - protein, 615 aa, unidentified
MRALLLLGFLLVSLESTLSIPPWEAPKEHKYKAEEHTVVLTVTGEPCHFPFQYHRQLYHKCTHKGRPGPQPWCATTPNFDQDQRWGYCLEPKKVKDHCSKHSPCQKGGTCVNMPSGPHCLCPQHLTGNHCQKEKCFEPQLLRFFHKNEIWYRTEQAAVARCQCKGPDAHCQRLASQACRTNPCLHGGRCLEVEGHRLCHCPVGYTGAFCDVDTKASCYDGRGLSYRGLARTTLSGAPCQPWASEATYRNVTAEQARNWGLGGHAFCRNPDNDIRPWCFVLNRDRLSWEYCDLAQCQTPTQAAPPTPVSPRLHVPLMPAQPAPPKPQPTTRTPPQSQTPGALPAKREQPPSLTRNGPLSCGQRLRKSLSSMTRVVGGLVALRGAHPYIAALYWGHSFCAGSLIAPCWVLTAAHCLQDRPAPEDLTVVLGQERRNHSCEPCQTLAVRSYRLHEAFSPVSYQHDLALLRLQEDADGSCALLSPYVQPVCLPSGAARPSETTLCQVAGWGHQFEGAEEYASFLQEAQVPFLSLERCSAPDVHGSSILPGMLCAGFLEGGTDACQGDSGGPLVCEDQAAERRLTLQGIISWGSGCGDRNKPGVYTDVAYYLAWIREHTVS

SEQ ID NO: 6309 - protein, 661 aa, unidentified
MRLKNLTFIIILIISGELYAEEKPCGFPHVENGRIAQYYYTFKSFYFPMSIDKKLSFFCLAGYTTESGRQEEQTTCTTEGWSPEPRCFKKCTKPDLSNGYISDVKLLYKIQENMRYGCASGYKTTGGKDEEVVQCLSDGWSSQPTCRKEHETCLAPELYNGNYSTTQKTFKVKDKVQYECATGYYTAGGKKTEEVECLTYGWSLTPKCTKLKCSSLRLIENGYFHPVKQTYEEGDVVQFFCHENYYLSGSDLIQCYNFGWYPESPVCEGRRNRCPPPPLPINSKIQTHSTTYRHGEIVHIECELNFEIHGSAEIRCEDGKWTEPPKCIEGQEKVACEEPPFIENGAANLHSKIYYNGDKVTYACKSGYLLHGSNEITCNRGKWTLPPECVENNENCKHPPVVMNGAVADGILASYATGSSVEYRCNEYYLLRGSKISRCEQGKWSSPPVCLEPCTVNVDYMNRNNIEMKWKYEGKVLHGDLIDFVCKQGYDLSPLTPLSELSVQCNRGEVKYPLCTRKESKGMCTSPPLIKHGVIISSTVDTYENGSSVEYRCFDHHFLEGSREAYCLDGMWTTPPLCLEPCTLSFTEMEKNNLLLKWDFDNRPHILHGEYIEFICRGDTYPAELYITGSILRMQCDRGQLKYPRCIPRQSTLSYQEPLRT

SEQ ID NO: 6310 - protein, 622 aa, unidentified
MAHVRGLQLPGCLALAALCSLVHSQHVFLAPQQARSLLQRVRRANTFLEEVRKGNLERECVEETCSYEEAFEALESSTATDVFWAKYTACETARTPRDKLAACLEGNCAEGLGTNYRGHVNITRSGIECQLWRSRYPHKPEINSTTHPGADLQENFCRNPDSSTTGPWCYTTDPTVRRQECSIPVCGQDQVTVAMTPRSEGSSVNLSPPLEQCVPDRGQQYQGRLAVTTHGLPCLAWASAQAKALSKHQDFNSAVQLVENFCRNPDGDEEGVWCYVAGKPGDFGYCDLNYCEEAVEEETGDGLDEDSDRAIEGRTATSEYQTFFNPRTFGSGEADCGLRPLFEKKSLEDKTERELLESYIDGRIVEGSDAEIGMSPWQVMLFRKSPQELLCGASLISDRWVLTAAHCLLYPPWDKNFTENDLLVRIGKHSRTRYERNIEKISMLEKIYIHPRYNWRENLDRDIALMKLKKPVAFSDYIHPVCLPDRETAASLLQAGYKGRVTGWGNLKETWTANVGKGQPSVLQVVNLPIVERPVCKDSTRIRITDNMFCAGYKPDEGKRGDACEGDSGGPFVMKSPFNNRWYQMGIVSWGEGCDRDGKYGFYTHVFRLKKWIQKVIDQFGE

SEQ ID NO: 6311 - protein, 425 aa, unidentified; identical to SEQ ID NO: 1465

SEQ ID NO: 6312 - protein, 385 aa, unidentified; identical to SEQ ID NO: 1468

SEQ ID NO: 6313 - protein, 2224 aa, unidentified
MFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNSGLIGPLLICKKGTLTEGGTQKTFDKQIVLLFAVFDESKSWSQSSSLMYTVNGYVNGTMPDITVCAHDHISWHLLGMSSGPELFSIHFNGQVLEQNHHKVSAITLVSATSTTANMTVGPEGKWIISSLTPKHLQAGMQAYIDIKNCPKKTRNLKKITREQRRHMKRWEYFIAAEEVIWDYAPVIPANMDKKYRSQHLDNFSNQIGKHYKKVMYTQYEDESFTKHTVNPNMKEDGILGPIIRAQVRDTLKIVFKNMASRPYSIYPHGVTFSPYEDEVNSSFTSGRNNTMIRAVQPGETYTYKWNILEFDEPTENDAQCLTRPYYSDVDIMRDIASGLIGLLLICKSRSLDRRGIQRAADIEQQAVFAVFDENKSWYLEDNINKFCENPDEVKRDDPKFYESNIMSTINGYVPESITTLGFCFDDTVQWHFCSVGTQNEILTIHFTGHSFIYGKRHEDTLTLFPMRGESVTVTMDNVGTWMLTSMNSSPRSKKLRLKFRDVKCIPDDDEDSYEIFEPPESTVMATRKMHDRLEPEDEESDADYDYQNRLAAALGIRSFRNSSLNQEEEEFNLTALALENGTEFVSSNTDIIVGSNYSSPSNISKFTVNNLAEPQKAPSHQQATTAGSPLRHLIGKNSVLNSSTAEHSSPYSEDPIEDPLQPDVTGIRLLSLGAGEFKSQEHAKHKGPKVERDQAAKHRFSWMKLLAHKVGRHLSQDTGSPSGMRPWEDLPSQDTGSPSRMRPWKDPPSDLLLLKQSNSSKILVGRWHLASEKGSYEIIQDTDEDTAVNNWLISPQNASRAWGESTPLANKPGKQSGHPKFPRVRHKSLQVRQDGGKSRLKKSQFLIKTRKKKKEKHTHHAPLSPRTFHPLRSEAYNTFSERRLKHSLVLHKSNETSLPTDLNQTLPSMDFGWIASLPDHNQNSSNDTGQASCPPGLYQTVPPEEHYQTFPIQDPDQMHSTSDPSHRSSSPELSEMLEYDRSHKSFPTDISQMSPSSEHEVWQTVISPDLSQVTLSPELSQTNLSPDLSHTTLSPELIQRNLSPALGQMPISPDLSHTTLSPDLSHTTLSLDLSQTNLSPELSQTNLSPALGQMPLSPDLSHTTLSLDFSQTNLSPELSHMTLSPELSQTNLSPALGQMPISPDLSHTTLSLDFSQTNLSPELSQTNLSPALGQMPLSPDPSHTTLSLDLSQTNLSPELSQTNLSPDLSEMPLFADLSQIPLTPDLDQMTLSPDLGETDLSPNFGQMSLSPDLSQVTLSPDISDTTLLPDLSQISPPPDLDQIFYPSESSQSLLLQEFNESFPYPDLGQMPSPSSPTLNDTFLSKEFNPLVIVGLSKDGTDYIEIIPKEEVQSSEDDYAEIDYVPYDDPYKTDVRTNINSSRDPDNIAAWYLRSNNGNRRNYYIAAEEISWDYSEFVQRETDIEDSDDIPEDTTYKKVVFRKYLDSTFTKRDPRGEYEEHLGILGPIIRAEVDDVIQVRFKNLASRPYSLHAHGLSYEKSSEGKTYEDDSPEWFKEDNAVQPNSSYTYVWHATERSGPESPGSACRAWAYYSAVNPEKDIHSGLIGPLLICQKGILHKDSNMPMDMREFVLLFMTFDEKKSWYYEKKSRSSWRLTSSEMKKSHEFHAINGMIYSLPGLKMYEQEWVRLHLLNIGGSQDIHVVHFHGQTLLENGNKQHQLGVWPLLPGSFKTLEMKASKPGWWLLNTEVGENQRAGMQTPFLIMDRDCRMPMGLSTGIISDSQIKASEFLGYWEPRLARLNNGGSYNAWSVEKLAAEFASKPWIQVDMQKEVIITGIQTQGAKHYLKSCYTTEFYVAYSSNQINWQIFKGNSTRNVMYFNGNSDASTIKENQFDPPIVARYIRISPTRAYNRPTLRLELQGCEVNGCSTPLGMENGKIENKQITASSFKKSWWGDYWEPFRARLNAQGRVNAWQAKANNNKQWLEIDLLKIKKITAIITQGCKSLSSEMYVKSYTIHYSEQGVEWKPYRLKSSMVDKIFEGNTNTKGHVKNFFNPPIISRFIRVIPKTWNQSIALRLELFGCDIY

SEQ ID NO: 6314 - protein, 466 aa, unidentified
MVSQALRLLCLLLGLQGCLAAGGVAKASGGETRDMPWKPGPHRVFVTQEEAHGVLHRRRRANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCTPTVEYPCGKIPILEKRNASKPQGRIVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 6315 - protein, 2351 aa, unidentified
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 6316 - protein, 461 aa, unidentified
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 6317 - protein, 128 aa, unidentified
MAFTGKFEMESEKNYDEFMKLLGISSDVIEKARNFKIVTEVQQDGQDFTWSQHYSGGHTMTNKFTVGKESNIQTMGGKTFKATVQMEGGKLVVNFPNYHQTSEIVGDKLVEVSTIGGVTYERVSKRLA

SEQ ID NO: 6318 - protein, 131 aa, unidentified
MAEPDYIEDDNPELIRPQKLINPVKTSRNHQDLHRELLMNQKRGLAPQNKPELQKVMEKRKRDQVIKQKEEEAQKKKSDLEIELLKRQQKLEQLELEKQKLQEEQENAPEFVKVKGNLRRTGQEVAQAQES

SEQ ID NO: 6319 - protein, 366 aa, unidentified
MPMISVLGKMFLWQREGPGGRWTCQTSRRVSSDPAWAVEWIELPRGLSLSSLGSARTLRGWSRSSRPSSVDSQDLPEVNVGDTVAMLPKSRRALTIQEIAALARSSLHGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTESCLSPAEEEPAPCKDCQPLCPPLTGSWERQRQASDLASSGVVSLDEDEAEPEEQ

SEQ ID NO: 6320 - protein, 890 aa, unidentified; identical to SEQ ID NO: 1492

SEQ ID NO: 6321 - protein, 826 aa, unidentified; identical to SEQ ID NO: 1494

SEQ ID NO: 6322 - protein, 416 aa, unidentified
MSISLSSLILLPIWINMAQIQQGGPDEKEKTTALKDLLSRIDLDELMKKDEPPLDFPDTLEGFEYAFNEKGQLRHIKTGEPFVFNYREDLHRWNQKRYEALGEIITKYVYELLEKDCNLKKVSIPVDATESEPKSFIFMSEDALTNPQKLMVLIHGSGVVRAGQWARRLIINEDLDSGTQIPFIKRAVAEGYGVIVLNPNENYIEVEKPKIHVQSSSDSSDEPAEKRERKDKVSKETKKRRDFYEKYRNPQREKEMMQLYIRENGSPEEHAIYVWDHFIAQAAAENVFFVAHSYGGLAFVELMIQREADVKNKVTAVALTDSVHNVWHQEAGKTIREWMRENCCNWVSSSEPLDTSVESMLPDCPRVSAGTDRHELTSWKSFPSIFKFFTEASEAKTSSLKPAVTRRSHRIKHEEL

SEQ ID NO: 6323 - protein, 409 aa, unidentified
MEGESTSAVLSGFVLGALAFQHLNTDSDTEGFLLGEVKGEAKNSITDSQMDDVEVVYTIDIQKYIPCYQLFSFYNSSGEVNEQALKKILSNVKKNVVGWYKFRRHSDQIMTFRERLLHKNLQEHFSNQDLVFLLLTPSIITESCSTHRLEHSLYKPQKGLFHRVPLVVANLGMSEQLGYKTVSGSCMSTGFSRAVQTHSSKFFEEDGSLKEVHKINEMYASLQEELKSICKKVEDSEQAVDKLVKDVNRLKREIEKRRGAQIQAAREKNIQKDPQENIFLCQALRTFFPNSEFLHSCVMSLKNRHVSKSSCNYNHHLDVVDNLTLMVEHTDIPEASPASTPQIIKHKALDLDDRWQFKRSRLLDTQDKRSKADTGSSNQDKASKMSSPETDEEIEKMKGFGEYSRSPTF

SEQ ID NO: 6324 - protein, 213 aa, unidentified
MDQEPVGGVERGEAVAASGAAAAAAFGESAGQMSNERGFENVELGVIGKKKKVPRRVIHFVSGETMEEYSTDEDEVDGLEKKDVLPTVDPTKLTWGPYLWFYMLRAATSTLSVCDFLGEKIASVLGISTPKYQYAIDEYYRMKKEEEEEEEENRMSEEAEKQYQQNKLQTDSIVQTDQPETVISSSFVNVNFEMEGDSEVIMESKQNPVSVPP

SEQ ID NO: 6325 - protein, 173 aa, unidentified
MHWKMLLLLLLYYNAEASMCHRWSRAVLFPAAHRPKRSSSLPLNPVLQTSLEEVELLYEFLLAELEISPDLQISIKDEELASLRKASDFRTVCNNVIPKSIPDIRRLSASLSSHPGILKKEDFERTVLTLAYTAYRTALSHGHQKDIWAQSLVSLFQALRHDLMRSSQPGVPP

SEQ ID NO: 6326 - protein, 539 aa, unidentified; identical to SEQ ID NO: 1501

SEQ ID NO: 6327 - protein, 575 aa, unidentified
MASWLRRKLRGKRRPVIAFCLLMILSAMAVTRFPPQRPSAGPDPGPMEPQGVTGAPATHIRQALSSSRRQRARNMGFWRSRALPRNSILVCAEEQGHRARVDRSRESPGGDLRHPGRVRRDITLSGHPRLSTQHVVLLREDEVGDPGTKDLGHPQHGSPIQETQSEVVTLVSPLPGSDMAALPAWRATSGLTLWPHTAEGRDLLGAENRALTGGQQAEDPTLASGAHQWPGSVEKLQGSVWCDAETLLSSSRTGGQAPPWLTDHDVQMLRLLAQGEVVDKARVPAHGQVLQVGFSTEAALQDLSSPRLSQLCSQGLCGLIKRPGDLPEVLSFHVDRVLGLRRSLPAVARRFHSPLLPYRYTDGGARPVIWWAPDVQHLSDPDEDQNSLALGWLQYQALLAHSCNWPGQAPCPGIHHTEWARLALFDFLLQVHDRLDRYCCGFEPEPSDPCVEERLREKCQNPAELRLVHILVRSSDPSHLVYIDNAGNLQHPEDKLNFRLLEGIDGFPESAVKVLASGCLQNMLLKSLQMDPVFWESQGGAQGLKQVLQTLEQRGQVLLGHIQKHNLTLFRDEDP

SEQ ID NO: 6328 - protein, 133 aa, unidentified [sequence omitted]

SEQ ID NO: 6329 - protein, 131 aa, unidentified
MSKRYLQKATKGKLLIIIFIVTLWGKVVSSANHHKAHHVKTGTCEVVALHRCCNKNKIEERSQTVKCSCFPGQVAGTTRAAPSCVDASIVEQKWWCHMQPCLEGEECKVLPDRKGWSCSSGNKVKTTRVTH

SEQ ID NO: 6330 - protein, 133 aa, unidentified
MSERVERNWSTGGWLLALCLAWLWTHLTLAALQPPTATVLVQQGTCEVIAAHRCCNRNRIEERSQTVKCSCFSGQVAGTTRAKPSCVDASIVLQRWWCQMEPCLPGEECKVLPDLSGWSCSSGHKVKTTKVTR

SEQ ID NO: 6331 - protein, 140 aa, unidentified
MRSPRMRVCAKSVLLSHWLFLAYVLMVCCKLMSASSQHLRGHAGHHQIKQGTCEVVAVHRCCNKNRIEERSQTVKCSCFPGQVAGTTRAQPSCVEASIVIQKWWCHMNPCLEGEDCKVLPDYSGWSCSSGNKVKTTKVTR

SEQ ID NO: 6332 - protein, 132 aa, unidentified
MAPSPRTGSRQDATALPSMSSTFWAFMILASLLIAYCSQLAAGTCEIVTLDRDSSQPRRTIARQTARCACRKGQIAGTTRARPACVDARIIKTKQWCDMLPCLEGEGCDLLINRSGWTCTQPGGRIKTTTVS

SEQ ID NO: 6333 - protein, 541 aa, unidentified
MPGLRRDRLLTLLLLGALLSADLYFHLWPQVQRQLRPRERPRGCPCTGRASSLARDSAAAASDPGTIVHNFSRTEPRTEPAGGSHSGSSSKLQALFAHPLYNVPEEPPLLGAEDSLLASQEALRYYRRKVARWNRRHKMYREQMNLTSLDPPLQLRLEASWVQFHLGINRHGLYSRSSPVVSKLLQDMRHFPTISADYSQDEKALLGACDCTQIVKPSGVHLKLVLRFSDFGKAMFKPMRQQRDEETPVDFFYFIDFQRHNAEIAAFHLDRILDFRRVPPTVGRIVNVTKEILEVTKNEILQSVFFVSPASNVCFFAKCPYMCKTEYAVCGNPHLLEGSLSAFLPSLNLAPRLSVPNPWIRSYTLAGKEEWEVNPLYCDTVKQIYPYNNSQRLLNVIDMAIFDFLIGNMDRHHYEMFTKFGDDGFLIHLDNARGFGRHSHDEISILSPLSQCCMIKKKTLLHLQLLAQADYRLSDVMRESLLEDQLSPVLTEPHLLALDRRLQTILRTVEGCIVAHGQQSVIVDGPVEQLAPDSGQANLTS

SEQ ID NO: 6334 - protein, 584 aa, unidentified
MKMMLVRRFRVLILMVFLVACALHIALDLLPRLERRGARPSGEPGCSCAQPAAEVAAPGWAQVRGRPGEPPAASSAAGDAGWPNKHTLRILQDFSSDPSSNLSSHSLEKLPPAAEPAERALRGRDPGALRPHDPAHRPLLRDPGPRRSESPPGPGGDASLLARLFEHPLYRVAVPPLTEEDVLFNVNSDTRLSPKAAENPDWPHAGAEGAEFLSPGEAAVDSYPNWLKFHIGINRYELYSRHNPAIEALLHDLSSQRITSVAMKSGGTQLKLIMTFQNYGQALFKPMKQTREQETPPDFFYFSDYERHNAEIAAFHLDRILDFRRVPPVAGRMVNMTKEIRDVTRDKKLWRTFFISPANNICFYGECSYYCSTEHALCGKPDQIEGSLAAFLPDLSLAKRKTWRNPWRRSYHKRKKAEWEVDPDYCEEVKQTPPYDSSHRILDVMDMTIFDFLMGNMDRHHYETFEKFGNETFIIHLDNGRGFGKYSHDELSILVPLQQCCRIRKSTYLRLQLLAKEEYKLSLLMAESLRGDQVAPVLYQPHLEALDRRLRVVLKAVRDCVERNGLHSVVDDDLDTEHRAASAR

SEQ ID NO: 6335 - protein, 314 aa, unidentified; identical to SEQ ID NO: 1514

SEQ ID NO: 6336 - protein, 425 aa, unidentified
MMPSESGAERRDRAAAQVGTAAATAVATAAPAGGGPDPEALSAFPGRHLSGLSWPQVKRLDALLSEPIPIHGRGNFPTLSVQPRQIVQVVRSTLEEQGLHVHSVRLHGSAASHVLHPESGLGYKDLDLVFRVDLRSEASFQLTKAVVLACLLDFLPAGVSRAKITPLTLKEAYVQKLVKVCTDSDRWSLISLSNKSGKNVELKFVDSVRRQFEFSIDSFQIILDSLLLFGQCSSTPMSEAFHPTVTGESLYGDFTEALEHLRHRVIATRSPEEIRGGGLLKYCHLLVRGFRPRPSTDVRALQRYMCSRFFIDFPDLVEQRRTLERYLEAHFGGADAARRYACLVTLHRVVNESTVCLMNHERRQTLDLIAALALQALAEQGPAATAALAWRPPGTDGVVPATVNYYVTPVQPLLAHAYPTWLPCN

SEQ ID NO: 6337 - protein, 257 aa, unidentified; identical to SEQ ID NO: 1521

SEQ ID NO: 6338 - protein, 283 aa, unidentified
MPGFFCDCWPSLEIRALLYAMGCIQSIGGKARVFREGITVIDVKASIDPVPTSIDESSSVVLRYRTPHFRASAQVVMPPIPKKETWVVGWIQACSHMEFYNQYGEQGMSSWELPDLQEGKIQAISDSDGVNYPWYGNTTETCTIVGPTKRDSKFIISMNDNFYPSVTWAVPVSESNVAKLTNIYRDQSFTTWLVATNTSTNDMIILQTLHWRMQLSIEVNPNRPLGQRARLREPIAQDQPKILSKNEPIPPSALVKPNANDAQVLMWRPKYGQPLVVIPPKHR

SEQ ID NO: 6339 - protein, 160 aa, unidentified
MQRVSGLLSWTLSRVLWLSGLSEPGAARQPRIMEEKALEVYDLIRTIRDPEKPNTLEELEVVSESCVEVQEINEEEYLVIIRFTPTVPHCSLATLIGLCLRVKLQRCLPFKHKLEIYISEGTHSTEEDINKQINDKERVAAAMENPNLREIVEQCVLEPD

SEQ ID NO: 6340 - protein, 760 aa, unidentified
MKTWVKIVFGVATSAVLALLVMCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 6341 - protein, 335 aa, unidentified; identical to SEQ ID NO: 1531

SEQ ID NO: 6342 - protein, 4588 aa, unidentified; identical to SEQ ID NO: 1533

SEQ ID NO: 6343 - protein, 703 aa, unidentified
MERAAPSRRVPLPLLLLGGLALLAAGVDADVLLEACCADGHRMATHQKDCSLPYATESKECRMVQEQCCHSQLEELHCATGISLANEQDRCATPHGDNASLEATFVKRCCHCCLLGRAAQAQGQSCEYSLMVGYQCGQVFQACCVKSQETGDLDVGGLQETDKIIEVEEEQEDPYLNDRCRGGGPCKQQCRDTGDEVVCSCFVGYQLLSDGVSCEDVNECITGSHSCRLGESCINTVGSFRCQRDSSCGTGYELTEDNSCKDIDECESGIHNCLPDFICQNTLGSFRCRPKLQCKSGFIQDALGNCIDINECLSISAPCPIGHTCINTEGSYTCQKNVPNCGRGYHLNEEGTRCVDVDECAPPAEPCGKGHRCVNSPGSFRCECKTGYYFDGISRMCVDVNECQRYPGRLCGHKCENTLGSYLCSCSVGFRLSVDGRSCEDINECSSSPCSQECANVYGSYQCYCRRGYQLSDVDGVTCEDIDECALPTGGHICSYRCINIPGSFQCSCPSSGYRLAPNGRNCQDIDECVTGIHNCSINETCFNIQGGFRCLAFECPENYRRSAATLQQEKTDTVRCIKSCRPNDVTCVFDPVHTISHTVISLPTFREFTRPEEIIFLRAITPPHPASQANIIFDITEGNLRDSFDIIKRYMDGMTVGVVRQVRPIVGPFHAVLKLEMNYVVGGVVSHRNVVNVHIFVSEYWF

SEQ ID NO: 6344 - protein, 1184 aa, unidentified
MVLLWEPAGAWLALGLALALGPSVAAAAPRQDCTGVECPPLENCIEEALEPGACCATCVQQGCACEGYQYYDCLQGGFVRGRVPAGQSYFVDFGSTECSCPPGGGKISCQFMLCPELPPNCIEAVVVADSCPQCGQVGCVHAGHKYAAGHTVHLPPCRACHCPDAGGELICYQLPGCHGNFSDAEEGDPERHYEDPYSYDQEVAEVEAATALGGEVQAGAVQAGAGGPPAALGGGSQPLSTIQAPPWPAVLPRPTAAAALGPPAPVQAKARRVTEDSEEEEEEEEEREEMAVTEQLAAGGHRGLDGLPTTAPAGPSLPIQEERAEAGARAEAGARPEENLILDAQATSRSTGPEGVTHAPSLGKAALVPTQAVPGSPRDPVKPSPHNILSTSLPDAAWIPPTREVPRKPQVLPHSHVEEDTDPNSVHSIPRSSPEGSTKDLIETCCAAGQQWAIDNDECLEIPESGTEDNVCRTAQRHCCVSYLQEKSCMAGVLGAKEGETCGAEDNDSCGISLYKQCCDCCGLGLRVRAEGQSCESNPNLGYPCNHVMLSCCEGEEPLIVPEVRRPPEPAAAPRRVSEAEMAGREALSLGTEAELPNSLPGDDQDECLLLPGELCQHLCINTVGSYHCACFPGFSLQDDGRTCRPEGHPPQPEAPQEPALKSEFSQVASNTIPLPLPQPNTCKDNGPCKQVCSTVGGSAICSCFPGYAIMADGVSCEDINECVTDLHTCSRGEHCVNTLGSFHCYKALTCEPGYALKDGECEDVDECAMGTHTCQPGFLCQNTKGSFYCQARQRCMDGFLQDPEGNCVDINECTSLSEPCRPGFSCINTVGSYTCQRNPLICARGYHASDDGTKCVDVNECETGVHRCGEGQVCHNLPGSYRCDCKAGFQRDAFGRGCIDVNECWASPGRLCQHTCENTLGSYRCSCASGFLLAADGKRCEDVNECEAQRCSQECANIYGSYQCYCRQGYQLAEDGHTCTDIDECAQGAGILCTFRCLNVPGSYQCACPEQGYTMTANGRSCKDVDECALGTHNCSEAETCHNIQGSFRCLRFECPPNYVQVSKTKCERTTCHDFLECQNSPARITHYQLNFQTGLLVPAHIFRIGPAPAFTGDTIALNIIKGNEEGYFGTRRLNAYTGVVYLQRAVLEPRDFALDVEMKLWRQGSVTTFLAKMHIFFTTFAL

SEQ ID NO: 6345 - protein, 448 aa, unidentified
MPGIKRILTVTILALCLPSPGNAQAQCTNGFDLDRQSGQCLDIDECRTIPEACRGDMMCVNQNGGYLCIPRTNPVYRGPYSNPYSTPYSGPYPAAAPPLSAPNYPTISRPLICRFGYQMDESNQCVDVDECATDSHQCNPTQICINTEGGYTCSCTDGYWLLEGQCLDIDECRYGYCQQLCANVPGSYSCTCNPGFTLNEDGRSCQDVNECATENPCVQTCVNTYGSFICRCDPGYELEEDGVHCSDMDECSFSEFLCQHECVNQPGTYFCSCPPGYILLDDNRSCQDINECEHRNHTCNLQQTCYNLQGGFKCIDPIRCEEPYLRISDNRCMCPAENPGCRDQPFTILYRDMDVVSGRSVPADIFQMQATTRYPGAYYIFQIKSGNEGREFYMRQTGPISATLVMTRPIKGPREIQLDLEMITVNTVINFRGSSVIRLRIYVSQYPF

SEQ ID NO: 6346 - protein, 439 aa, unidentified
MVPSSPRALFLLLLILACPEPRASQNCLSKQQLLSAIRQLQQLLKGQETRFAEGIRHMKSRLAALQNSVGRVGPDALPVSCPALNTPADGRKFGSKYLVDHEVHFTCNPGFRLVGPSSVVCLPNGTWTGEQPHCRGISECSSQPCQNGGTCVEGVNQYRCICPPGRTGNRCQHQAQTAAPEGSVAGDSAFSRAPRCAQVERAQHCSCEAGFHLSGAAGDSVCQDVNECELYGQEGRPRLCMHACVNTPGSYRCTCPGGYRTLADGKSCEDVDECVGLQPVCPQGTTCINTGGSFQCVSPECPEGSGNVSYVKTSPFQCERNPCPMDSRPCRHLPKTISFHYLSLPSNLKTPITLFRMATASAPGRAGPNSLRFGIVGGNSRGHFVMQRSDRQTGDLILVQNLEGPQTLEVDVDMSEYLDRSFQANHVSKVTIFVSPYDF

SEQ ID NO: 6347 - protein, 2871 aa, unidentified
MRRGRLLEIALGFTVLLASYTSHGADANLEAGNVKETRASRAKRRGGGGHDALKGPNVCGSRYNAYCCPGWKTLPGGNQCIVPICRHSCGDGFCSRPNMCTCPSGQIAPSCGSRSIQHCNIRCMNGGSCSDDHCLCQKGYIGTHCGQPVCESGCLNGGRCVAPNRCACTYGFTGPQCERDYRTGPCFTVISNQMCQGQLSGIVCTKTLCCATVGRAWGHPCEMCPAQPHPCRRGFIPNIRTGACQDVDECQAIPGLCQGGNCINTVGSFECKCPAGHKLNEVSQKCEDIDECSTIPGICEGGECTNTVSSYFCKCPPGFYTSPDGTRCIDVRPGYCYTALTNGRCSNQLPQSITKMQCCCDAGRCWSPGVTVAPEMCPIRATEDFNKLCSVPMVIPGRPEYPPPPLGPIPPVLPVPPGFPPGPQIPVPRPPVEYLYPSREPPRVLPVNVTDYCQLVRYLCQNGRCIPTPGSYRCECNKGFQLDLRGECIDVDECEKNPCAGGECINNQGSYTCQCRAGYQSTLTRTECRDIDECLQNGRICNNGRCINTDGSFHCVCNAGFHVTRDGKNCEDMDECSIRNMCLNGMCINEDGSFKCICKPGFQLASDGRYCKDINECETPGICMNGRCVNTDGSYRCECFPGLAVGLDGRVCVDTHMRSTCYGGYKRGQCIKPLFGAVTKSECCCASTEYAFGEPCQPCPAQNSAEYQALCSSGPGMTSAGSDINECALDPDICPNGICENLRGTYKCICNSGYEVDSTGKNCVDINECVLNSLLCDNGQCRNTPGSFVCTCPKGFIYKPDLKTCEDIDECESSPCINGVCKNSPGSFICECSSESTLDPTKTICIETIKGTCWQTVIDGRCEININGATLKSQCCSSLGAAWGSPCTLCQVDPICGKGYSRIKGTQCEDIDECEVFPGVCKNGLCVNTRGSFKCQCPSGMTLDATGRICLDIRLETCFLRYEDEECTLPIAGRHRMDACCCSVGAAWGTEECEECPMRNTPEYEELCPRGPGFATKEITNGKPFFKDINECKMIPSLCTHGKCRNTIGSFKCRCDSGFALDSEERNCTDIDECRISPDLCGRGQCVNTPGDFECKCDEGYESGFMMMKNCMDIDECQRDPLLCRGGVCHNTEGSYRCECPPGHQLSPNISACIDINECELSAHLCPNGRCVNLIGKYQCACNPGYHSTPDRLFCVDIDECSIMNGGCETFCTNSEGSYECSCQPGFALMPDQRSCTDIDECEDNPNICDGGQCTNIPGEYRCLCYDGFMASEDMKTCVDVNECDLNPNICLSGTCENTKGSFICHCDMGYSGKKGKTGCTDINECEIGAHNCGKHAVCTNTAGSFKCSCSPGWIGDGIKCTDLDECSNGTHMCSQHADCKNTMGSYRCLCKEGYTGDGFTCTDLDECSENLNLCGNGQCLNAPGGYRCECDMGFVPSADGKACEDIDECSLPNICVFGTCHNLPGLFRCECEIGYELDRSGGNCTDVNECLDPTTCISGNCVNTPGSYICDCPPDFELNPTRVGCVDTRSGNCYLDIRPRGDNGDTACSNEIGVGVSKASCCCSLGKAWGTPCEMCPAVNTSEYKILCPGGEGFRPNPITVILEDIDECQELPGLCQGGKCINTFGSFQCRCPTGYYLNEDTRVCDDVNECETPGICGPGTCYNTVGNYTCICPPDYMQVNGGNNCMDMRRSLCYRNYYADNQTCDGELLFNMTKKMCCCSYNIGRAWNKPCEQCPIPSTDEFATLCGSQRPGFVIDIYTGLPVDIDECREIPGVCENGVCINMVGSFRCECPVGFFYNDKLLVCEDIDECQNGPVCQRNAECINTAGSYRCDCKPGYRFTSTGQCNDRNECQEIPNICSHGQCIDTVGSFYCLCHTGFKTNDDQTMCLDINECERDACGNGTCRNTIGSFNCRCNHGFILSHNNDCIDVDECASGNGNLCRNGQCINTVGSFQCQCNEGYEVAPDGRTCVDINECLLEPRKCAPGTCQNLDGSYRCICPPGYSLQNEKCEDIDECVEEPEICALGTCSNTEGSFKCLCPEGFSLSSSGRRCQDLRMSYCYAKFEGGKCSSPKSRNHSKQECCCALKGEGWGDPCELCPTEPDEAFRQICPYGSGIIVGPDDSAVDMDECKEPDVCKHGQCINTDGSYRCECPFGYILAGNECVDTDECSVGNPCGNGTCKNVIGGFECTCEEGFEPGPMMTCEDINECAQNPLLCAFRCVNTYGSYECKCPVGYVLREDRRMCKDEDECEEGKHDCTEKQMECKNLIGTYMCICGPGYQRRPDGEGCVDENECQTKPGICENGRCLNTRGSYTCECNDGFTASPNQDECLDNREGYCFTEVLQNMCQIGSSNRNPVTKSECCCDGGRGWGPHCEICPFQGTVAFKKLCPHGRGFMTNGADIDECKVIHDVCRNGECVNDRGSYHCICKTGYTPDITGTSCVDLNECNQAPKPCNFICKNTEGSYQCSCPKGYILQEDGRSCKDLDECATKQHNCQFLCVNTIGGFTCKCPPGFTQHHTSCIDNNECTSDINLCGSKGICQNTPGSFTCECQRGFSLDQTGSSCEDVDECEGNHRCQHGCQNIIGGYRCSCPQGYLQHYQWNQCVDENECLSAHICGGASCHNTLGSYKCMCPAGFQYEQFSGGCQDINECGSAQAPCSYGCSNTEGGYLCGCPPGYFRIGQGHCVSGMGMGRGNPEPPVSGEMDDNSLSPEACYECKINGYPKRGRKRRSTNETDASNIEDQSETEANVSLASWDVEKTAIFAFNISHVSNKVRILELLPALTTLTNHNRYLIESGNEDGFFKINQKEGISYLHFTKKKPVAGTYSLQISSTPLYKKKELNQLEDKYDKDYLSGELGDNLKMKIQVLLH

SEQ ID NO: 6348 - protein, 2912 aa, unidentified
MGRRRRLCLQLYFLWLGCVVLWAQGTAGQPQPPPPKPPRPQPPPQQVRSATAGSEGGFLAPEYREEGAAVASRVRRRGQQDVLRGPNVCGSRFHSYCCPGWKTLPGGNQCIVPICRNSCGDGFCSRPNMCTCSSGQISSTCGSKSIQQCSVRCMNGGTCADDHCQCQKGYIGTYCGQPVCENGCQNGGRCIGPNRCACVYGFTGPQCERDYRTGPCFTQVNNQMCQGQLTGIVCTKTLCCATIGRAWGHPCEMCPAQPQPCRRGFIPNIRTGACQDVDECQAIPGICQGGNCINTVGSFECRCPAGHKQSETTQKCEDIDECSIIPGICETGECSNTVGSYFCVCPRGYVTSTDGSRCIDQRTGMCFSGLVNGRCAQELPGRMTKMQCCCEPGRCWGIGTIPEACPVRGSEEYRRLCMDGLPMGGIPGSAGSRPGGTGGNGFAPSGNGNGYGPGGTGFIPIPGGNGFSPGVGGAGVGAGGQGPIITGLTILNQTIDICKHHANLCLNGRCIPTVSSYRCECNMGYKQDANGDCIDVDECTSNPCTNGDCVNTPGSYYCKCHAGFQRTPTKQACIDIDECIQNGVLCKNGRCVNTDGSFQCICNAGFELTTDGKNCVDHDECTTTNMCLNGMCINEDGSFKCICKPGFVLAPNGRYCTDVDECQTPGICMNGHCINSEGSFRCDCPPGLAVGMDGRVCVDTHMRSTCYGGIKKGVCVRPFPGAVTKSECCCANPDYGFGEPCQPCPAKNSAEFHGLCSSGVGITVDGRDINECALDPDICANGICENLRGSYRCNCNSGYEPDASGRNCIDIDECLVNRLLCDNGLCRNTPGSYSCTCPPGYVFRTETETCEDINECESNPCVNGACRNNLGSFNCECSPGSKLSSTGLICIDSLKGTCWLNIQDSRCEVNINGATLKSECCATLGAAWGSPCERCELDTACPRGLARIKGVTCEDVNECEVFPGVCPNGRCVNSKGSFHCECPEGLTLDGTGRVCLDIRMEQCYLKWDEDECIHPVPGKFRMDACCCAVGAAWGTECEECPKPGTKEYETLCPRGAGFANRGDVLTGRPFYKDINECKAFPGMCTYGKCRNTIGSFKCRCNSGFALDMEERNCTDIDECRISPDLCGSGICVNTPGSFECECFEGYESGFMMMKNCMDIDECERNPLLCRGGTCVNTEGSFQCDCPLGHELSPSREDCVDINECSLSDNLCRNGKCVNMIGTYQCSCNPGYQATPDRQGCTDIDECMIMNGGCDTQCTNSEGSYECSCSEGYALMPDGRSCADIDECENNPDICDGGQCTNIPGEYRCLCYDGFMASMDMKTCIDVNECDLNSNICMFGECENTKGSFICHCQLGYSVKKGTTGCTDVDECEIGAHNCDMHASCLNIPGSFKCSCREGWIGNGIKCIDLDECSNGTHQCSINAQCVNTPGSYRCACSEGFTGDGFTCSDVDECAENINLCENGQCLNVPGAYRCECEMGFTPASDSRSCQDIDECSFQNICVFGTCNNLPGMFHCICDDGYELDRTGGNCTDIDECADPINCVNGLCVNTPGRYECNCPPDFQLNPTGVGCVDNRVGNCYLKFGPRGDGSLSCNTEIGVGVSRSSCCCSLGKAWGNPCETCPPVNSTEYYTLCPGGEGFRPNPITIILEDIDECQELPGLCQGGNCINTFGSFQCECPQGYYLSEDTRICEDIDECFAHPGVCGPGTCYNTLGNYTCICPPEYMQVNGGHNCMDMRKSFCYRSYNGTTCENELPFNVTKRMCCCTYNVGKAWNKPCEPCPTPGTADFKTICGNIPGFTFDIHTGKAVDIDECKEIPGICANGVCINQIGSFRCECPTGFSYNDLLLVCEDIDECSNGDNLCQRNADCINSPGSYRCECAAGFKLSPNGACVDRNECLEIPNVCSHGLCVDLQGSYQCICHNGFKASQDQTMCMDVDECERHPCGNGTCKNTVGSYNCLCYPGFELTHNNDCLDIDECSSFFGQVCRNGRCFNEIGSFKCLCNEGYELTPDGKNCIDTNECVALPGSCSPGTCQNLEGSFRCICPPGYEVKSENCIDINECDEDPNICLFGSCTNTPGGFQCLCPPGFVLSDNGRRCFDTRQSFCFTNFENGKCSVPKAFNTTKAKCCCSKMPGEGWGDPCELCPKDDEVAFQDLCPYGHGTVPSLHDTREDVNECLESPGICSNGQCINTDGSFRCECPMGYNLDYTGVRCVDTDECSIGNPCGNGTCTNVIGSFECNCNEGFEPGPMMNCEDINECAQNPLLCAFRCMNTFGSYECTCPIGYALREDQKMCKDLDECAEGLHDCESRGMMCKNLIGTFMCICPPGMARRPDGEGCVDENECRTKPGICENGRCVNIIGSYRCECNEGFQSSSSGTECLDNRQGLCFAEVLQTICQMASSSRNLVTKSECCCDGGRGWGHQCELCPLPGTAQYKKICPHGPGYTTDGRDIDECKVMPNLCTNGQCINTMGSFRCFCKVGYTTDISGTSCIDLDECSQSPKPCNYICKNTEGSYQCSCPRGYVLQEDGKTCKDLDECQTKQHNCQFLCVNTLGGFTCKCPPGFTQHHTACIDNNECGSQPSLCGAKGICQNTPGSFSCECQRGFSLDATGLNCEDVDECDGNHRCQHGCQNILGGYRCGCPQGYIQHYQWNQCVDENECSNPNACGSASCYNTLGSYKCACPSGFSFDQFSSACHDVNECSSSKNPCNYGCSNTEGGYLCGCPPGYYRVGQGHCVSGMGFNKGQYLSLDTEVDEENALSPEACYECKINGYSKKDSRQKRSIHEPDPTAVEQISLESVDMDSPVNMKFNLSHLGSKEHILELRPAIQPLNNHIRYVISQGNDDSVFRIHQRNGLSYLHTAKKKLMPGTYTLEITSIPLYKKKELKKLEESNEDDYLLGELGEALRMRLQIQLY

SEQ ID NO: 6349 - protein, 2809 aa, unidentified
MTLEGLYLARGPLARLLLAWSALLCMAGGQGRWDGALEAAGPGRVRRRGSPGILQGPNVCGSRFHAYCCPGWRTFPGRSQCVVPICRRACGEGFCSQPNLCTCADGTLAPSCGVSRGSGCSVSCMNGGTCRGASCLCQKGYTGTVCGQPICDRGCHNGGRCIGPNRCACVYGFMGPQCERDYRTGPCFGQVGPEGCQHQLTGLVCTKALCCATVGRAWGLPCELCPAQPHPCRRGFIPNIHTGACQDVDECQAVPGLCQGGSCVNMVGSFHCRCPVGHRLSDSSAACEDYRAGACFSVLFGGRCAGDLAGHYTRRQCCCDRGRCWAAGPVPELCPPRGSNEFQQLCAQRLPLLPGHPGLFPGLLGFGSNGMGPPLGPARLNPHGSDARGIPSLGPGNSNIGTATLNQTIDICRHFTNLCLNGRCLPTPSSYRCECNVGYTQDVRGECIDVDECTSSPCHHGDCVNIPGTYHCRCYPGFQATPTRQACVDVDECIVSGGLCHLGRCVNTEGSFQCVCNAGFELSPDGKNCVDHNECATSTMCVNGVCLNEDGSFSCLCKPGFLLAPGGHYCMDIDECQTPGICVNGHCTNTEGSFRCQCLGGLAVGTDGRVCVDTHVRSTCYGAIEKGSCARPFPGTVTKSECCCANPDHGFGEPCQLCPAKDSAEFQALCSSGLGITTDGRDINECALDPEVCANGVCENLRGSYRCVCNLGYEAGASGKDCTDVDECALNSLLCDNGWCQNSPGSYSCSCPPGFHFWQDTEICKDVDECLSSPCVSGVCRNLAGSYTCKCGPGSRLDPSGTFCLDSTKGTCWLKIQESRCEVNLQGASLRSECCATLGAAWGSPCERCEIDPACARGFARMTGVTCDDVNECESFPGVCPNGRCVNTAGSFRCECPEGLMLDASGRLCVDVRLEPCFLRWDEDECGVTLPGKYRMDVCCCSIGAVWGVECEACPDPESLEFASLCPRGLGFASRDFLSGRPFYKDVNECKVFPGLCTHGTCRNTVGSFHCACAGGFALDAQERNCTDIDECRISPDLCGQGTCVNTPGSFECECFPGYESGFMLMKNCMDVDECARDPLLCRGGTCTNTDGSYKCQCPPGHELTAKGTACEDIDECSLSDGLCPHGQCVNVIGAFQCSCHAGFQSTPDRQGCVDINECRVQNGGCDVHCINTEGSYRCSCGQGYSLMPDGRACADVDECEENPRVCDQGHCTNMPGGHRCLCYDGFMATPDMRTCVDVDECDLNPHICLHGDCENTKGSFVCHCQLGYMVRKGATGCSDVDECEVGGHNCDSHASCLNIPGSFSCRCLPGWVGDGFECHDLDECVSQEHRCSPRGDCLNVPGSYRCTCRQGFAGDGFFCEDRDECAENVDLCDNGQCLNAPGGYRCECEMGFDPTEDHRACQDVDECAQGNLCAFGSCENLPGMFRCICNGGYELDRGGGNCTDINECADPVNCINGVCINTPGSYLCSCPQDFELNPSGVGCVDTRAGNCFLETHDRGDSGISCSAEIGVGVTRASCCCSLGRAWGNPCELCPMANTTEYRTLCPGGEGFQPNRITVILEDIDECQELPGLCQGGDCVNTFGSFQCECPPGYHLSEHTRICEDIDECSTHSGICGPGTCYNTLGNYTCVCPAEYLQVNGGNNCMDMRKSVCFRHYNGTCQNELAFNVTRKMCCCSYNIGQAWNRPCEACPTPISPDYQILCGNQAPGFLTDIHTGKPLDIDECGEIPAICANGICINQIGSFRCECPAGFNYNSILLACEDVDECGSRESPCQQNADCINIPGSYRCKCTRGYKLSPGGACVGRNECREIPNVCSHGDCMDTEGSYMCLCHRGFQASADQTLCMDIDECDRQPCGNGTCKNIIGSYNCLCFPGFVVTHNGDCVDFDECTTLVGQVCRFGHCLNTAGSFHCLCQDGFELTADGKNCVDTNECLSLAGTCLPGTCQNLEGSFRCICPPGFQVQSDHCIDIDECSEEPNLCLFGTCTNSPGSFQCLCPPGFVLSDNGHRCFDTRQSFCFTRFEAGKCSVPKAFNTTKTRCCCSKRPGEGWGDPCELCPQEGSAAFQELCPFGHGAVPGPDDSREDVNECAENPGVCTNGVCVNTDGSFRCECPFGYSLDFTGINCVDTDECSVGHPCGQGTCTNVIGGFECACADGFEPGLMMTCEDIDECSLNPLLCAFRCHNTEGSYLCTCPAGYTLREDGAMCRDVDECADGQQDCHARGMECKNLIGTFACVCPPGMRPLPGSGEGCTDDNECHAQPDLCVNGRCVNTAGSFRCDCDEGFQPSPTLTECHDIRQGPCFAEVLQTMCRSLSSSSEAVTRAECCCGGGRGWGPRCELCPLPGTSAYRKLCPHGSGYTAEGRDVDECRMLAHLCAHGECINSLGSFRCHCQAGYTPDATATTCLDMDECSQVPKPCTFLCKNTKGSFLCSCPRGYLLEEDGRTCKDLDECTSRQHNCQFLCVNTVGAFTCRCPPGFTQHHQACFDNDECSAQPGPCGAHGHCHNTPGSFRCECHQGFTLVSSGHGCEDVNECDGPHRCQHGCQNQLGGYRCSCPQGFTQHSQWAQCVDENECALSPPTCGSASCRNTLGGFRCVCPSGFDFDQALGGCQEVDECAGRRGPCSYSCANTPGGFLCGCPQGYFRAGQGHCVSGLGFSPGPQDTPDKEELLSSEACYECKINGLSPRDRPRRSAHRDHQVNLATLDSEALLTLGLNLSHLGRAERILELRPALEGLEGRIRYVIVRGNEQGFFRMHHLRGVSSLQLGRRRPGPGTYRLEVVSHMAGPWGVQPEGQPGPWGQALRLKVQLQLL

SEQ ID NO: 6350 - protein, 707 aa, unidentified
MNQELLSVGSKRRRTGGSLRGNPSSSQVDEEQMNRVVEEEQQQQLRQQEEEHTARNGEVVGVEPRPGGQNDSQQGQLEENNNRFISVDEDSSGNQEEQEEDEEHAGEQDEEDEEEEEMDQESDDFDQSDDSSREDEHTHTNSVTNSSSIVDLPVHQLSSPFYTKTTKMKRKLDHGSEVRSFSLGKKPCKVSEYTSTTGLVPCSATPTTFGDLRAANGQGQQRRRITSVQPPTGLQEWLKMFQSWSGPEKLLALDELIDSCEPTQVKHMMQVIEPQFQRDFISLLPKELALYVLSFLEPKDLLQAAQTCRYWRILAEDNLLWREKCKEEGIDEPLHIKRRKVIKPGFIHSPWKSAYIRQHRIDTNWRRGELKSPKVLKGHDDHVITCLQFCGNRIVSGSDDNTLKVWSAVTGKCLRTLVGHTGGVWSSQMRDNIIISGSTDRTLKVWNAETGECIHTLYGHTSTVRCMHLHEKRVVSGSRDATLRVWDIETGQCLHVLMGHVAAVRCVQYDGRRVVSGAYDFMVKVWDPETETCLHTLQGHTNRVYSLQFDGIHVVSGSLDTSIRVWDVETGNCIHTLTGHQSLTSGMELKDNILVSGNADSTVKIWDIKTGQCLQTLQGPNKHQSAVTCLQFNKNFVITSSDDGTVKLWDLKTGEFIRNLVTLESGGSGGVVWRIRASNTKLVCAVGSRNGTEETKLLVLDFDVDMK

SEQ ID NO: 6351 - protein, 287 aa, unidentified; identical to SEQ ID NO: 1544

SEQ ID NO: 6352 - protein, 280 aa, unidentified; identical to SEQ ID NO: 1549

SEQ ID NO: 6353 - protein, 254 aa, unidentified; identical to SEQ ID NO: 1552

SEQ ID NO: 6354 - protein, 365 aa, unidentified; identical to SEQ ID NO: 1554

SEQ ID NO: 6355 - protein, 390 aa, unidentified; identical to SEQ ID NO: 1555

SEQ ID NO: 6356 - protein, 326 aa, unidentified; identical to SEQ ID NO: 1556

SEQ ID NO: 6357 - protein, 313 aa, unidentified
MELDRAVGVLGAATLLLSFLGMAWALQAADTCPEVKMVGLEGSDKLTILRGCPGLPGAPGPKGEAGTNGKRGERGPPGPPGKAGPPGPNGAPGEPQPCLTGPRTCKDLLDRGHFLSGWHTIYLPDCRPLTVLCDMDTDGGGWTVFQRRVDGSVDFYRDWATYKQGFGSRLGEFWLGNDNIHALTAQGTSELRVDLVDFEDNYQFAKYRSFKVADEAEKYNLVLGAFVEGSAGDSLTFHNNQSFSTKDQDNDLNTGNCAVMFQGAWWYKNCHVSNLNGRYLRGTHGSFANGINWKSGKGYNYSYKVSEMKVRPA

SEQ ID NO: 6358 - protein, 299 aa, unidentified
MDLLWILPSLWLLLLGGPACLKTQEHPSCPGPRELEASKVVLLPSCPGAPGSPGEKGAPGPQGPPGPPGKMGPKGEPGDPVNLLRCQEGPRNCRELLSQGATLSGWYHLCLPEGRALPVFCDMDTEGGGWLVFQRRQDGSVDFFRSWSSYRAGFGNQESEFWLGNENLHQLTLQGNWELRVELEDFNGNRTFAHYATFRLLGEVDHYQLALGKFSEGTAGDSLSLHSGRPFTTYDADHDSSNSNCAVIVHGAWWYASCYRSNLNGRYAVSEAAAHKYGIDWASGRGVGHPYRRVRMMLR

SEQ ID NO: 6359 - protein, 429 aa, unidentified; identical to SEQ ID NO: 1557

SEQ ID NO: 6360 - protein, 734 aa, unidentified; identical to SEQ ID NO: 1559

SEQ ID NO: 6361 - protein, 977 aa, unidentified; identical to SEQ ID NO: 1561

SEQ ID NO: 6362 - protein, 359 aa, unidentified; identical to SEQ ID NO: 1563

SEQ ID NO: 6363 - protein, 426 aa, unidentified
MWPLTALLLLVPSSGQAATLEKPILSLHPPWTTIFKGERVTLKCDGYHPLLLELQPISTLWYLGHLLLPSHKKSIEVQTPGVYRCQTRGAPVSDPIHLSVSNDWLILQVPYAPVFEGEPLVLRCRGWYDKVVYKLHYYHDGQAVRYFHSSANYTVLQARASDSGRYQCSGTMRIPVESAPMFSAKVAVTVQELFRAPVLRVMGPREARGAALGGVVLRCDTRLHPQKRDTPLQFAFYKYSRAVRRFDWGAEYTVPEPEVEELESYWCEAATATRSVRKRSPWLQLPGPGSPLDPASTTAPAPWAAALAPGNRPLSFRKPPVSRSVPLVTSVRNTTSTGLQFPASGAPTAGPPACAPPTPLEQSAGALKPDVDLLLREMQLLKGLLSRVVLELKEPQALRELRGTPETPTSHFAVSPGTPETTPVES

SEQ ID NO: 6364 - protein, 85 aa, unidentified
MKKVLLLITAILAVAVGFPVSQDQEREKRSISDSDELASGFFVFPYPYPFRPLPPIPFPRFPWFRRNFPIPIPESAPTTPLPSEK

SEQ ID NO: 6365 - protein, 382 aa, unidentified
MGLLLPLALCILVLCCGAMSPPQLALNPSALLSRGCNDSDVLAVAGFALRDINKDRKDGYVLRLNRVNDAQEYRRGGLGSLFYLTLDVLETDCHVLRKKAWQDCGMRIFFESVYGQCKAIFYMNNPSRVLYLAAYNCTLRPVSKKKIYMTCPDCPSSIPTDSSNHQVLEAATESLAKYNNENTSKQYSLFKVTRASSQWVVGPSYFVEYLIKESPCTKSQASSCSLQSSDSVPVGLCKGSLTRTHWEKFVSVTCDFFESQAPATGSENSAVNQKPTNLPKVEESQQKNTPPTDSPSKAGPRGSVQYLPDLDDKNSQEKGPQEAFPVHLDLTTNPQGETLDISFLFLEPMEEKLVVLPFPKEKARTAECPGPAQNASPLVLPP

SEQ ID NO: 6366 - protein, 866 aa, unidentified
MFSMRIVCLVLSVVGTAWTADSGEGDFLAEGGGVRGPRVVERHQSACKDSDWPFCSDEDWNYKCPSGCRMKGLIDEVNQDFTNRINKLKNSLFEYQKNNKDSHSLTTNIMEILRGDFSSANNRDNTYNRVSEDLRSRIEVLKRKVIEKVQHIQLLQKNVRAQLVDMKRLEVDIDIKIRSCRGSCSRALAREVDLKDYEDQQKQLEQVIAKDLLPSRDRQHLPLIKMKPVPDLVPGNFKSQLQKVPPEWKALTDMPQMRMELERPGGNEITRGGSTSYGTGSETESPRNPSSAGSWNSGSSGPGSTGNRNPGSSGTGGTATWKPGSSGPGSTGSWNSGSSGTGSTGNQNPGSPRPGSTGTWNPGSSERGSAGHWTSESSVSGSTGQWHSESGSFRPDSPGSGNARPNNPDWGTFEEVSGNVSPGTRREYHTEKLVTSKGDKELRTGKEKVTSGSTTTTRRSCSKTVTKTVIGPDGHKEVTKEVVTSEDGSDCPEAMDLGTLSGIGTLDGFRHRHPDEAAFFDTASTGKTFPGFFSPMLGEFVSETESRGSESGIFTNTKESSSHHPGIAEFPSRGKSSSYSKQFTSSTSYNRGDSTFESKSYKMADEAGSEADHEGTHSTKRGHAKSRPVRDCDDVLQTHPSGTQSGIFNIKLPGSSKIFSVYCDQETSLGGWLLIQQRMDGSLNFNRTWQDYKRGFGSLNDEGEGEFWLGNDYLHLLTQRGSVLRVELEDWAGNEAYAEYHFRVGSEAEGYALQVSSYEGTAGDALIEGSVEEGAEYTSHNNMQFSTFDRDADQWEENCAEVYGGGWWYNNCQAANLNGIYYPGGSYDPRNNSPYEIENGVVWVSFRGADYSLRAVRMKIRPLVTQ

SEQ ID NO: 6367 - protein, 491 aa, unidentified
MKRMVSWSFHKLKTMKHLLLLLLCVFLVKSQGVNDNEEGFFSARGHRPLDKKREEAPSLRPAPPPISGGGYRARPAKAAATQKKVERKAPDAGGCLHADPDLGVLCPTGCQLQEALLQQERPIRNSVDELNNNVEAVSQTSSSSFQYMYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQCSKEDGGGWWYNRCHAANPNGRYYWGGQYTWDMAKHGTDDGVVWMNWKGSWYSMRKMSMKIRPFFPQQ

SEQ ID NO: 6368 - protein, 208 aa, unidentified
MWKWILTHCASAFPHLPGCCCCCFLLLFLVSSVPVTCQALGQDMVSPEATNSSSSSFSSPSSAGRHVRSYNHLQGDVRWRKLFSFTKYFLKIEKNGKVSGTKKENCPYSILEITSVEIGVVAVKAINSNYYLAMNKKGKLYGSKEFNNDCKLKERIEENGYNTYASFNWQHNGRQMYVALNGKGAPRRGQKTRRKNTSAHFLPMVVHS

SEQ ID NO: 6369 - protein, 216 aa, unidentified
MGAARLLPNLTLCLQLLILCCQTQGENHPSPNFNQYVRDQGAMTDQLSRRQIREYQLYSRTSGKHVQVTGRRISATAEDGNKFAKLIVETDTFGSRVRIKGAESEKYICMNKRGKLIGKPSGKSKDCVFTEIVLENNYTAFQNARHEGWFMAFTRQGRPRQASRSRQNQREAHFIKRLYQGQLPFPNHAEKQKQFEFVGSAPTRRTKRTRRPQPLT

SEQ ID NO: 6370 - protein, 207 aa, unidentified
MYSAPSACTCLCLHFLLLCFQVQVLVAEENVDFRIHVENQTRARDDVSRKQLRLYQLYSRTSGKHIQVLGRRISARGEDGDKYAQLLVETDTFGSQVRIKGKETEFYLCMNRKGKLVGKPDGTSKECVFIEKVLENNYTALMSAKYSGWYVGFTKKGRPRKGPKTRENQQDVHFMKRYPKGQPELQKPFKYTTVTKRSRRIRPTHPA

SEQ ID NO: 6371 - protein, 216 aa, unidentified
MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 6372 - protein, 209 aa, unidentified
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 6373 - protein, 170 aa, unidentified
MRRRLWLGLAWLLLARAPDAAGTPSASRGPRSYPHLEGDVRWRRLFSSTHFFLRVDPGGRVQGTRWRHGQDSILEIRSVHVGVVVIKAVSSGFYVAMNRRGRLYGSRLYTVDCRFRERIEENGHNTYASQRWRRRGQPMFLALDRRGGPRPGGRTRRYHLSAHFLPVLVS

SEQ ID NO: 6374 - protein, 251 aa, unidentified
MLGARLRLWVCALCSVCSMSVLRAYPNASPLLGSSWGGLIHLYTATARNSYHLQIHKNGHVDGAPHQTIYSALMIRSEDAGFVVITGVMSRRYLCMDFRGNIFGSHYFDPENCRFQHQTLENGYDVYHSPQYHFLVSLGRAKRAFLPGMNPPPYSQFLSRRNEIPLIHFNTPIPRRHTRSAEDDSERDPLNVLKPRARMTPAPASCSQELPSAEDNSPMASDPLGVVRGGRVNTHAGGTGPEGCRPFAKFI

SEQ ID NO: 6375 - protein, 239 aa, unidentified
MGLIWLLLLSLLEPGWPAAGPGARLRRDAGGRGGVYEHLGGAPRRRKLYCATKYHLQLHPSGRVNGSLENSAYSILEITAVEVGIVAIRGLFSGRYLAMNKRGRLYASEHYSAECEFVERIHELGYNTYASRLYRTVSSTPGARRQPSAERLWYVSVNGKGRPRRGFKTRRTQKSSLFLPRVLDHRDHEMVRQLQSGLPRPPGKGVQPRRRRQKQSPDNLEPSHVQASRLGSQLEASAH

SEQ ID NO: 6376 - protein, 206 aa, unidentified
MSGPGTAAVALLPAVLLALLAPWAGRGGAAAPTAPNGTLEAELERRWESLVALSLARLPVAAQPKEAAVQSGAGDYLLGIKRLRRLYCNVGIGFHLQALPDGRIGGAHADTRDSLLELSPVERGVVSIFGVASRFFVAMSSKGKLYGSPFFTDECTFKEILLPNNYNAYESYKYPGMFIALSKNGKTKKGNRVSPTMKVTHFLPRL

SEQ ID NO: 6377 - protein, 268 aa, unidentified
MSLSFLLLLFFSHLILSAWAHGEKRLAPKGQPGPAATDRNPRGSSSRQSSSSAMSSSSASSSPAASLGSQGSGLEQSSFQWSPSGRRTGSLYCRVGIGFHLQIYPDGKVNGSHEANMLSVLEIFAVSQGIVGIRGVFSNKFLAMSKKGKLHASAKFTDDCKFRERFQENSYNTYASAIHRTEKTGREWYVALNKRGKAKRGCSPRVKPQHISTHFLPRFKQSEQPELSFTVTVPEKKKPPSPIKPKIPLSAPRKNTNSVKYRLKFRFG

SEQ ID NO: 6378 - protein, 194 aa, unidentified
MHKWILTWILPTLLYRSCFHIICLVGTISLACNDMTPEQMATNVNCSSPERHTRSYDYMEGGDIRVRRLFCRTQWYLRIDKRGKVKGTQEMKNNYNIMEIRTVAVGIVAIKGVESEFYLAMNKEGKLYAKKECNEDCNFKELILENHYNTYASAKWTHNGGEMFVALNQKGIPVRGKKTKKEQKTAHFLPMAIT

SEQ ID NO: 6379 - protein, 233 aa, unidentified
MGSPRSALSCLLLHLLVLCLQAQEGPGRGPALGRELASLFRAGREPQGVSQQHVREQSLVTDQLSRRLIRTYQLYSRTSGKHVQVLANKRINAMAEDGDPFAKLIVETDTFGSRVRVRGAETGLYICMNKKGKLIAKSNGKGKDCVFTEIVLENNYTALQNAKYEGWYMAFTRKGRPRKGSKTRQHQREVHFMKRLPRGHHTTEQSLRFEFLNYPPFTRSLRGSQRTWAPEPR

SEQ ID NO: 6380 - protein, 234 aa, unidentified [sequence omitted]

SEQ ID NO: 6381 - protein, 223 aa, unidentified
MKFVPCLLLVTLSCLGTLGQAPRQKQGSTGEEFHFQTGGRDSCTMRPSSLGQGAGEVWLRVDCRNTDQTYWCEYRGQPSMCQAFAADPKPYWNQALQELRRLHHACQGAPVLRPSVCREAGPQAHMQQVTSSLKGSPEPNQQPEAGTPSLRPKATVKLTEATQLGKDSMEELGKAKPTTRPTAKPTQPGPRPGGNEEAKKKAWEHCWKPFQALCAFLISFFRG

SEQ ID NO: 6382 - protein, 258 aa, unidentified
MTPPKLRASLSPSLLLLLSGCLLAAARREKGAASNVAEPVPGPTGGSSGRFLSPEQHACSWQLLLPAPEAAAGSELALRCQSPDGARHQCAYRGHPERCAAYAARRAHFWKQVLGGLRKKRRPCHDPAPLQARLCAGKKGHGAELRLVPRASPPARPTVAGFAGESKPRARNRGRTRERASGPAAGTPPPQSAPPKENPSERKTNEGKRKAALVPNEERPMGTGPDPDGLDGNAELTETYCAEKWHSLCNFFVNFWNG

SEQ ID NO: 6383 - protein, 822 aa, unidentified [sequence omitted]

SEQ ID NO: 6384 - protein, 821 aa, unidentified; identical to SEQ ID NO: 1571

SEQ ID NO: 6385 - protein, 806 aa, unidentified; identical to SEQ ID NO: 1572

SEQ ID NO: 6386 - protein, 802 aa, unidentified; identical to SEQ ID NO: 1573

SEQ ID NO: 6387 - protein, 504 aa, unidentified; identical to SEQ ID NO: 1574

SEQ ID NO: 6388 - protein, 453 aa, unidentified
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIMKYEASILTHDSSIRYLQEIYNSNNQKIVNLKEKVAQLEAQCQEPCKDTVQIHDITGKDCQDIANKGAKQSGLYFIKPLKANQQFLVYCEIDGSGNGWTVFQKRLDGSVDFKKNWIQYKEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQVRPEHPAETEYDSLYPEDDL

SEQ ID NO: 6389 - protein, 312 aa, unidentified
MAKVFSFILVTTALTMGREISALEDCAQEQMRLRAQVRLLETRVKQQQVKIKQLLQENEVQFLDKGDENTVIDLGSKRQYADCSEIFNDGYKLSGFYKIKPLQSPAEFSVYCDMSDGGGWTVIQRRSDGSENFNRGWKDYENGFGNFVQKHGEYWLGNKNLHFLTTQEDYTLKIDLADFEKNSRYAQYKNFKVGDEKNFYELNIGEYSGTAGDSLAGNFHPEVQWWASHQRMKFSTWDRDHDNYEGNCAEEDQSGWWFNRCHSANLNGVYYSGPYTAKTDNGIVWYTWHGWWYSLKSVVMKIRPNDFIPNVI

SEQ ID NO: 6390 - protein, 439 aa, unidentified
MKLANWYWLSSAVLATYGFLVVANNETEEIKDERAKDVCPVRLESRGKCEEAGECPYQVSLPPLTIQLPKQFSRIEEVFKEVQNLKEIVNSLKKSCQDCKLQADDNGDPGRNGLLLPSTGAPGEVGDNRVRELESEVNKLSSELKNAKEEINVLHGRLEKLNLVNMNNIENYVDSKVANLTFVVNSLDGKCSKCPSQEQIQSRPVQHLIYKDCSDYYAIGKRSSETYRVTPDPKNSSFEVYCDMETMGGGWTVLQARLDGSTNFTRTWQDYKAGFGNLRREFWLGNDKIHLLTKSKEMILRIDLEDFNGVELYALYDQFYVANEFLKYRLHVGNYNGTAGDALRFNKHYNHDLKFFTTPDKDNDRYPSGNCGLYYSSGWWFDACLSANLNGKYYHQKYRGVRNGIFWGTWPGVSEAHPGGYKSSFKEAKMMIRPKHFKP

SEQ ID NO: 6391 - protein, 323 aa, unidentified
MAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVAGDQNVEYKGTVWHKDCFTCSNCKQVIGTGSFFPKGEDFYCVTCHETKFAKHCVKCNKAITSGGITYQDQPWHADCFVCVTCSKKLAGQRFTAVEDQYYCVDCYKNFVAKKCAGCKNPITGKRTVSRVSHPVSKARKPPVCHGKRLPLTLFPSANLRGRHPGGERTCPSWVVVLYRKNRSLAAPRGPGLVKAPVWWPMKDNPGTTTASTAKNAP

SEQ ID NO: 6392 - protein, 1422 aa, unidentified
MATLACRVQFLDDTDPFNSTNFPEPSRPPLFTFREDLALGTQLAGVHRLLQAPHKLDDCTLQLSHNGAYLDLEATLAEQRDELEGFQDDAGRGKKHSIILRTQLSVRVHACIEKLYNSSGRDLRRALFSLKQIFQDDKDLVHEFVVAEGLTCLIKVGAEADQNYQNYILRALGQIMLYVDGMNGVINRNETIQWLYTLIGSKFRLVVKTALKLLLVFVEYSESNAPLLIQAVTAVDTKRGVKPWSNIMEILEEKDGVDTELLVYAMTLVNKTLSGLPDQDTFYDVVDCLEELGIAAVSQRHLNKKGTDLDLVEQLNIYEVALRHEDGDETTEPPPSGCRDRRRASVCSSGGGEHRGLDRRRSRRHSVQSIKSTLSAPTSPCSQSAPSFKPNQVRDLREKYSNFGNNSYHSSRPSSGSSVPTTPTSSVSPPQEARLERSSPSGLLTSSFRQHQESLAAERERRRQEREERLQRIEREERNKFRYKYLEQLAAEEHEKELRSRSVSRGRADLSLDLTSPAAPACLAPLSHSPSSSDSQEALTVSASSPGTPHHPQASAGDPEPESEAEPEAEAGAGQVADEAGQDIASAHEGAETEVEQALEQEPEERASLSEKERQNEGVNERDNCSASSVSSSSSTLEREEKEDKLSRDRTTGLWPAGVQDAGVNGQCGDILTNKRFMLDMLYAHNRKSPDDEEKGDGEAGRTQQEAEAVASLATRISTLQANSQTQDESVRRVDVGCLDNRGSVKAFAEKFNSGDLGRGSISPDAEPNDKVPETAPVQPKTESDYIWDQLMANPRELRIQDMDFTDLGEEDDIDVLDVDLGHREAPGPPPPPPPTFLGLPPPPPPPLLDSIPPPPVPGNLLVPPPPVFNAPQGLGWSQVPRGQPTFTKKKKTIRLFWNEVRPFDWPCKNNRRCREFLWSKLEPIKVDTSRLEHLFESKSKELSVSKKTAADGKRQEIIVLDSKRSNAINIGLTVLPPPRTIKIAILNFDEYALNKEGIEKILTMIPTDEEKQKIQEAQLANPEIPLGSAEQFLLTLSSISELSARLHLWAFKMDYETTEKEVAEPLLDLKEGIDQLENNKTLGFILSTLLAIGNFLNGTNAKAFELSYLEKVPEVKDTVHKQSLLHHVCTMVVENFPDSSDLYSEIGAITRSAKVDFDQLQDNLCQMERRCKASWDHLKAIAKHEMKPVLKQRMSEFLKDCAERIIILKIVHRRIINRFHSFLLFMGHPPYAIREVNINKFCRIISEFALEYRTTRERVLQQKQKRANHRERNKTRGKMITDSGKFSGSSPAPPSQPQGLSYAEDAAEHENMKAVLKTSSPSVEDATPALGVRTRSRASRGSTSSWTMGTDDSPNVTDDAADEIMDRIVKSATQVPSQRVVPRERKRSRANRKSLRRTLKSGLTPEEARALGLVGTSELQL

SEQ ID NO: 6393 - protein, 211 aa, unidentified
MVFLKFFCMSFFCHLCQGYFDGPLYPEMSNGTLHHYFVPDGDYEENDDPEKCQLLFRVSDHRRCSQGEGSQVGSLLSLTLREEFTVLGRQVEDAGRVLEGISKSISYDLDGEESYGKYLRRESHQIGDAYSNSDKSLTELESKFKQGQEQDSRQESRLNEDFLGMLVHTRSLLKETLDISVGLRDKYELLALTIRSHGTRLGRLKNDYLKV

SEQ ID NO: 6394 - protein, 458 aa, unidentified
MMLIPMASVMAVTEPKWVSVWSRFLWVTLLSMVLGSLLALLLPLGAVEEQCLAVLKGLYLLRSKPDRAQHAATKCTSPSTELSITSRGATLLVAKTKASPAGKLEARAALNQALEMKRQGKREKAQKLFMHALKMDPDFVDALTEFGIFSEEDKDIIQADYLYTRALTISPYHEKALVNRDRTLPLVEEIDQRYFSIIDSKVKKVMSIPKGNSALRRVMEETYYHHIYHTVAIEGNTLTLSEIRHILETRYAVPGKSLEEQNEVIGMHAAMKYINTTLVSRIGSVTISDVLEIHRRVLGYVDPVEAGRFRTTQVLVGHHIPPHPQDVEKQMQEFVQWLNSEEAMNLHPVEFAALAHYKLVYIHPFIDGNGRTSRLLMNLILMQAGYPPITIRKEQRSDYYHVLEAANEGDVRPFIRFIAKCTETTLDTLLFATTEYSVALPEAQPNHSGFKETLPVKP

SEQ ID NO: 6395 - protein, 437 aa, unidentified
MGRRMRGAAATAGLWLLALGSLLALWGGLLPPRTELPASRPPEDRLPRRPARSGGPAPAPRFPLPPPLAWDARGGSLKTFRALLTLAAGADGPPRQSRSEPRWHVSARQPRPEESAAVHGGVFWSRGLEEQVPPGFSEAQAAAWLEAARGARMVALERGGCGRSSNRLARFADGTRACVRYGINPEQIQGEALSYYLARLLGLQRHVPPLALARVEARGAQWAQVQEELRAAHWTEGSVVSLTRWLPNLTDVVVPAPWRSEDGRLRPLRDAGGELANLSQAELVDLVQWTDLILFDYLTANFDRLVSNLFSLQWDPRVMQRATSNLHRGPGGALVFLDNEAGLVHGYRVAGMWDKYNEPLLQSVCVFRERTARRVLELHRGQDAAARLLRLYRRHEPRFPELAALADPHAQLLQRRLDFLAKHILHCKAKYGRRSGT

SEQ ID NO: 6396 - protein, 582 aa, unidentified
MFPAGPPSHSLLRLPLLQLLLLVVQAVGRGLGRASPAGGPLEDVVIERYHIPRACPREVQMGDFVRYHYNGTFEDGKKFDSSYDRNTLVAIVVGVGRLITGMDRGLMGMCVNERRRLIVPPHLGYGSIGLAGLIPPDATLYFDVVLLDVWNKEDTVQVSTLLRPPHCPRMVQDGDFVRYHYNGTLLDGTSFDTSYSKGGTYDTYVGSGWLIKGMDQGLLGMCPGERRKIIIPPFLAYGEKGYGTVIPPQASLVFHVLLIDVHNPKDAVQLETLELPPGCVRRAGAGDFMRYHYNGSLMDGTLFDSSYSRNHTYNTYIGQGYIIPGMDQGLQGACMGERRRITIPPHLAYGENGTGDKIPGSAVLIFNVHVIDFHNPADVVEIRTLSRPSETCNETTKLGDFVRYHYNCSLLDGTQLFTSHDYGAPQEATLGANKVIEGLDTGLQGMCVGERRQLIVPPHLAHGESGARGVPGSAVLLFEVELVSREDGLPTGYLFVWHKDPPANLFEDMDLNKDGEVPPEEFSTFIKAQVSEGKGRLMPGQDPEKTIGDMFQNQDRNQDGKITVDELKLKSDEDEERVHEEL

SEQ ID NO: 6397 - protein, 201 aa, unidentified; identical to SEQ ID NO: 1579

SEQ ID NO: 6398 - protein, 211 aa, unidentified
MRLFLWNAVLTLFVTSLIGALIPEPEVKIEVLQKPFICHRKTKGGDLMLVHYEGYLEKDGSLFHSTHKHNNGQPIWFTLGILEALKGWDQGLKGMCVGEKRKLIIPPALGYGKEGKGKIPPESTLIFNIDLLEIRNGPRSHESFQEMDLNDDWKLSKDEVKAYLKKEFEKHGAVVNESHHDALVEDIFDKEDEDKDGFISAREFTYKHDEL

SEQ ID NO: 6399 - protein, 142 aa, unidentified
MRLSWFRVLTVLSICLSAVATATGAEGKRKLQIGVKKRVDHCPIKSRKGDVLHMHYTGKLEDGTEFDSSLPQNQPFVFSLGTGQVIKGWDQGLLGMCEGEKRKLVIPSELGYGERGAPPKIPGGATLVFEVELLKIERRTEL

SEQ ID NO: 6400 - protein, 222 aa, unidentified
MPKTMHFLFRFIVFFYLWGLFTAQRQKKEESTEEVKIEVLHRPENCSKTSKKGDLLNAHYDGYLAKDGSKFYCSRTQNEGHPKWFVLGVGQVIKGLDIAMTDMCPGEKRKVVIPPSFAYGKEGYAEGKIPPDATLIFEIELYAVTKGPRSIETFKQIDMDNDRQLSKAEINLYLQREFEKDEKPRDKSYQDAVLEDIFKKNDHDGDGFISPKEYNVYQHDEL

SEQ ID NO: 6401 - protein, 570 aa, unidentified
MAFRGWRPPPPPLLLLLLWVTGQAAPVAGLGSDAELQIERRFVPDECPRTVRSGDFVRYHYVGTFPDGQKFDSSYDRDSTFNVFVGKGQLITGMDQALVGMCVNERRFVKIPPKLAYGNEGVSGVIPPNSVLHFDVLLMDIWNSEDQVQIHTYFKPPSCPRTIQVSDFVRYHYNGTFLDGTLFDSSHNRMKTYDTYVGIGWLIPGMDKGLLGMCVGEKRIITIPPFLAYGEDGDGKDIPGQASLVFDVALLDLHNPKDSISIENKVVPENCERISQSGDFLRYHYNGTLLDGTLFDSSYSRNRTFDTYIGQGYVIPGMDEGLLGVCIGEKRRIVVPPHLGYGEEGRGNIPGSAVLVFDIHVIDFHNPSDSISITSHYKPPDCSVLSKKGDYLKYHYNASLLDGTLLDSTWNLGKTYNIVLGSGQVVLGMDMGLREMCVGEKRTVIIPPHLGYGEAGVDGEVPGSAVLVFDIELLELVAGLPEGYMFIWNGEVSPNLFEEIDKDGNGEVLLEEFSEYIHAQVASGKGKLAPGFDAELIVKNMFTNQDRNGDGKVTAEEFKLKDQEAKHDEL

SEQ ID NO: 6402 - protein, 1338 aa, unidentified; identical to SEQ ID NO: 1586

SEQ ID NO: 6403 - protein, 1363 aa, unidentified; identical to SEQ ID NO: 1589

SEQ ID NO: 6404 - protein, 535 aa, unidentified [sequence omitted]

SEQ ID NO: 6405 - protein, 532 aa, unidentified; identical to SEQ ID NO: 1595

SEQ ID NO: 6406 - protein, 533 aa, unidentified; identical to SEQ ID NO: 1597

SEQ ID NO: 6407 - protein, 376 aa, unidentified
MQWTSLLLLAGLFSLSQAQYEDDPHWWFHYLRSQQSTYYDPYDPYPYETYEPYPYGVDEGPAYTYGSPSPPDPRDCPQECDCPPNFPTAMYCDNRNLKYLPFVPSRMKYVYFQNNQITSIQEGVFDNATGLLWIALHGNQITSDKVGRKVFSKLRHLERLYLDHNNLTRMPGPLPRSLRELHLDHNQISRVPNNALEGLENLTALYLQHNEIQEVGSSMRGLRSLILLDLSYNHLRKVPDGLPSALEQLYMEHNNVYTVPDSYFRGAPKLLYVRLSHNSLTNNGLASNTFNSSSLLELDLSYNQLQKIPPVNTNLENLYLQGNRINEFSISSFCTVVDVVNFSKLQVLRLDGNEIKRSAMPADAPLCLRLASLIEI

SEQ ID NO: 6408 - protein, 2477 aa, unidentified
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 6409 - protein, 1894 aa, unidentified
MAPEAGATLRAPRRLSWAALLLLAALLPVASSAAASVDHPLKPRHVKLLSTKMGLKVTWDPPKDATSRPVEHYNIAYGKSLKSLKYIKVNAETYSFLIEDVEPGVVYFVLLTAENHSGVSRPVYRAESPPGGEWIEIDGFPIKGPGPFNETVTEKEVPNKPLRVRVRSSDDRLSVAWKAPRLSGAKSPRRSRGFLLGYGESGRKMNYVPLTRDERTHEIKKLASESVYVVSLQSMNSQGRSQPVYRAALTKRKISEEDELDVPDDISVRVMSSQSVLVSWVDPVLEKQKKVVASRQYTVRYREKGELARWDYKQIANRRVLIENLIPDTVYEFAVRISQGERDGKWSTSVFQRTPESAPTTAPENLNVWPVNGKPTVVAASWDALPETEGKVKEYILSYAPALKPFGAKSLTYPGDTTSALVDGLQPGERYLFKIRATNRRGLGPHSKAFIVAMPTTSKADVEQNTEDNGKPEKPEPSSPSPRAPASSQHPSVPASPQGRNAKDLLLDLKNKILANGGAPRKPQLRAKKAEELDLQSTEITGEEELGSREDSPMSPSDTQDQKRTLRPPSRHGHSVVAPGRTAVRARMPALPRREGVDKPGFSLATQPRPGAPPSASASPAHHASTQGTSHRPSLPASLNDNDLVDSDEDERAVGSLHPKGAFAQPRPALSPSRQSPSSVLRDRSSVHPGAKPASPARRTPHSGAAEEDSSASAPPSRLSPPHGGSSRLLPTQPHLSSPLSKGGKDGEDAPATNSNAPSRSTMSSSVSSHLSSRTQVSEGAEASDGESHGDGDREDGGRQAEATAQTLRARPASGHFHLLRHKPFAANGRSPSRFSIGRGPRLQPSSSPQSTVPSRAHPRVPSHSDSHPKLSSGIHGDEEDEKPLPATVVNDHVPSSSRQPISRGWEDLRRSPQRGASLHRKEPIPENPKSTGADTHPQGKYSSLASKAQDVQQSTDADTEGHSPKAQPGSTDRHASPARPPAARSQQHPSVPRRMTPGRAPQQQPPPPVATSQHHPGPQSRDAGRSPSQPRLSLTQAGRPRPTSQGRSHSSSDPYTASSRGMLPTALQNQDEDAQGSYDDDSTEVEAQDVRAPAHAARAKEAAASLPKHQQVESPTGAGAGGDHRSQRGHAASPARPSRPGGPQSRARVPSRAAPGKSEPPSKRPLSSKSQQSVSAEDDEEEDAGFFKGGKEDLLSSSVPKWPSSSTPRGGKDADGSLAKEEREPAIALAPRGGSLAPVKRPLPPPPGSSPRASHVPSRLPPRSAATVSPVAGTHPWPQYTTRAPPGHFSTTPMLSLRQRMMHARFRNPLSRQPARPSYRQGYNGRPNVEGKVLPGSNGKPNGQRIINGPQGTKWVVDLDRGLVLNAEGRYLQDSHGNPLRIKLGGDGRTIVDLEGTPVVSPDGLPLFGQGRHGTPLANAQDKPILSLGGKPLVGLEVIKKTTHPPTTTMQPTTTTTPLPTTTTPRPTTATTRRTTTTRRTTTRRPTTTVRTTTRTTTTTTPTPTTPIPTCPPGTLERHDDDGNLIMSSNGIPECYAEEDEFSGLETDTAVPTEEAYVIYDEDYEFETSRPPTTTEPSTTATTPRVIPEEGAISSFPEEEFDLAGRKRFVAPYVTYLNKDPSAPCSLTDALDHFQVDSLDEIIPNDLKKSDLPPQHAPRNITVVAVEGCHSFVIVDWDKATPGDVVTGYLVYSASYEDFIRNKWSTQASSVTHLPIENLKPNTRYYFKVQAQNPHGYGPISPSVSFVTESDNPLLVVRPPGGEPIWIPFAFKHDPSYTDCHGRQYVKRTWYRKFVGVVLCNSLRYKIYLSDNLKDTFYSIGDSWGRGEDHCQFVDSHLDGRTGPQSYVEALPTIQGYYRQYRQEPVRFGNIGFGTPYYYVGWYECGVSIPGKW

SEQ ID NO: 6410 - protein, 733 aa, unidentified
MAGGRETCLPLIGFILICLKMVASAKSAPEIPTIDQAYSKLSNSITVEWATVPGATSYLLTAEDGDTVIETTVANSPGTVTGLKAATWYEITIRSISAAGRSQASPPKQAKTVLAAPILEVSSPSSDSILVQWEAVYMAIAFSVSIMRANGLGSIWKENTTNTSLTFTSLEAGTLYTIKAYAWNANRIPGDDSTCNQRTSPRAPANIQVSFDSGALKASFSWARAEGAFNYTVMALSDSSELTCSTTFSSCTISSLQCGTEYLISVLASNDAGSSKSSSAMTLKTVACAPGRVTIQEDPPGHLSVAWSSVDLGDYYVVFVKSDDGLEVHCNTSLTQCNFLSECGFTYFISVFVYNKAGQSPLGDIFNYTTAPCCPSDINPVLVSSDRVEIVWSPVRGAELYETKAVDGYNMVECNDTTPACTLSALECDTKYNITVYSFNEVRGSNMSCTPQFITTAPCSPEIKNVSRDAFSMINVHWRSTNDDATYTVTAQGEKGLYQCSSTGESCTMRGLPCGSVFSVTAVAETQAGRSLPSYSVPLETVPCCPTGLTVTQITQSVINVSWTIGRVAQTHVAVLESHTGQSKCHTHQNHCLLGCITCGINYTVTLKAISATGLTADCSYQSYFSGACCPLGVKLYRLGPNGIRIYWQASRGSANYSTDLYGSKGIFTCTPSAGLSFCDVTEIPCGDVYTVMVSPVAKTGLKLTFCPKKIYSVTCSGSTLGMVIYRGKRNEE

SEQ ID NO: 6411 - protein, 1801 aa, unidentified; identical to SEQ ID NO: 1605

SEQ ID NO: 6412 - protein, 255 aa, unidentified; identical to SEQ ID NO: 1608

SEQ ID NO: 6413 - protein, 245 aa, unidentified
MDMAWQMMQLLLLALVTAAGSAQPRSARARTDLLNVCMNAKHHKTQPSPEDELYGQCSPWKKNACCTASTSQELHKDTSRLYNFNWDHCGKMEPTCKRHFIQDSCLYECSPNLGPWIRQVNQSWRKERILNVPLCKEDCERWWEDCRTSYTCKSNWHKGWNWTSGINECPAGALCSTFESYFPTPAALCEGLWSHSFKVSNYSRGSGRCIQMWFDSAQGNPNEEVAKFYAAAMNAGAPSRGIIDS

SEQ ID NO: 6414 - protein, 684 aa, unidentified
MGLSAAAPLWGPPGLLLAIALHPALSVPPRRDYCVLGAGPAGLQMAYFLQRAGRDYAVFERAPRPGSFFTRYPRHRKLISINKRYTGKANAEFNLRHDWNSLLSHDPRLLFRHYSRAYFPDARDMVRYLGDFADTLGLRVQYNTTIAHVTLDKDRQAWNGHYFILTDQKGQVHQCSVLFVATGLSVPNQVDFPGSEYAEGYESVSVDPEDFVGQNVLILGRGNSAFETAENILGVTNFIHMLSRSRVRLSWATHYVGDLRAINNGLLDTYQLKSLDGLLESDLTDLAILKDSKGKFHVTPKFFLEEANTNQSADSITLPQDDNDNFAMRVPYDRVIRCLGWNFDFSIFNKSLRLNSGNAFGKKYPLIRASYESKGSRGLFILGTASHSVDYRKSAGGFIHGFRYTVRAVHRLLEHRHHSVTWPATELPITQLTSSIVRRVNEASGLYQMFGVLADVILLKENSTAFEYLEEFPIQMLAQLETLTGRKAKHGLFVINMEYGRNFSGPDKDVFFDDRSVGHTEDAWQSNFLHPVIYYYRYLPTEQEVRFRPAHWPLPRPTAIHHIVEDFLTDWTAPIGHILPLRRFLENCLDTDLRSFYAESCFLFALTRQKLPPFCQQGYLRMQGLVSTESLWQHRVESRLLRDYAPTGRRLEDSSQQLGDQEPLGSPLAPGPLAQSVDSNKEEL

SEQ ID NO: 6415 - protein, 587 aa, unidentified
MSRARSHLRAALFLAAASARGITTQVAARRGLSAWPVPQEPSMEYQDAVRMLNTLQTNAGYLEQVKRQRGDPQTQLEAMELYLARSGLQVEDLDRLNIIHVTGTKGKGSTCAFTECILRSYGLKTGFFSSPHLVQVRERIRINGQPISPELFTKYFWRLYHRLEETKDGSCVSMPPYFRFLTLMAFHVFLQEKVDLAVVEVGIGGAYDCTNIIRKPVVCGVSSLGIDHTSLLGDTVEKIAWQKGGIFKQGVPAFTVLQPEGPLAVLRDRAQQISCPLYLCPMLEALEEGGPPLTLGLEGEHQRSNAALALQLAHCWLQRQDRHGAGEPKASRPGLLWQLPLAPVFQPTSHMRLGLRNTEWPGRTQVLRRGPLTWYLDGAHTASSAQACVRWFRQALQGRERPSGGPEVRVLLFNATGDRDPAALLKLLQPCQFDYAVFCPNLTEVSSTGNADQQNFTVTLDQVLLRCLEHQQHWNHLDEEQASPDLWSAPSPEPGGSASLLLAPHPPHTCSASSLVFSCISHALQWISQGRDPIFQPPSPPKGLLTHPVAHSGASILREAAAIHVLVTGSLHLVGGVLKLLEPALSQ

SEQ ID NO: 6416 - protein, 4008 aa, unidentified; identical to SEQ ID NO: 1612

SEQ ID NO: 6417 - protein, 2179 aa, unidentified
MNSLSWGAANAVLLLLLLAWASPTFISINRGVRVMKGHSAFLSGDDLKFAIPKEKDACKVEVVMNEPITQRVGKLTPQVFDCHFLPNEVKYVHNGCPILDEDTVKLRLYRFTERDTFIETFILWVYLLEPDCNIIHMSNNVLEVPEFNGLSQAIDKNLLRFDYDRMASLECTVSLDTARTRLPAHGQMVLGEPRPEEPRGDQPHSFFPESQLRAKLKCPGGSCTPGLKKIGSLKVSCEEFLLMGLRYQHLDPPSPNIDYISIQLDLTDTRSKIVYKSESAWLPVYIRAGIPNQIPKAAFMAVFILEVDQFILTSLTTSVLDCEEDETPKPLLVFNITKAPLQGYVTHLLDHTRPISSFTWKDLSDMQIAYQPPNSSHSERRHDEVELEVYDFFFERSAPMTVHISIRTADTNAPRVSWNTGLSLLEGQSRAITWEQFQVVDNDDIGAVRLVTVGGLQHGWLTLRGGKGFLFTVADLQAGVVRYHHDDSDSTKDFVVFRIFDGHHSIRHKFPINVLPKDDSPPFLITNVVIELEEGQTILIQGSMLRASDVDASDDYIFFNITKPPQAGEIMKKPGPGLIGYPVHGFLQRDLFNGIIYYRHFGGEIFEDSFQFVLWDSHEPPNLSVPQVATIHITPVDDQLPKEAPGVSRHLVVKETEVAYITKKQLHFIDSESYDRELVYTITTPPFFSFSHRHLDAGKLFMVDSIPKVVKNPTALELRSFTQHAVNYMKVAYMPPMQDIGPHCRDVQFTFSVSNQHGGTLHGICFNITILPVDNQVPEAFTNPLKVTEGGQSIISTEHILISDADTKLDNIDLSLRELPLHGRVELNGFPLNSGGTFSWGDLHTLKVRYQHDGTEVLQDDLLLEVTDGTNSAEFVLHVEVFPVNDEPPVLKADLMPVMNCSEGGEVVITSEYIFATDVDSDNLKLMFVIAREPQHGVVRRAGVTVDQFSQRDVISEAVTYKHTGGEIGLMPCFDTITLVVSDGEAGPFVNGCCYNGPNPSVPLHASFPVYDLNITVYPVDNQPPSIAIGPVFVVDEGCSTALTVNHLSATDPDTAADDLEFVLVSPPQFGYLENILPSVGFEKSNIGISIDSFQWKDMNAFHINYVQSRHLRIEPTADQFTVYVTDGKHHSLEIPFSIIINPTNDEAPDFVVQNITVCEGQMKELDSSIISAVDLDIPQDALLFSITQKPRHGLLIDRGFSKDFSENKQPANPHQKHAPVHSFSMELLKTGMRLTYMHDDSESLADDFTIQLSDGKHKILKTISVEVIPVNDEKPMLSKKAEIAMNMGETRIISSAILSAIDEDSPREKIYYVFERLPQNGQLQLKIGRDWVPLSPGMKCTQEEVDLNLLRYTHTGAMDSQNQDSFTFYLWDGNNRSPALDCQITIKDMEKGDIVILTKPLVVSKGDRGFLTTTTLLAVDGTDKPEELLYVITSPPRYGQIEYVHYPGVPITNFSQMDVVGQTVCYVHKSKVTVSSDRFRFIISNGLRTEHGVFEITLETVDRALPVVTRNKGLRLAQGAVGLLSPDLLQLTDPDTPAENLTFLLVQLPQHGQLYLWGTGLLQHNFTQQDVDSKNVAYRHSGGDSQTDCFTFMATDGTNQGFIVNGRVWEEPVLFTIQVDQLDKTAPRITLLHSPSQVGLLKNGCYGIYITSRVLKASDPDTEDDQIIFKILQGPKHGHLENTTTGEFIHEKFSQKDLNSKTILYIINPSLEVNSDTVEFQIMDPTGNSATPQILELKWSHIEWSQTEYEVCENVGLLPLEIIRRGYSMDSAFVGIKVNQVSAAVGKDFTVIPSKLIQFDPGMSTKMWNIAITYDGLEEDDEVFEVILNSPVNAVLGTKTKAAVKILDSKGGQCHPSYSSNQSKHSTWEKGIWHLLPPGSSSSTTSGSFHLERRPLPSSMQLAVIRGDTLRGFDSTDLSQRKLRTRGNGKTVRPSSVYRNGTDIIYNYHGIVSLKLEDDSFPTHKRKAKVSIISQPQKTIKVAELPQADKVESTTDSHFPRQDQLPSFPKNCTLELKGLFHFEEGIQKLYQCNGIAWKAWSPQTKDVEDKSCPAGWHQHSGYCHILITEQKGTWNAAAQACREQYLGNLVTVFSRQHMRWLWDIGGRKSFWIGLNDQVHAGHWEWIGGEPVAFTNGRRGPSQRSKLGKSCVLVQRQGKWQTKDCRRAKPHNYVCSRKL

SEQ ID NO: 6418 - protein, 2139 aa, unidentified
MAGASRHPTGTPRQLLVALACLLLSRPALQGRASSLGTEPDPALYLPARGALDGTRPDGPSVLIANPGLRVPLGRSLWLDPLRDLVIGVQPGDRCEVTVLDALPRLKGALSPRRFPCTFGPRQVQYTHFGSHSPGRARVLLQLRYDAPTHTLVLPFTLAVDLVFSQLELVTRNRPLVVEKLRSWSRAIDRRVLDFASLKSGATATRRCRLTPLPHEDGPLPKYGRLVDAVGAPLPRGKGVDCEAFLRAGVRYQHTATSSPNRDYVPMMVELLGPEGQDAGSAGVLVREHFQLLVRIRGGAENTPPRPSFMATMMMEVDPLVLTALTPDALAAEDVESDPGDLVFNILNAPTHPPGHPGQQGYVVSTDDPLGLPVSFFTQQELRELKIAYQPPAENSHGERLFQLELEVVDGDGAASDPFAFMVTVKSMNTLVPVASHNRGLVLFEGQSRPLSSTHSIPISDKDNLEEVKMAAVRGLRHGQLVVFGAPAGCKYFTPADLAAGRVVYQHDGSNTYSDNIIFRMEDGHHQVDFLFPLTILPVDDEPPMVNTNTGLSLTEGQVVQISPFVLSATDIDSEDSTIHFVLENQPLKGNEEEPQWELAPGSSHSGHYLGDLLLQQAELPLSTEDEDWHYMEKEGLYEKVVTEWLQRDIMEGRLFYRHLGPHSPQSVMVQLAFHVQDDHDPPNLSKQHIFTIKVQPVDILSPQLYPGTTLEMTVQEYQLTHFQKNFLRYIDQDSDDQNLWYTLLTLPTDTDGNHQVRAGEIVLTDSPDTLIMHFTQAQVNQHKVAYQPPQKLGIAPRVVQFTYQVEDAAGNSVPGTFTLFLQPVDNQPPEVTNRGFAILEGGSFNLSSNELHVTDPDTDIDQIVFILVRGPQHGHLQYFKRCMVPGESFMQADVINGSVSYQHGRDQTTTSDTFHLEVSDGVHHIPITIPISVHPNVANRSPRISLRSSSLLDVSIDVLENKATEITMGVIHGKRKDVGDLMLSFIVKDSPKLGTILVNGLPTERFTQEDLINGRVAYAHTAGEVGFQKQHDAFSLILSKDSYQWVVGNSIIEKVQVQVTVLPVDNVGPKVFVGESFIVYEGEKNSLTLQHLHVEDVDTHQDELLCTVTSQPASGYLEKIASAPGSKMSQSGSPISAFSLRDIQVRHINYVQSIHKGVEPQEDQFTFYCSDGINFSPNVFFPIIILPTNDEQPKLFAHEFKVLEGMSLVIDTQLLNGADADLPPNELHFQLTALPRHGRIIQQLATGSQPIHSFTLKEIQEASTIVYEHDDSETKEDSFEVWLSDGKHTTHRKVPIVVTLVDDETPHLTVNNGLKVEKGHSEIITNRILKATDLDSDDKSLSFVLHSGPQQGLLQRLRKPRGEVRNNLTLGMNFTQDEINRGLICYIHTGQEGIVDIIKFDVTDGVNTLTDHYFYVTIGNLDSVFPEVISKRITLIEGARVTLTNNLLTNSDINSSDEHHFSITRAPSLGHLESSDYAGEPIASFTQLQLASNKISYVHTSNDEKKMDSFEFQVIGELYPVFRTFRIFITDVDNKKPILTIHRLTLQKEDSQLITLLELTVEDSDTPDDLILFTITQVPMHGKILYNGSRPVTTFTKQDLNKNLISYKHDGSETTEDSFSLTVTDGTHTDFYVLPDTALATHKPQVMRVQIRSLDNRLPQITTNRGAPALKRLHTGHMGFLITSKSLKAEDQDSPHRLLKYKVTRGPEHGFIIKTGLGNQSTRVFTQADIDEMKISYVLNEGSNASKDIFYFSVEDNGGNKLTNQPFHLNWAWICLEKEYYIVDEDSTFLEVTLTRRGYLGETSFISIGTKDETAKKDKDFKWKTNKQIQFNPGQTTATWRVRIIPDNEYETSETFQIILSEPLMAVLEFPEMATVEIVDPGDESTVYIPEAEYKIEEDIGELLIPVRRSGDASQELIVICSTRQGSATGTISSTVLFSDYISRPEDHTSILHFDKNETQKTCQVLIIDDSLYEEEESFSVSLRLPVGGQLGARFPTTKVTILADRYDEPVLHFGDAEYHVNESARYVEVCVWRRGTDLSQPSSIAVRSRKSEQESAEAGTDYVGISRNLDFAPGVRMQTFQVTILDDLGQPTLEGPEKFELLLQMPMGAVLGEPNKTTIFIEDTITDCKQSACSSFD

SEQ ID NO: 6419 - protein, 1309 aa, unidentified
MQPLTKDAGMSLSSVTLASALQVRGEALSEEEIWSLLFLAAEQLLEDLRNDSSDYVVCPWSALLSAAGSLSFQGRVSHIEAAPFKAPELLQGQSEDEQPDASQMHVYSLGMTLYWSAGFHVPPHQPLQLCEPLHSILLTMCEDQPHRRCTLQSVLEACRVHEKEVSVYPAPAGLHIRRLVGLVLGTISEVEKRVVEESSSVQQNRSYLLRKRLRGTSSESPAAQAPECLHPCRVSERSTETQSSPEPHWSTLTHSHCSLLVNRALPGADPQDQQAGRRLSSGSVHSAADSSWPTTPSQRGFLQRRSKFSRPEFILLAGEAPMTLHLPGSVVTKKGKSYLALRDLCVVLLNGQHLEVKCDVESTVGAVFNAVTSFANLEELTYFGLAYMKSKEFFFLDSETRLCKIAPEGWREQPQKTSMNTFTLFLRIKFFVSHYGLLQHSLTRHQFYLQLRKDILEERLYCNEEILLQLGVLALQAEFGNYPKEQVESKPYFHVEDYIPASLIERMTALRVQVEVSEMHRLSSALWGEDAELKFLRVTQQLPEYGVLVHQVFSEKRRPEEEMALGICAKGVIVYEVKNNSRIAMLRFQWRETGKISTYQKKFTITSSVTGKKHTFVTDSAKTSKYLLDLCSAQHGFNAQMGSGQPSHVLFDHDKFVQMANLSPAHQARSKPLIWIQRLSCSENELFVSRLQGAAGGLLSTSMDNFNVDGSKEAGAEGIGRSPCTGREQLKSACVIQKPMTWDSLSGPPVQSMHAGSKNNRRKSFIAEPGREIVRVTLKRDPHRGFGFVINEGEYSGQADPGIFISSIIPGGPAEKAKTIKPGGQILALNHISLEGFTFNMAVRMIQNSPDNIELIISQSKGVGGNNPDEEKNSTANSGVSSTDILSFGYQGSLLSHTQDQDRNTEELDMAGVQSLVPRLRHQLSFLPLKGAGSSCPPSPPEISAGEIYFVELVKEDGTLGFSVTGGINTSVPYGGIYVKSIVPGGPAAKEGQILQGDRLLQVDGVILCGLTHKQAVQCLTGPGQVARLVLERRVPRSTQQCPSANDSMGDERTAVSLVTALPGRPSSCVSVTDGPKFEVKLKKNANGLGFSFVQMEKESCSHLKSDLVRIKRLFPGQPAEENGAIAAGDIILAVNGRSTEGLIFQEVLHLLRGAPQEVTLLLCRPPPGALPELEQEWQTPELSADKEFTRATCTDSCTSPILDQEDSWRDSASPDAGEGLGLRPESSQKAIREAQWGQNRERPWASSLTHSPESHPHLCKLHQERDESTLATSLEKDVRQNCYSVCDIMRLGRYSFSSPLTRLSTDIF

SEQ ID NO: 6420 - protein, 325 aa, unidentified
MVCGSPGGMLLLRAGLLALAALCLLRVPGARAAACEPVRIPLCKSLPWNMTKMPNHLHHSTQANAILAIEQFEGLLGTHCSPDLLFFLCAMYAPICTIDFQHEPIKPCKSVCERARQGCEPILIKYRHSWPENLACEELPVYDRGVCISPEAIVTADGADFPMDSSNGNCRGASSERCKCKPIRATQKTYFRNNYNYVIRAKVKEIKTKCHDVTAVVEVKEILKSSLVNIPRDTVNLYTSSGCLCPPLNVNEEYIIMGYEDEERSRLLLVEGSIAEKWKDRLGKKVKRWDMKLRHLGLSKSDSSNSDSTQSQKSGRNSNPRQARN

SEQ ID NO: 6421 - protein, 129 aa, unidentified
MKTLQFFFLFCCWKAICCNSCELTNITIAIEKEECRFCISINTTWCAGYCYTRDLVYKDPARPKIQKTCTFKELVYETVRVPGCAHHADSLYTYPVATQCHCGKCDSDSTDCTVRGLGPSYCSFGEMKE

SEQ ID NO: 6422 - protein, 695 aa, unidentified; identical to SEQ ID NO: 1619

SEQ ID NO: 6423 - protein, 344 aa, unidentified
MVRARHQPGGLCLLLLLLCQFMEDRSAQAGNCWLRQAKNGRCQVLYKTELSKEECCSTGRLSTSWTEEDVNDNTLFKWMIFNGGAPNCIPCKETCENVDCGPGKKCRMNKKNKPRCVCAPDCSNITWKGPVCGLDGKTYRNECALLKARCKEQPELEVQYQGRCKKTCRDVFCPGSSTCVVDQTNNAYCVTCNRICPEPASSEQYLCGNDGVTYSSACHLRKATCLLGRSIGLAYEGKCIKAKSCEDIQCTGGKKCLWDFKVGRGRCSLCDELCPDSKSDEPVCASDNATYASECAMKEAACSSGVLLEVKHSGSCNSISEDTEEEEEDEDQDYSFPISSILEW

SEQ ID NO: 6424 - protein, 308 aa, unidentified
MWKRWLALALALVAVAWVRAEEELRSKSKICANVFCGAGRECAVTEKGEPTCLCIEQCKPHKRPVCGSNGKTYLNHCELHRDACLTGSKIQVDYDGHCKEKKSVSPSASPVVCYQSNRDELRRRIIQWLEAEIIPDGWFSKGSNYSEILDKYFKNFDNGDSRLDSSEFLKFVEQNETAINITTYPDQENNKLLRGLCVDALIELSDENADWKLSFQEFLKCLNPSFNPPEKKCALEDETYADGAETEVDCNRCVCACGNWVCTAMTCDGKNQKGAQTQTEEEMTRYVQELQKHQETAEKTKRVSTKEI

SEQ ID NO: 6425 - protein, 263 aa, unidentified
MRPGAPGPLWPLPWGALAWAVGFVSSMGSGNPAPGGVCWLQQGQEATCSLVLQTDVTRAECCASGNIDTAWSNLTHPGNKINLLGFLGLVHCLPCKDSCDGVECGPGKACRMLGGRPRCECAPDCSGLPARLQVCGSDGATYRDECELRAARCRGHPDLSVMYRGRCRKSCEHVVCPRPQSCVVDQTGSAHCVVCRAAPCPVPSSPGQELCGNNNVTYISSCHMRQATCFLGRSIGVRHAGSCAGTPEEPPGGESAEEEENFV

SEQ ID NO: 6426 - protein, 842 aa, unidentified
MKPGGFWLHLTLLGASLPAALGWMDPGTSRGPDVGVGESQAEEPRSFEVTRREGLSSHNELLASCGKKFCSRGSRCVLSRKTGEPECQCLEACRPSYVPVCGSDGRFYENHCKLHRAACLLGKRITVIHSKDCFLKGDTCTMAGYARLKNVLLALQTRLQPLQEGDSRQDPASQKRLLVESLFRDLDADGNGHLSSSELAQHVLKKQDLDEDLLGCSPGDLLRFDDYNSDSSLTLREFYMAFQVVQLSLAPEDRVSVTTVTVGLSTVLTCAVHGDLRPPIIWKRNGLTLNFLDLEDINDFGEDDSLYITKVTTIHMGNYTCHASGHEQLFQTHVLQVNVPPVIRVYPESQAQEPGVAASLRCHAEGIPMPRITWLKNGVDVSTQMSKQLSLLANGSELHISSVRYEDTGAYTCIAKNEVGVDEDISSLFIEDSARKTLANILWREEGLSVGNMFYVFSDDGIIVIHPVDCEIQRHLKPTEKIFMSYEEICPQREKNATQPCQWVSAVNVRNRYIYVAQPALSRVLVVDIQAQKVLQSIGVDPLPAKLSYDKSHDQVWVLSWGDVHKSRPSLQVITEASTGQSQHLIRTPFAGVDDFFIPPTNLIINHIRFGFIFNKSDPAVHKVDLETMMPLKTIGLHHHGCVPQAMAHTHLGGYFFIQCRQDSPASAARQLLVDSVTDSVLGPNGDVTGTPHTSPDGRFIVSAAADSPWLHVQEITVRGEIQTLYDLQINSGISDLAFQRSFTESNQYNIYAALHTEPDLLFLELSTGKVGMLKNLKEPPAGPAQPWGGTHRIMRDSGLFGQYLLTPARESLFLINGRQNTLRCEVSGIKGGTTVVWVGEV

SEQ ID NO: 6427 - protein, 847 aa, unidentified
MFKCWSVVLVLGFIFLESEGRPTKEGGYGLKSYQPLMRLRHKQEKNQESSRVKGFMIQDGPFGSCENKYCGLGRHCVTSRETGQAECACMDLCKRHYKPVCGSDGEFYENHCEVHRAACLKKQKITIVHNEDCFFKGDKCKTTEYSKMKNMLLDLQNQKYIMQENENPNGDDISRKKLLVDQMFKYFDADSNGLVDINELTQVIKQEELGKDLFDCTLYVLLKYDDFNADKHLALEEFYRAFQVIQLSLPEDQKLSITAATVGQSAVLSCAIQGTLRPPIIWKRNNIILNNLDLEDINDFGDDGSLYITKVTTTHVGNYTCYADGYEQVYQTHIFQVNVPPVIRVYPESQAREPGVTASLRCHAEGIPKPQLGWLKNGIDITPKLSKQLTLQANGSEVHISNVRYEDTGAYTCIAKNEAGVDEDISSLFVEDSARKTLANILWREEGLGIGNMFYVFYEDGIKVIQPIECEFQRHIKPSEKLLGFQDEVCPKAEGDEVQRCVWASAVNVKDKFIYVAQPTLDRVLIVDVQSQKVVQAVSTDPVPVKLHYDKSHDQVWVLSWGTLEKTSPTLQVITLASGNVPHHTIHTQPVGKQFDRVDDFFIPTTTLIITHMRFGFILHKDEAALQKIDLETMSYIKTINLKDYKCVPQSLAYTHLGGYYFIGCKPDSTGAVSPQVMVDGVTDSVIGFNSDVTGTPYVSPDGHYLVSINDVKGLVRVQYITIRGEIQEAFDIYTNLHISDLAFQPSFTEAHQYNIYGSSSTQTDVLFVELSSGKVKMIKSLKEPLKAEEWPWNRKNRQIQDSGLFGQYLMTPSKDSLFILDGRLNKLNCEITEVEKGNTVIWVGDA

SEQ ID NO: 6428 - protein, 466 aa, unidentified
MRAPGMRSRPAGPALLLLLLFLGAAESVRRAQPPRRYTPDWPSLDSRPLPAWFDEAKFGVFIHWGVFSVPAWGSEWFWWHWQGEGRPQYQRFMRDNYPPGFSYADFGPQFTARFFHPEEWADLFQAAGAKYVVLTTKHHEGFTNWPSPVSWNWNSKDVGPHRDLVGELGTALRKRNIRYGLYHSLLEWFHPLYLLDKKNGFKTQHFVSAKTMPELYDLVNSYKPDLIWSDGEWECPDTYWNSTNFLSWLYNDSPVKDEVVVNDRWGQNCSCHHGGYYNCEDKFKPQSLPDHKWEMCTSIDKFSWGYRRDMALSDVTEESEIISELVQTVSLGGNYLLNIGPTKDGLIVPIFQERLLAVGKWLSINGEAIYASKPWRVQWEKNTTSVWYTSKGSAVYAIFLHWPENGVLNLESPITTSTTKITMLGIQGDLKWSTDPDKGLFISLPQLPPSAVPAEFAWTIKLTGVK

SEQ ID NO: 6429 - protein, 467 aa, unidentified
MRPQELPRLAFPLLLLLLLLLPPPPCPAHSATRFDPTWESLDARQLPAWFDQAKFGIFIHWGVFSVPSFGSEWFWWYWQKEKIPKYVEFMKDNYPPSFKYEDFGPLFTAKFFNANQWADIFQASGAKYIVLTSKHHEGFTLWGSEYSWNWNAIDEGPKRDIVKELEVAIRNRTDLRFGLYYSLFEWFHPLFLEDESSSFHKRQFPVSKTLPELYELVNNYQPEVLWSDGDGGAPDQYWNSTGFLAWLYNESPVRGTVVTNDRWGAGSICKHGGFYTCSDRYNPGHLLPHKWENCMTIDKLSWGYRREAGISDYLTIEELVKQLVETVSCGGNLLMNIGPTLDGTISVVFEERLRQMGSWLKVNGEAIYETHTWRSQNDTVTPDVWYTSKPKEKLVYAIFLKWPTSGQLFLGHPKAILGATEVKLLGHGQPLNWISLEQNGIMVELPQLTIHQMPCKWGWALALTNVI

SEQ ID NO: 6430 - protein, 794 aa, unidentified; identical to SEQ ID NO: 1620

SEQ ID NO: 6431 - protein, 479 aa, unidentified
MVRIQRRKLLASCLCVTATVFLLVTLQVMVELGKFERKEFKSSSLQDGHTKMEEAPTHLNSFLKKEGLTFNRKRKWELDSYPIMLWWSPLTGETGRLGQCGADACFFTINRTYLHHHMTKAFLFYGTDFNIDSLPLPRKAHHDWAVFHEESPKNNYKLFHKPVITLFNYTATFSRHSHLPLTTQYLESIEVLKSLRYLVPLQSKNKLRKRLAPLVYVQSDCDPPSDRDSYVRELMTYIEVDSYGECLRNKDLPQQLKNPASMDADGFYRIIAQYKFILAFENAVCDDYITEKFWRPLKLGVVPVYYGSPSITDWLPSNKSAILVSEFSHPRELASYIRRLDSDDRLYEAYVEWKLKGEISNQRLLTALRERKWGVQDVNQDNYIDAFECMVCTKVWANIRLQEKGLPPKRWEAEDTHLSCPEPTVFAFSPLRTPPLSSLREMWISSFEQSKKEAQALRWLVDRNQNFSSQEFWGLVFKD

SEQ ID NO: 6432 - protein, 492 aa, unidentified
MAAGPIRVVLVLLGVLSVCAASGHGSVAEREAGGEAEWAEPWDGAVFRPPSALGAVGVTRSSGTPRPGREEAGDLPVLLWWSPGLFPHFPGDSERIECARGACVASRNRRALRDSRTRALLFYGTDFRASAAPLPRLAHQSWALLHEESPLNNFLLSHGPGIRLFNLTSTFSRHSDYPLSLQWLPGTAYLRRPVPPPMERAEWRRRGYAPLLYLQSHCDVPADRDRYVRELMRHIPVDSYGKCLQNRELPTARLQDTATATTEDPELLAFLSRYKFHLALENAICNDYMTEKLWRPMHLGAVPVYRGSPSVRDWMPNNHSVILIDDFESPQKLAEFIDFLDKNDEEYMKYLAYKQPGGITNQFLLDSLKHREWGVNDPLLPNYLNGFECFVCDYELARLDAEKAHAASPGDSPVFEPHIAQPSHMDCPVPTPGFGNVEEIPENDSWKEMWLQDYWQGLDQGEALTAMIHNNETEQTKFWDYLHEIFMKRQHL

SEQ ID NO: 6433 - protein, 210 aa, unidentified
MWTLGRRAVAGLLASPSPAQAQTLTRVPRPAELAPLCGRRGLRTDIDATCTPRRASSNQRGLNQIWNVKKQSVYLMNLRKSGTLGHPGSLDETTYERLAEETLDSLAEFFEDLADKPYTFEDYDVSFGSGVLTVKLGGDLGTYVINKQTPNKQIWLSSPSSGPKRYDWTGKNWVYSHDGVSLHELLAAELTKALKTKLDLSSLAYSGKDA

SEQ ID NO: 6434 - protein, 621 aa, unidentified
MAELTVEVRGSNGAFYKGFIKDVHEDSLTVVFENNWQPERQVPFNEVRLPPPPDIKKEISEGDEVEVYSRANDQEPCGWWLAKVRMMKGEFYVIEYAACDATYNEIVTFERLRPVNQNKTVKKNTFFKCTVDVPEDLREACANENAHKDFKKAVGACRIFYHPETTQLMILSASEATVKRVNILSDMHLRSIRTKLMLMSRNEEATKHLECTKQLAAAFHEEFVVREDLMGLAIGTHGSNIQQARKVPGVTAIELDEDTGTFRIYGESADAVKKARGFLEFVEDFIQVPRNLVGKVIGKNGKVIQEIVDKSGVVRVRIEGDNENKLPREDGMVPFVFVGTKESIGNVQVLLEYHIAYLKEVEQLRMERLQIDEQLRQIGSRSYSGRGRGRRGPNYTSGYGTNSELSNPSETESERKDELSDWSLAGEDDRDSRHQRDSRRRPGGRGRSVSGGRGRGGPRGGKSSISSVLKDPDSNPYSLLDNTESDQTADTDASESHHSTNRRRRSRRRRTDEDAVLMDGMTESDTASVNENGLVTVADYISRAESQSRQRNLPRETLAKNKKEMAKDVIEEHGPSEKAINGPTSASGDDISKLQRTPGEEKINTLKEENTQEAAVLNGVS

SEQ ID NO: 6435 - protein, 92 aa, unidentified; identical to SEQ ID NO: 1630

SEQ ID NO: 6436 - protein, 87 aa, unidentified; identical to SEQ ID NO: 1632

SEQ ID NO: 6437 - protein, 961 aa, unidentified; identical to SEQ ID NO: 1650

SEQ ID NO: 6438 - protein, 456 aa, unidentified; identical to SEQ ID NO: 1652

SEQ ID NO: 6439 - protein, 451 aa, unidentified; identical to SEQ ID NO: 1653

SEQ ID NO: 6440 - protein, 462 aa, unidentified; identical to SEQ ID NO: 1656

SEQ ID NO: 6441 - protein, 452 aa, unidentified [sequence omitted]

SEQ ID NO: 6442 - protein, 467 aa, unidentified; identical to SEQ ID NO: 1665

SEQ ID NO: 6443 - protein, 440 aa, unidentified; identical to SEQ ID NO: 1666

SEQ ID NO: 6444 - protein, 123 aa, unidentified
MARGSALLLASLLLAAALSASAGLWSPAKEKRGWTLNSAGYLLGPHAVGNHRSFSDKNGLTSKRELRPEDDMKPGSFDRSIPENNIMRTIIEFLSFLHLKEAGALDRLLDLPAAASSEDIERS

SEQ ID NO: 6445 - protein, 423 aa, unidentified
MLPPQKKPWESMAKGLVLGALFTSFLLLVYSYAVPPLHAGLASTTPEAAASCSPPALEPEAVIRANGSAGECQPRRNIVFLKTHKTASSTLLNILFRFGQKHRLKFAFPNGRNDFDYPTFFARSLVQDYRPGACFNIICNHMRFHYDEVRGLVPTNAIFITVLRDPARLFESSFHYFGPVVPLTWKLSAGDKLTEFLQDPDRYYDPNGFNAHYLRNLLFFDLGYDNSLDPSSPQVQEHILEVERRFHLVLLQEYFDESLVLLKDLLCWELEDVLYFKLNARRDSPVPRLSGELYGRATAWNMLDSHLYRHFNASFWRKVEAFGRERMAREVAALRHANERMRTICIDGGHAVDAAAIQDEAMQPWQPLGTKSILGYNLKKSIGQRHAQLCRRMLTPEIQYLMDLGANLWVTKLWKFIRDFLRW

SEQ ID NO: 6446 - protein, 398 aa, unidentified
MMSMLGGLQRYFRVILLLLLALTLLLLAGFLHSDLELDTPLFGGQAEGPPVTNIMFLKTHKTASSTVLNILYRFAETHNLSVALPAGSRVHLGYPWLFLARYVEGVGSQQRFNIMCNHLRFNLPQVQKVMPNDTFYFSILRNPVFQLESSFIYYKTYAPAFRGAPSLDAFLASPRTFYNDSRHLRNVYAKNNMWFDFGFDPNAQCEEGYVRARIAEVERRFRLVLIAEHLDESLVLLRRRLRWALDDVVAFRLNSRSARSVARLSPETRERARSWCALDWRLYEHFNRTLWAQLRAELGPRRLRGEVERLRARRRELASLCLQDGGALKNHTQIRDPRLRPYQSGKADILGYNLRPGLDNQTLGVCQRLVMPELQYMARLYALQFPEKPLKNIPFLGA

SEQ ID NO: 6447 - protein, 431 aa, unidentified
MPPILQRLQQATKMMSRRKILLLVLGCSTVSLLIHQGAQLSWYPKLFPLSCPPLRNSPPRPKHMTVAFLKTHKTAGTTVQNILFRFAERHNLTVALPHPSCEHQFCYPRNFSAHFVHPATRPPHVLASHLRFDRAELERLMPPSTVYVTILREPAAMFESLFSYYNQYCPAFRRVPNASLEAFLRAPEAYYRAGEHFAMFAHNTLAYDLGGDNERSPRDDAAYLAGLIRQVEEVFSLVMIAEYFDESLVLLRRLLAWDLDDVLYAKLNARAASSRLAAIPAALARAARTWNALDAGLYDHFNATFWRHVARAGRACVEREARELREARQRLLRRCFGDEPLLRPAAQIRTKQLQPWQPSRKVDIMGYDLPGGGAGPATEACLKLAMPEVQYSNYLLRKQKRRGGARARPEPVLDNPPPRPIRVLPRGPQGP

SEQ ID NO: 6448 - protein, 685 aa, unidentified; identical to SEQ ID NO: 1670

SEQ ID NO: 6449 - protein, 522 aa, unidentified
MAAVVAATRWWQLLLVLSAAGMGASGAPQPPNILLLLMDDMGWGDLGVYGEPSRETPNLDRMAAEGLLFPNFYSANPLCSPSRAALLTGRLPIRNGFYTTNAHARNAYTPQEIVGGIPDSEQLLPELLKKAGYVSKIVGKWHLGHRPQFHPLKHGFDEWFGSPNCHFGPYDNKARPNIPVYRDWEMVGRYYEEFPINLKTGEANLTQIYLQEALDFIKRQARHHPFFLYWAVDATHAPVYASKPFLGTSQRGRYGDAVREIDDSIGKILELLQDLHVADNTFVFFTSDNGAALISAPEQGGSNGPFLCGKQTTFEGGMREPALAWWPGHVTAGQVSHQLGSIMDLFTTSLALAGLTPPSDRAIDGLNLLPTLLQGRLMDRPIFYYRGDTLMAATLGQHKAHFWTWTNSWENFRQGIDFCPGQNVSGVTTHNLEDHTKLPLIFHLGRDPGERFPLSFASAEYQEALSRITSVVQQHQEALVPAQPQLNVCNWAVMNWAPPGCEKLGKCLTPPESIPKKCLWSH

SEQ ID NO: 6450 - protein, 603 aa, unidentified
MRRKEKRLLQAVALVLAALVLLPNVGLWALYRERQPDGTPGGSGAAVAPAAGQGSHSRQKKTFFLGDGQKLKDWHDKEAIRRDAQRVGNGEQGRPYPMTDAERVDQAYRENGFNIYVSDKISLNRSLPDIRHPNCNSKRYLETLPNTSIIIPFHNEGWSSLLRTVHSVLNRSPPELVAEIVLVDDFSDREHLKKPLEDYMALFPSVRILRTKKREGLIRTRMLGASVATGDVITFLDSHCEANVNWLPPLLDRIARNRKTIVCPMIDVIDHDDFRYETQAGDAMRGAFDWEMYYKRIPIPPELQKADPSDPFESPVMAGGLFAVDRKWFWELGGYDPGLEIWGGEQYEISFKVWMCGGRMEDIPCSRVGHIYRKYVPYKVPAGVSLARNLKRVAEVWMDEYAEYIYQRRPEYRHLSAGDVAVQKKLRSSLNCKSFKWFMTKIAWDLPKFYPPVEPPAAAWGEIRNVGTGLCADTKHGALGSPLRLEGCVRGRGEAAWNNMQVFTFTWREDIRPGDPQHTKKFCFDAISHTSPVTLYDCHSMKGNQLWKYRKDKTLYHPVSGSCMDCSESDHRIFMNTCNPSSLTQQWLFEHTNSTVLEKFNRN

SEQ ID NO: 6451 - protein, 581 aa, unidentified [sequence omitted]

SEQ ID NO: 6452 - protein, 639 aa, unidentified
MLLRKRYRHRPCRLQFLLLLLMLGCVLMMVAMLHPPHHTLHQTVTAQASKHSPEARYRLDFGESQDWVLEAEDEGEEYSPLEGLPPFISLREDQLLVAVALPQARRNQSQGRRGGSYRLIKQPRRQDKEAPKRDWGADEDGEVSEEEELTPFSLDPRGLQEALSARIPLQRALPEVRHPLCLQQHPQDSLPTASVILCFHDEAWSTLLRTVHSILDTVPRAFLKEIILVDDLSQQGQLKSALSEYVARLEGVKLLRSNKRLGAIRARMLGATRATGDVLVFMDAHCECHPGWLEPLLSRIAGDRSRVVSPVIDVIDWKTFQYYPSKDLQRGVLDWKLDFHWEPLPEHVRKALQSPISPIRSPVVPGEVVAMDRHYFQNTGAYDSLMSLRGGENLELSFKAWLCGGSVEILPCSRVGHIYQNQDSHSPLDQEATLRNRVRIAETWLGSFKETFYKHSPEAFSLSKAEKPDCMERLQLQRRLGCRTFHWFLANVYPELYPSEPRPSFSGKLHNTGLGLCADCQAEGDILGCPMVLAPCSDSRQQQYLQHTSRKEIHFGSPQHLCFAVRQEQVILQNCTEEGLAIHQQHWDFQENGMIVHILSGKCMEAVVQENNKDLYLRPCDGKARQQWRFDQINAVDER

SEQ ID NO: 6453 - protein, 571 aa, unidentified
MRRRSRMLLCFAFLWVLGIAYYMYSGGGSALAGGAGGGAGRKEDWNEIDPIKKKDLHHSNGEEKAQSMETLPPGKVRWPDFNQEAYVGGTMVRSGQDPYARNKFNQVESDKLRMDRAIPDTRHDQCQRKQWRVDLPATSVVITFHNEARSALLRTVVSVLKKSPPHLIKEIILVDDYSNDPEDGALLGKIEKVRVLRNDRREGLMRSRVRGADAAQAKVLTFLDSHCECNEHWLEPLLERVAEDRTRVVSPIIDVINMDNFQYVGASADLKGGFDWNLVFKWDYMTPEQRRSRQGNPVAPIKTPMIAGGLFVMDKFYFEELGKYDMMMDVWGGENLEISFRVWQCGGSLEIIPCSRVGHVFRKQHPYTFPGGSGTVFARNTRRAAEVWMDEYKNFYYAAVPSARNVPYGNIQSRLELRKKLSCKPFKWYLENVYPELRVPDHQDIAFGALQQGTNCLDTLGHFADGVVGVYECHNAGGNQEWALTKEKSVKHMDLCLTVVDRAPGSLIKLQGCRENDSRQKWEQIEGNSKLRHVGSNLCLDSRTAKSGGLSVEVCGPALSQQWKFTLNLQQ

SEQ ID NO: 6454 - protein, 622 aa, unidentified
MRLLRRRHMPLRLAMVGCAFVLFLFLLHRDVSSREEATEKPWLKSLVSRKDHVLDLMLEAMNNLRDSMPKLQIRAPEAQQTLFSINQSCLPGFYTPAELKPFWERPPQDPNAPGADGKAFQKSKWTPLETQEKEEGYKKHCFNAFASDRISLQRSLGPDTRPPECVDQKFRRCPPLATTSVIIVFHNEAWSTLLRTVYSVLHTTPAILLKEIILVDDASTEEHLKEKLEQYVKQLQVVRVVRQEERKGLITARLLGASVAQAEVLTFLDAHCECFHGWLEPLLARIAEDKTVVVSPDIVTIDLNTFEFAKPVQRGRVHSRGNFDWSLTFGWETLPPHEKQRRKDETYPIKSPTFAGGLFSISKSYFEHIGTYDNQMEIWGGENVEMSFRVWQCGGQLEIIPCSVVGHVFRTKSPHTFPKGTSVIARNQVRLAEVWMDSYKKIFYRRNLQAAKMAQEKSFGDISERLQLREQLHCHNFSWYLHNVYPEMFVPDLTPTFYGAIKNLGTNQCLDVGENNRGGKPLIMYSCHGLGGNQYFEYTTQRDLRHNIAKQLCLHVSKGALGLGSCHFTGKNSQVPKDEEWELAQDQLIRNSGSGTCLTSQDKKPAMAPCNPSDPHQLWLFV

SEQ ID NO: 6455 - protein, 637 aa, unidentified; identical to SEQ ID NO: 1676

SEQ ID NO: 6456 - protein, 601 aa, unidentified
MKRKQKRFLQMTLLFTVALIFLPNVGLWSLYKDKHLVKSAEPGEQQTFPLGLGDGQFYSWTDGLRRKDWHDYESIQKEAMRSGKGEHGKPYPLTEEDHDDSAYRENGFNIFVSNNIALERSLPDIRHANCKHKMYLERLPNTSIIIPFHNEGWTSLLRTIHSIINRTPGSLIAEIILVDDFSEREHLKDKLEEYMARFSKVRIVRTKKREGLIRTRLLGASMARGEVLTFLDSHCEVNVNWLPPLLNQIALNHKTIVCPMIDVIDHNHFGYEAQAGDAMRGAFDWEMYYKRIPIPPELQRADPSDPFESPVMAGGLFAVDRKWFWELGGYDPGLEIWGGEQYEISFKVWMCGGEMFDVPCSRVGHIYRKYVPYKVPSGTSLARNLKRVAETWMDEFAEYIYQRRPEYRHLSTGDISAQKELRKQLKCKDFKWFMAAVAWDVPKYYPPVEPPPAAWGEIRNVAANLCVDSKHGATGTELRLDICVKDGSERTWSHEQLFTFGWREDIRPGEPLHTRKFCFDAISHNSPVTLYDCHGMKGNQLWGYRKDRTLFHPVSNSCMDCNPAEKKIFMARCDPLSETQQWIFEHINMTVLEKFNHHANS

SEQ ID NO: 6457 - protein, 116 aa, unidentified
MAPPSVPLVLLLVLLLSLAETPASAPAHRGRGGWTLNSAGYLLGPVLHLPQMGDQDGKRETALEILDLWKAIDGLPYSHPPQPSKRNVMETFAKPEIGDLGMLSMKIPKEEDVLKS

SEQ ID NO: 6458 - protein, 944 aa, unidentified
MAAVAAVAARRRRSWASLVLAFLGVCLGITLAVDRSNFKTCEESSFCKRQRSIRPGLSPYRALLDSLQLGPDSLTVHLIHEVTKVLLVLELQGLQKNMTRFRIDELEPRRPRYRVPDVLVADPPIARLSVSGRDENSVELTMAEGPYKIILTARPFRLDLLEDRSLLLSVNARGLLEFEHQRAPRVSQGSKDPAEGDGAQPEETPRDGDKPEETQGKAEKDEPGAWEETFKTHSDSKPYGPMSVGLDFSLPGMEHVYGIPEHADNLRLKVTEGGEPYRLYNLDVFQYELYNPMALYGSVPVLLAHNPHRDLGIFWLNAAETWVDISSNTAGKTLFGKMMDYLQGSGETPQTDVRWMSETGIIDVFLLLGPSISDVFRQYASLTGTQALPPLFSLGYHQSRWNYRDEADVLEVDQGFDDHNLPCDVIWLDIEHADGKRYFTWDPSRFPQPRTMLERLASKRRKLVAIVDPHIKVDSGYRVHEELRNLGLYVKTRDGSDYEGWCWPGSAGYPDFTNPTMRAWWANMFSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFSGNTLVSSSADPEGHFETPIWIERVVIIGAGKPAAVVLQTKGSPESRLSFQHDPETSVLVLRKPGINVASDWSIHLR

SEQ ID NO: 6459 - protein, 739 aa, unidentified
MPSPRPVLLRGARAALLLLLPPRLLARPSLLLRRSLSAASCPPISLPAAASRSSMDGAGAEEVLAPLRLAVRQQGDLVRKLKEDKAPQVDVDKAVAELKARKRVLEAKELALQPKDDIVDRAKMEDTLKRRFFYDQAFAIYGGVSGLYDFGPVGCALKNNIIQTWRQHFIQEEQILEIDCTMLTPEPVLKTSGHVDKFADFMVKDVKNGECFRADHLLKAHLQKLMSDKKCSVEKKSEMESVLAQLDNYGQQELADLFVNYNVKSPITGNDLSPPVSFNLMFKTFIGPGGNMPGYLRPETAQGIFLNFKRLLEFNQGKLPFAAAQIGNSFRNEISPRSGLIRVREFTMAEIEHFVDPSEKDHPKFQNVADLHLYLYSAKAQVSGQSARKMRLGDAVEQGVINNTVLGYFIGRIYLYLTKVGISPDKLRFRQHMENEMAHYACDCWDAESKTSYGWIEIVGCADRSCYDLSCHARATKVPLVAEKPLKEPKTVNVVQFEPSKGAIGKAYKKDAKLVMEYLAICDECYITEMEMLLNEKGEFTIETEGKTFQLTKDMINVKRFQKTLYVEEVVPNVIEPSFGLGRIMYTVFEHTFHVREGDEQRTFFSFPAVVAPFKCSVLPLSQNQEFMPFVKELSEALTRHGVSHKVDDSSGSIGRRYARTDEIGVAFGVTIDFDTVNKTPHTATLRDRDSMRQIRAEISELPSIVQDLANGNITWADVEARYPLFEGQETGKKETIEE

SEQ ID NO: 6460 - protein, 345 aa, unidentified
MVAALLGGGGEARGGTVPGAWLCLMALLQLLGSAPRGSGLAHGRRLICWQALLQCQGEPECSYAYNQYAEACAPVLAQHGGGDAPGAAAAAFPASAASFSSRWRCPSHCISALIQLNHTRRGPALEDCDCAQDENCKSTKRAIEPCLPRTSGGGAGGPGAGGVMGCTEARRRCDRDSRCNLALSRYLTYCGKVFNGLRCTDECRTVIEDMLAMPKAALLNDCVCDGLERPICESVKENMARLCFGAELGNGPGSSGSDGGLDDYYDEDYDDEQRTGGAGGEQPLDDDDGVPHPPRPGSGAAASGGRGDLPYGPGRRSSGGGGRLAPRGAWTPLASILLLLLGPLF

SEQ ID NO: 6461 - protein, 678 aa, unidentified
MAPSLSPGPAALRRAPQLLLLLLAAECALAALLPAREATQFLRPRQRRAFQVFEEAKQGHLERECVEELCSREEAREVFENDPETDYFYPRYLDCINKYGSPYTKNSGFATCVQNLPDQCTPNPCDRKGTQACQDLMGNFFCLCKAGWGGRLCDKDVNECSQENGGCLQICHNKPGSFHCSCHSGFELSSDGRTCQDIDECADSEACGEARCKNLPGSYSCLCDEGFAYSSQEKACRDVDECLQGRCEQVCVNSPGSYTCHCDGRGGLKLSQDMDTCEDILPCVPFSVAKSVKSLYLGRMFSGTPVIRLRFKRLQPTRLVAEFDFRTFDPEGILLFAGGHQDSTWIVLALRAGRLELQLRYNGVGRVTSSGPVINHGMWQTISVEELARNLVIKVNRDAVMKIAVAGDLFQPERGLYHLNLTVGGIPFHEKDLVQPINPRLDGCMRSWNWLNGEDTTIQETVKVNTRMQCFSVTERGSFYPGSGFAFYSLDYMRTPLDVGTESTWEVEVVAHIRPAADTGVLFALWAPDLRAVPLSVALVDYHSTKKLKKQLVVLAVEHTALALMEIKVCDGQEHVVTVSLRDGEATLEVDGTRGQSEVSAAQLQERLAVLERHLRSPVLTFAGGLPDVPVTSAPVTAFYRGCMTLEVNRRLLDLDEAAYKHSDITAHSCPPVEPAAA

SEQ ID NO: 6462 - protein, 101 aa, unidentified
MQRLCVYVLIFALALAAFSEASWKPRSQQPDAPLGTGANRDLELPWLEQQGPASHHRRQLGPQGPPHLVADPSKKQGPWLEEEEEAYGWMDFGRRSAEDEN

SEQ ID NO: 6463 - protein, 536 aa, unidentified
MEFSSPSREECPKPLSRVSIMAGSLTGLLLLQAVSWASGARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWRRQ

SEQ ID NO: 6464 - protein, 347 aa, unidentified
MHRRRLALGLGFCLLAGTSLSVLWVYLENWLPVSYVPYYLPCPEIFNMKLHYKREKPLQPVVWSQYPQPKLLEHRPTQLLTLTPWLAPIVSEGTFNPELLQHIYQPLNLTIGVTVFAVGKYTHFIQSFLESAEEFFMRGYRVHYYIFTDNPAAVPGVPLGPHRLLSSIPIQGHSHWEETSMRRMETISQHIAKRAHREVDYLFCLDVDMVFRNPWGPETLGDLVAAIHPSYYAVPRQQFPYERRRVSTAFVADSEGDFYYGGAVFGGQVARVYEFTRGCHMAILADKANGIMAAWREESHLNRHFISNKPSKVLSPEYLWDDRKPQPPSLKLIRFSTLDKDISCLRS

SEQ ID NO: 6465 - protein, 474 aa, unidentified
MKRVLVLLLAVAFGHALERGRDYEKNKVCKEFSHLGKEDFTSLSLVLYSRKFPSGTFEQVSQLVKEVVSLTEACCAEGADPDCYDTRTSALSAKSCESNSPFPVHPGTAECCTKEGLERKLCMAALKHQPQEFPTYVEPTNDEICEAFRKDPKEYANQFMWEYSTNYGQAPLSLLVSYTKSYLSMVGSCCTSASPTVCFLKERLQLKHLSLLTTLSNRVCSQYAAYGEKKSRLSNLIKLAQKVPTADLEDVLPLAEDITNILSKCCESASEDCMAKELPEHTVKLCDNLSTKNSKFEDCCQEKTAMDVFVCTYFMPAAQLPELPDVELPTNKDVCDPGNTKVMDKYTFELSRRTHLPEVFLSKVLEPTLKSLGECCDVEDSTTCFNAKGPLLKKELSSFIDKGQELCADYSENTFTEYKKKLAERLKAKLPDATPTELAKLVNKHSDFASNCCSINSPPLYCDSEIDAELKNIL

SEQ ID NO: 6466 - protein, 180 aa, unidentified
MKSIYFVAGLFVMLVQGSWQRSLQDTEEKSRSFSASQADPLSDPDQMNEDKRHSQGTFTSDYSKYLDSRRAQDFVQWLMNTKRNRNNIAKRHDEFERHAEGTFTSDVSSYLEGQAAKEFIAWLVKGRGRRDFPEEVAIVEELGRRHADGSFSDEMNTILDNLAARDFINWLIQTKITDRK

SEQ ID NO: 6467 - protein, 477 aa, unidentified; identical to SEQ ID NO: 1682

SEQ ID NO: 6468 - protein, 430 aa, unidentified
MSQLRATKSGLVVRAVICIFIFLYLRNPTPAESEEEPAQPEVVECGFYPDELCSALFEGKGAAPQIAKFCKTPHKSEIHAHLHTPGNCSRISRGLHFITRPLSAEEGDFSLAYIITIHKELAMFVQLLRAIYVPQNVYCIHVDEKAPMKYKTAVQTLVNCFENVFISSKTEKVAYAGFTRLQADINCMKVLVHSKFQWNYVINLCGQDFPIKTNREIIHYIRSKWSDKNITPGVIQPLHIKSKTSQSHLEFVPKGSIYAPPNNRFKDKPPHNLTIYFGSAYYVLTRKFVEFILTDIHAKDMLQWSKDIRSPEQHYWVTLNRLKDAPGATPNAGWEGNVRAIKRKSEEGNVHDGCKGRYVEDICVYGPGDLPWLIQSPSLFANKFEPSTDPLVVTCLERRHRLQVLRQAEVPIEPHWHFQQQSHFNMRLNR

SEQ ID NO: 6469 - protein, 173 aa, unidentified
MALRVVRSVRALLCTLRAVPSPAAPCPPRPWQLGVGAVRTLRTGPALLSVRKFTEKHEWVTTENGIGTVGISNFAQEALGDVVYCSLPEVGTKLNKQDEFGALESVKAASELYSPLSGEVTEINEALAENPGLVNKSCYEDGWLIKMTLSNPSELDELMSEEAYEKYIKSIEE

SEQ ID NO: 6470 - protein, 372 aa, unidentified
MPPPQQGPCGHHLLLLLALLLPSLPLTRAPVPPGPAAALLQALGLRDEPQGAPRLRPVPPVMWRLFRRRDPQETRSGSRRTSPGVTLQPCHVEELGVAGNIVRHIPDRGAPTRASEPASAAGHCPEWTVVFDLSAVEPAERPSRARLELRFAAAAAAAPEGGWELSVAQAGQGAGADPGPVLLRQLVPALGPPVRAELLGAAWARNASWPRSLRLALALRPRAPAACARLAEASLLLVTLDPRLCHPLARPRRDAEPVLGGGPGGACRARRLYVSFREVGWHRWVIAPRGFLANYCQGQCALPVALSGSGGPPALNHAVLRALMHAAAPGAADLPCCVPARLSPISVLFFDNSDNVVLRQYEDMVVDECGCR

SEQ ID NO: 6471 - protein, 478 aa, unidentified
MAHVPARTSPGPGPQLLLLLLPLFLLLLRDVAGSHRAPAWSALPAAADGLQGDRDLQRHPGDAAATLGPSAQDMVAVHMHRLYEKYSRQGARPGGGNTVRSFRARLEVVDQKAVYFFNLTSMQDSEMILTATFHFYSEPPRWPRALEVLCKPRAKNASGRPLPLGPPTRQHLLFRSLSQNTATQGLLRGAMALAPPPRGLWQAKDISPIVKAARRDGELLLSAQLDSEERDPGVPRPSPYAPYILVYANDLAISEPNSVAVTLQRYDPFPAGDPEPRAAPNNSADPRVRRAAQATGPLQDNELPGLDERPPRAHAQHFHKHQLWPSPFRALKPRPGRKDRRKKGQEVFMAASQVLDFDEKTMQKARRKQWDEPRVCSRRYLKVDFADIGWNEWIISPKSFDAYYCAGACEFPMPKIVRPSNHATIQSIVRAVGIIPGIPEPCCVPDKMNSLGVLFLDENRNVVLKVYPNMSVDTCACR

SEQ ID NO: 6472 - protein, 407 aa, unidentified
MVLAAPLLLGFLLLALELRPRGEAAEGPAAAAAAAAAAAAAGVGGERSSRPAPSVAPEPDGCPVCVWRQHSRELRLESIKSQILSKLRLKEAPNISREVVKQLLPKAPPLQQILDLHDFQGDALQPEDFLEEDEYHATTETVISMAQETDPAVQTDGSPLCCHFHFSPKVMFTKVLKAQLWVYLRPVPRPATVYLQILRLKPLTGEGTAGGGGGGRRHIRIRSLKIELHSRSGHWQSIDFKQVLHSWFRQPQSNWGIEINAFDPSGTDLAVTSLGPGAEGLHPFMELRVLENTKRSRRNLGLDCDEHSSESRCCRYPLTVDFEAFGWDWIIAPKRYKANYCSGQCEYMFMQKYPHTHLVQQANPRGSAGPCCTPTKMSPINMLYFNDKQQIIYGKIPGMVVDRCGCS

SEQ ID NO: 6473 - protein, 308 aa, unidentified
MPGQELRTVNGSQMLLVLLVLSWLPHGGALSLAEASRASFPGPSELHSEDSRFRELRKRYEDLLTRLRANQSWEDSNTDLVPAPAVRILTPEVRLGSGGHLHLRISRAALPEGLPEASRLHRALFRLSPTASRSWDVTRPLRRQLSLARPQAPALHLRLSPPPSQSDQLLAESSSARPQLELHLRPQAARGRRRARARNGDHCPLGPGRCCRLHTVRASLEDLGWADWVLSPREVQVTMCIGACPSQFRAANMHAQIKTSLHRLKPDTVPAPCCVPASYNPMVLIQKTDTGVSLQTYDDLLAKDCHCI

SEQ ID NO: 6474 - protein, 429 aa, unidentified
MCPGALWVALPLLSLLAGSLQGKPLQSWGRGSAGGNAHSPLGVPGGGLPEHTFNLKMFLENVKVDFLRSLNLSGVPSQDKTRVEPPQYMIDLYNRYTSDKSTTPASNIVRSFSMEDAISITATEDFPFQKHILLFNISIPRHEQITRAELRLYVSCQNHVDPSHDLKGSVVIYDVLDGTDAWDSATETKTFLVSQDIQDEGWETLEVSSAVKRWVRSDSTKSKNKLEVTVESHRKGCDTLDISVPPGSRNLPFFVVFSNDHSSGTKETRLELREMISHEQESVLKKLSKDGSTEAGESSHEEDTDGHVAAGSTLARRKRSAGAGSHCQKTSLRVNFEDIGWDSWIIAPKEYEAYECKGGCFFPLADDVTPTKHAIVQTLVHLKFPTKVGKACCVPTKLSPISVLYKDDMGVPTLKYHYEGMSVAECGCR

SEQ ID NO: 6475 - protein, 364 aa, unidentified
MLRFLPDLAFSFLLILALGQAVQFQEYVFLQFLGLDKAPSPQKFQPVPYILKKIFQDREAAATTGVSRDLCYVKELGVRGNVLRFLPDQGFFLYPKKISQASSCLQKLLYFNLSAIKEREQLTLAQLGLDLGPNSYYNLGPELELALFLVQEPHVWGQTTPKPGKMFVLRSVPWPQGAVHFNLLDVAKDWNDNPRKNFGLFLEILVKEDRDSGVNFQPEDTCARLRCSLHASLLVVTLNPDQCHPSRKRRAAIPVPKLSCKNLCHRHQLFINFRDLGWHKWIIAPKGFMANYCHGECPFSLTISLNSSNYAFMQALMHAVDPEIPQAVCIPTKLSPISMLYQDNNDNVILRHYEDMVVDECGCG

SEQ ID NO: 6476 - protein, 501 aa, unidentified
MRLPKLLTFLLWYLAWLDLEFICTVLGAPDLGQRPQGTRPGLAKAEAKERPPLARNVFRPGGHSYGGGATNANARAKGGTGQTGGLTQPKKDEPKKLPPRPGGPEPKPGHPPQTRQATARTVTPKGQLPGGKAPPKAGSVPSSFLLKKAREPGPPREPKEPFRPPPITPHEYMLSLYRTLSDADRKGGNSSVKLEAGLANTITSFIDKGQDDRGPVVRKQRYVFDISALEKDGLLGAELRILRKKPSDTAKPAAPGGGRAAQLKLSSCPSGRQPASLLDVRSVPGLDGSGWEVFDIWKLFRNFKNSAQLCLELEAWERGRAVDLRGLGFDRAARQVHEKALFLVFGRTKKRDLFFNEIKARSGQDDKTVYEYLFSQRRKRRAPLATRQGKRPSKNLKARCSRKALHVNFKDMGWDDWIIAPLEYEAFHCEGLCEFPLRSHLEPTNHAVIQTLMNSMDPESTPPTCCVPTRLSPISILFIDSANNVVYKQYEDMVVESCGCR

SEQ ID NO: 6477 - protein, 455 aa, unidentified
MDTPRVLLSAVFLISFLWDLPGFQQASISSSSSSAELGSTKGMRSRKEGKMQRAPRDSDAGREGQEPQPRPQDEPRAQQPRAQEPPGRGPRVVPHEYMLSIYRTYSIAEKLGINASFFQSSKSANTITSFVDRGLDDLSHTPLRRQKYLFDVSMLSDKEELVGAELRLFRQAPSAPWGPPAGPLHVQLFPCLSPLLLDARTLDPQGAPPAGWEVFDVWQGLRHQPWKQLCLELRAAWGELDAGEAEARARGPQQPPPPDLRSLGFGRRVRPPQERALLVVFTRSQRKNLFAEMREQLGSAEAAGPGAGAEGSWPPPSGAPDARPWLPSPGRRRRRTAFASRHGKRHGKKSRLRCSKKPLHVNFKELGWDDWIIAPLEYEAYHCEGVCDFPLRSHLEPTNHAIIQTLMNSMDPGSTPPSCCVPTKLTPISILYIDAGNNVVYKQYEDMVVESCGCR

SEQ ID NO: 6478 - protein, 450 aa, unidentified
MDLSAAAALCLWLLSACRPRDGLEAAAVLRAAGAGPVRSPGGGGGGGGGGRTLAQAAGAAAVPAAAVPRARAARRAAGSGFRNGSVVPHHFMMSLYRSLAGRAPAGAAAVSASGHGRADTITGFTDQATQDESAAETGQSFLFDVSSLNDADEVVGAELRVLRRGSPESGPGSWTSPPLLLLSTCPGAARAPRLLYSRAAEPLVGQRWEAFDVADAMRRHRREPRPPRAFCLLLRAVAGPVPSPLALRRLGFGWPGGGGSAAEERAVLVVSSRTQRKESLFREIRAQARALGAALASEPLPDPGTGTASPRAVIGGRRRRRTALAGTRTAQGSGGGAGRGHGRRGRSRCSRKPLHVDFKELGWDDWIIAPLDYEAYHCEGLCDFPLRSHLEPTNHAIIQTLLNSMAPDAAPASCCVPARLSPISILYIDAANNVVYKQYEDMVVEACGCR

SEQ ID NO: 6479 - protein, 454 aa, unidentified
MARPNKFLLWFCCFAWLCFPISLGSQASGGEAQIAASAELESGAMPWSLLQHIDERDRAGLLPALFKVLSVGRGGSPRLQPDSRALHYMKKLYKTYATKEGIPKSNRSHLYNTVRLFTPCTRHKQAPGDQVTGILPSVELLFNLDRITTVEHLLKSVLLYNINNSVSFSSAVKCVCNLMIKEPKSSSRTLGRAPYSFTFNSQFEFGKKHKWIQIDVTSLLQPLVASNKRSIHMSINFTCMKDQLEHPSAQNGLFNMTLVSPSLILYLNDTSAQAYHSWYSLHYKRRPSQGPDQERSLSAYPVGEEAAEDGRSSHHRHRRGQETVSSELKKPLGPASFNLSEYFRQFLLPQNECELHDFRLSFSQLKWDNWIVAPHRYNPRYCKGDCPRAVGHRYGSPVHTMVQNIIYEKLDSSVPRPSCVPAKYSPLSVLTIEPDGSIAYKEYEDMIATKCTCR

SEQ ID NO: 6480 - protein, 211 aa, unidentified
MKLWDVVAVCLVLLHTASAFPLPAGKRPPEAPAEDRSLGRRRAPFALSSDSNMPEDYPDQFDDVMDFIQATIKRLKRSPDKQMAVLPRRERNRQAAAANPENSRGKGRRGQRGKNRGCVLTAIHLNVTDLGLGYETKEELIFRYCSGSCDAAETTYDKILKNLSRNRRLVSDKVGQACCRPIAFDDDLSFLDDNLVYHILRKHSAKRCGCI

SEQ ID NO: 6481 - protein, 385 aa, unidentified
MKMLPGVGVFGTGSSARVLVPLLRAEGFTVEALWGKTEEEAKQLAEEMNIAFYTSRTDDILLHQDVDLVCISIPPPLTRQISVKALGIGKNVVCEKAATSVDAFRMVTASRYYPQLMSLVGNVLRFLPAFVRMKQLISEHYVGAVMICDARIYSGSLLSPSYGWICDELMGGGGLHTMGTYIVDLLTHLTGRRAEKVHGLLKTFVRQNAAIRGIRHVTSDDFCFFQMLMGGGVCSTVTLNFNMPGAFVHEVMVVGSAGRLVARGADLYGQKNSATQEELLLRDSLAVGAGLPEQGPQDVPLLYLKGMVYMVQALRQSFQGQGDRRTWDRTPVSMAASFEDGLYMQSVVDAIKRSSRSGEWEAVEVLTEEPDTNQNLCEALQRNNL

SEQ ID NO: 6482 - protein, 682 aa, unidentified; identical to SEQ ID NO: 1695

SEQ ID NO: 6483 - protein, 464 aa, unidentified
MILANVFCLFFFLDETLRSLASPSSLQGPELHGWRPPVDCVRANELCAAESNCSSRYRTLRQCLAGRDRNTMLANKECQAALEVLQESPLYDCRCKRGMKKELQCLQIYWSIHLGLTEGEEFYEASPYEPVTSRLSDIFRLASIFSGTGADPVVSAKSNHCLDAAKACNLNDNCKKLRSSYISICNREISPTERCNRRKCHKALRQFFDRVPSEYTYRMLFCSCQDQACAERRRQTILPSCSYEDKEKPNCLDLRGVCRTDHLCRSRLADFHANCRASYQTVTSCPADNYQACLGSYAGMIGFDMTPNYVDSSPTGIVVSPWCSCRGSGNMEEECEKFLRDFTENPCLRNAIQAFGNGTDVNVSPKGPSFQATQAPRVEKTPSLPDDLSDSTSLGTSVITTCTSVQEQGLKANNSKELSMCFTELTTNIIPGSNKVIKPNSGPSRARPSAALTVLSVLMLKLAL

SEQ ID NO: 6484 - protein, 299 aa, unidentified
MVRCLGPALLLLLLLGSASSVGGNRCVDAAEACTADARCQRLRSEYVAQCLGRAAQGGCPRARCRRALRRFFARGPPALTHALLFCPCAGPACAERRRQTFVPSCAFSGPGPAPPSCLEPLNFCERSRVCRCARAAAGPWRGWGRGLSPAHRPPAAQASPPGLSGLVHPSAQRPRRLPAGPGRPLPARLRGPRGVPAGTAVTPNYVDNVSARVAPWCDCGASGNRREDCEAFRGLFTRNRCLDGAIQAFASGWPPVLLDQLNPQGDPEHSLLQVSSTGRALERRSLLSILPVLALPALL

SEQ ID NO: 6485 - protein, 613 aa, unidentified
MAATAVAAAVAGTESAQGPPGPAASLELWLNKATDPSMSEQDWSAIQNFCEQVNTDPNGPTHAPWLLAHKIQSPQEKEALYALTVLEMCMNHCGEKFHSEVAKFRFLNELIKVLSPKYLGSWATGKVKGRVIEILFSWTVWFPEDIKIRDAYQMLKKQGIIKQDPKLPVDKILPPPSPWPKSSIFDADEEKSKLLTRLLKSNHPEDLQAANRLIKNLVKEEQEKSEKVSKRVSAVEEVRSHVKVLQEMLSMYRRPGQAPPDQEALQVVYERCEKLRPTLFRLASDTTDDDDALAEILQANDLLTQGVLLYKQVMEGRVTFGNRVTSSLGDIPVSRVFQNPAGCMKTCPLIDLEVDNGPAQMGTVVPSLLHQDLAALGISDAPVTGMVSGQNCCEEKRNPSSSTLPGGGVQNPSADRNLLDLLSAQPAPCPLNYVSQKSVPKEVPPGTKSSPGWSWEAGPLAPSPSSQNTPLAQVFVPLESVKPSSLPPLIVYDRNGFRILLHFSQTGAPGHPEVQVLLLTMMSTAPQPVWDIMFQVAVPKSMRVKLQPASSSKLPAFSPLMPPAVISQMLLLDNPHKEPIRLRYKLTFNQGGQPFSEVGEVKDFPDLAVLGAA

SEQ ID NO: 6486 - protein, 318 aa, unidentified
MASPGCLLCVLGLLLCGAASLELSRPHGDTAKKPIIGILMQKCRNKVMKNYGRYYIAASYVKYLESAGARVVPVRLDLTEKDYEILFKSINGILFPGGSVDLRRSDYAKVAKIFYNLSIQSFDDGDYFPVWGTCLGFEELSLLISGECLLTATDTVDVAMPLNFTGGQLHSRMFQNFPTELLLSLAVEPLTANFHKWSLSVKNFTMNEKLKKFFNVLTTNTDGKIEFISTMEGYKYPVYGVQWHPEKAPYEWKNLDGISHAPNAVKTAFYLAEFFVNEARKNNHHFKSESEEEKALIYQFSPIYTGNISSFQQCYIFD

SEQ ID NO: 6487 - protein, 569 aa, unidentified; identical to SEQ ID NO: 1700

SEQ ID NO: 6488 - protein, 586 aa, unidentified
MARGYGATVSLVLLGLGLALAVIVLAVVLSRHQAPCGPQAFAHAAVAADSKVCSDIGRAILQQQGSPVDATIAALVCTSVVNPQSMGLGGGVIFTIYNVTTGKVEVINARETVPASHAPSLLDQCAQALPLGTGAQWIGVPGELRGYAEAHRRHGRLPWAQLFQPTIALLRGGHVVAPVLSRFLHNSILRPSLQASTLRQLFFNGTEPLRPQDPLPWPALATTLETVATEGVEVFYTGRLGQMLVEDIAKEGSQLTLQDLAKFQPEVVDALEVPLGDYTLYSPPPPAGGAILSFILNVLRGFNFSTESMARPEGRVNVYHHLVETLKFAKGQRWRLGDPRSHPKLQNASRDLLGETLAQLIRQQIDGRGDHQLSHYSLAEAWGHGTGTSHVSVLGEDGSAVAATSTINTPFGAMVYSPRTGIILNNELLDLCERCPRGSGTTPSPVSGDRVGGAPGRCWPPVPGERSPSSMVPSILINKAQGSKLVIGGAGGELIISAVAQAIMSKLWLGFDLRAAIAAPILHVNSKGCVEYEPNFSQEVQRGLQDRGQNQTQRPFFLNVVQAVSQEGACVYAVSDLRKSGEAAGY

SEQ ID NO: 6489 - protein, 122 aa, unidentified
MATGSRTSLLLAFGLLCLPWLQEGSAFPTIPLSRLFDNAMLRAHRLHQLAFDTYQEFRLEDGSPRTGQIFKQTYSKFDTNSHNDDALLKNYGLLYCFRKDMDKVETFLRIVQCRSVEGSCGF

SEQ ID NO: 6490 - protein, 217 aa, unidentified
MAAGSRTSLLLAFGLLCLSWLQEGSAFPTIPLSRLFDNAMLRARRLYQLAYDTYQEFEEAYILKEQKYSFLQNPQTSLCFSESIPTPSNRVKTQQKSNLELLRISLLLIQSWLEPVQLLRSVFANSLVYGASDSNVYRHLKDLEEGIQTLMWRLEDGSPRTGQIFNQSYSKFDTKSHNDDALLKNYGLLYCFRKDMDKVETFLRIVQCRSVEGSCGF

SEQ ID NO: 6491 - protein, 530 aa, unidentified
MLLWPLLLLLLLLPTLALLRQQRSQDARLSWLAGLQHRVAWGALVWAATWQRRRLEQSTLHVHQSQQQALRWCLQGAQRPHCSLRRSTDISTFRNHLPLTKASQTQQEDSGEQPLPPTSNQDLGEASLQATLLGLAALNKAYPEVLAQGRTARVTLTSPWPRPLPWPGNTLGQVGTPGTKDPRALLLDALRSPGLRALEAGTAVELLDVFLGLETDGEELAGAIAAGNPGAPLRERAAELREALEQGPRGLALRLWPKLQVVVTLDAGGQAEAVAALGALWCQGLAFFSPAYAASGGVLGLNLQPEQPHGLYLLPPGAPFIELLPVKEGTQEEAASTLLLAEAQQGKEYELVLTDRASLTRCRLGDVVRVVGAYNQCPVVRFICRLDQTLSVRGEDIGEDLFSEALGRAVGQWAGAKLLDHGCVESSILDSSAGSAPHYEVFVALRGLRNLSEENRDKLDHCLQEASPRYKSLRFWGSVGPARVHLVGQGAFRALRAALAACPSSPFPPAMPRVLRHRHLAQCLQERVVS

SEQ ID NO: 6492 - protein, 108 aa, unidentified
MPLWVFFFVILTLSNSSHCSPPPPLTLRMRRYADAIFTNSYRKVLGQLSARKLLQDIMSRQQGESNQERGARARLGRQVDSMWAEQKQMELESILVALLQKHSRNSQG

SEQ ID NO: 6493 - protein, 423 aa, unidentified; identical to SEQ ID NO: 1705

SEQ ID NO: 6494 - protein, 117 aa, unidentified
MPSPGTVCSLLLLGMLWLDLAMAGSSFLSPEHQRVQQRKESKKPPAKLQPRALAGWLRPEDGGQAEGAEDELEVRFNAPFDVGIKLSGVQYQQHSQALGKFLQDILWEEAKEAPADK

SEQ ID NO: 6495 - protein, 417 aa, unidentified
MAWFALYLLSLLWATAGTSTQTQSSCSVPSAQEPLVNGIQVLMENSVTSSAYPNPSILIAMNLAGAYNLKAQKLLTYQLMSSDNNDLTIGQLGLTIMALTSSCRDPGDKVSILQRQMENWAPSSPNAEASAFYGPSLAILALCQKNSEATLPIAVRFAKTLLANSSPFNVDTGAMATLALTCMYNKIPVGSEEGYRSLFGQVLKDIVEKISMKIKDNGIIGDIYSTGLAMQALSVTPEPSKKEWNCKKTTDMILNEIKQGKFHNPMSIAQILPSLKGKTYLDVPQVTCSPDHEVQPTLPSNPGPGPTSASNITVIYTINNQLRGVELLFNETINVSVKSGSVLLVVLEEAQRKNPMFKFETTMTSWGLVVSSINNIAENVNHKTYWQFLSGVTPLNEGVADYIPFNHEHITANFTQY

SEQ ID NO: 6496 - protein, 153 aa, unidentified
MVATKTFALLLLSLFLAVGLGEKKEGHFSALPSLPVGSHAKVSSPQPRGPRYAEGTFISDYSIAMDKIHQQDFVNWLLAQKGKKNDWKHNITQREARALELASQANRKEEEAVEPQSSPAKNPSDEDLLRDLLIQELLACLLDQTNLCRLRSR

SEQ ID NO: 6497 - protein, 199 aa, unidentified
MLAYSSVHCFREDKMKFTIVFAGLLGVFLAPALANYNINVNDDNNNAGSGQQSVSVNNEHNVANVDNNNGWDSWNSIWDYGNGFAATRLFQKKTCIVHKMNKEVMPSIQSLDALVKEKKLQGKGPGGPPPKGLMYSVNPNKVDDLSKFGKNIANMCRGIPTYMAEEMQEASLFFYSGTCYTTSVLWIVDISFCGDTVEN

SEQ ID NO: 6498 - protein, 184 aa, unidentified
MKILVAFLVVLTIFGIQSHGYEVFNIISPSNNGGNVQETVTIDNEKNTAIINIHAGSCSSTTIFDYKHGYIASRVLSRRACFILKMDHQNIPPLNNLQWYIYEKQALDNMFSSKYTWVKYNPLESLIKDVDWFLLGSPIEKLCKHIPLYKGEVVENTHNVGAGGCAKAGLLGILGISICADIHV

SEQ ID NO: 6499 - protein, 429 aa, unidentified
MQLRNPELHLGCALALRFLALVSWDIPGARALDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 6500 - protein, 677 aa, unidentified
MPGFLVRILPLLLVLLLLGPTRGLRNATQRMFEIDYSRDSFLKDGQPFRYISGSIHYSRVPRFYWKDRLLKMKMAGLNAIQTYVPWNFHEPWPGQYQFSEDHDVEYFLRLAHELGLLVILRPGPYICAEWEMGGLPAWLLEKESILLRSSDPDYLAAVDKWLGVLLPKMKPLLYQNGGPVITVQVENEYGSYFACDFDYLRFLQKRFRHHLGDDVVLFTTDGAHKTFLKCGALQGLYTTVDFGTGSNITDAFLSQRKCEPKGPLINSEFYTGWLDHWGQPHSTIKTEAVASSLYDILARGASVNLYMFIGGTNFAYWNGANSPYAAQPTSYDYDAPLSEAGDLTEKYFALRNIIQKFEKVPEGPIPPSTPKFAYGKVTLEKLKTVGAALDILCPSGPIKSLYPLTFIQVKQHYGFVLYRTTLPQDCSNPAPLSSPLNGVHDRAYVAVDGIPQGVLERNNVITLNITGKAGATLDLLVENMGRVNYGAYINDFKGLVSNLTLSSNILTDWTIFPLDTEDAVRSHLGGWGHRDSGHHDEAWAHNSSNYTLPAFYMGNFSIPSGIPDLPQDTFIQFPGWTKGQVWINGFNLGRYWPARGPQLTLFVPQHILMTSAPNTITVLELEWAPCSSDDPELCAVTFVDRPVIGSSVTYDHPSKPVEKRLMPPPPQKNKDSWLDHV

SEQ ID NO: 6501 - protein, 654 aa, unidentified
MAPKKLSCLRSLLLPLSLTLLLPQADTRSFVVDRGHDRFLLDGAPFRYVSGSLHYFRVPRVLWADRLLKMRWSGLNAIQFYVPWNYHEPQPGVYNFNGSRDLIAFLNEAALANLLVILRPGPYICAEWEMGGLPSWLLRKPEIHLRTSDPDFLAAVDSWFKVLLPKIYPWLYHNGGNIISIQVENEYGSYRACDFSYMRHLAGLFRALLGEKILLFTTDGPEGLKCGSLRGLYTTVDFGPADNMTKIFTLLRKYEPHGPLVNSEYYTGWLDYWGQNHSTRSVSAVTKGLENMLKLGASVNMYMFHGGTNFGYWNGADKKGRFLPITTSYDYDAPISEAGDPTPKLFALRDVISKFQEVPLGPLPPPSPKMMLGPVTLHLVGHLLAFLDLLCPRGPIHSILPMTFEAVKQDHGFMLYRTYMTHTIFEPTPFWVPNNGVHDRAYVMVDGVFQGVVERNMRDKLFLTGKLGSKLDILVENMGRLSFGSNSSDFKGLLKPPILGQTILTQWMMFPLKIDNLVKWWFPLQLPKWPYPQAPSGPTFYSKTFPILGSVGDTFLYLPGWTKGQVWINGFNLGRYWTKQGPQQTLYVPRFLLFPRGALNKITLLELEDVPLQPQVQFLDKPILNSTSTLHRTHINSLSADTLSASEPMELSGH

SEQ ID NO: 6502 - protein, 636 aa, unidentified
MTTWSLRRRPARTLGLLLLVVLGFLVLRRLDWSTLVPLRLRHRQLGLQAKGWNFMLEDSTFWIFGGSIHYFRVPREYWRDRLLKMKACGLNTLTTYVPWNLHEPERGKFDFSGNLDLEAFVLMAAEIGLWVILRPGPYICSEMDLGGLPSWLLQDPGMRLRTTYKGFTEAVDLYFDHLMSRVVPLQYKRGGPIIAVQVENEYGSYNKDPAYMPYVKKALEDRGIVELLLTSDNKDGLSKGIVQGVLATINLQSTHELQLLTTFLFNVQGTQPKMVMEYWTGWFDSWGGPHNILDSSEVLKTVSAIVDAGSSINLYMFHGGTNFGFMNGAMHFHDYKSDVTSYDYDAVLTEAGDYTAKYMKLRDFFGSISGIPLPPPPDLLPKMPYEPLTPVLYLSLWDALKYLGEPIKSEKPINMENLPVNGGNGQSFGYILYETSITSSGILSGHVHDRGQVFVNTVSIGFLDYKTTKIAVPLIQGYTVLRILVENRGRVNYGENIDDQRKGLIGNLYLNDSPLKNFRIYSLDMKKSFFQRFGLDKWSSLPETPTLPAFFLGSLSISSTPCDTFLKLEGWEKGVVFINGQNLGRYWNIGPQKTLYLPGPWLSSGINQVIVFEETMAGPALQFTETPHLGRNQYIK

SEQ ID NO: 6503 - protein, 617 aa, unidentified
MRCLAARVNYKTLIIICALFTLVTVLLWNKCSSDKAIQFPRRSSSGFRVDGFEKRAAASESNNYMNHVAKQQSEEAFPQEQQKAPPVVGGFNSNVGSKVLGLKYEEIDCLINDEHTIKGRREGNEVFLPFTWVEKYFDVYGKVVQYDGYDRFEFSHSYSKVYAQRAPYHPDGVFMSFEGYNVEVRDRVKCISGVEGVPLSTQWGPQGYFYPIQIAQYGLSHYSKNLTEKPPHIEVYETAEDRDKNKPNDWTVPKGCFMANVADKSRFTNVKQFIAPETSEGVSLQLGNTKDFIISFDLKFLTNGSVSVVLETTEKNQLFTIHYVSNAQLIAFKERDIYYGIGPRTSWSTVTRDLVTDLRKGVGLSNTKAVKPTKIMPKKVVRLIAKGKGFLDNITISTTAHMAAFFAASDWLVRNQDEKGGWPIMVTRKLGEGFKSLEPGWYSAMAQGQAISTLVRAYLLTKDHIFLNSALRATAPYKFLSEQHGVKAVFMNKHDWYEEYPTTPSSFVLNGFMYSLIGLYDLKETAGEKLGKEARSLYERGMESLKAMLPLYDTGSGTIYDLRHFMLGIAPNLARWDYHTTHINQLQLLSTIDESPVFKEFVKRWKSYLKGSRAKHN

SEQ ID NO: 6504 - protein, 1179 aa, unidentified; identical to SEQ ID NO: 1734

SEQ ID NO: 6505 - protein, 266 aa, unidentified; identical to SEQ ID NO: 1735

SEQ ID NO: 6506 - protein, 242 aa, unidentified
MALKNKFSCLWILGLCLVATTSSKIPSITDPHFIDNCIEAHNEWRGKVNPPAADMKYMIWDKGLAKMAKAWANQCKFEHNDCLDKSYKCYAAFEYVGENIWLGGIKSFTPRHAITAWYNETQFYDFDSLSCSRVCGHYTQLVWANSFYVGCAVAMCPNLGGASTAIFVCNYGPAGNFANMPPYVRGESCSLCSKEEKCVKNLCRTPQLIIPNQNPFLKPTGRAPQQTAFNPFSLGFLLLRIF

SEQ ID NO: 6507 - protein, 775 aa, unidentified
MMVQRLGLISPPASQVSTACNQISPSLQRAMNAANLNIPPSDTRSLISRESLASTTLSLTESQSASSMKQEWSQGYRALPSLSNHGSQNGLDLGDLLSLPPGTSMSSNSVSNSLPSYLFGTESSHSPYPSPRHSSTRSHSARSKKRALSLSPLSDGIGIDFNTIIRTSPTSLVAYINGSRASPANLSPQPEVYGHFLGVRGSCIPQPRPVPGSQKGVLVAPGGLALPAYGEDGALEHERMQQLEHGGLQPGLVNHMVVQHGLPGPDSQSAGLFKTERLEEFPGSTVDLPPAPPLPPLPPPPGPPPPYHAHAHLHHPELGPHAQQLALPQATLDDDGEMDGIGGKHCCRWIDCSALYDQQEELVRHIEKVHIDQRKGEDFTCFWAGCPRRYKPFNARYKLLIHMRVHSGEKPNKCTFEGCEKAFSRLENLKIHLRSHTGEKPYLCQHPGCQKAFSNSSDRAKHQRTHLDTKPYACQIPGCTKRYTDPSSLRKHVKAHSSKEQQARKKLRSSTELHPDLLTDCLTVQSLQPATSPRDAAAEGTVGRSPGPGPDLYSAPIFSSNYSSRSGTAAGAVPPPHPVSHPSPGHNVQGSPHNPSSQLPPLTAVDAGAERFAPSAPSPHHISPRRVPAPSSILQRTQPPYTQQPSGSHLKSYQPETNSSFQPNGIHVHGFYGQLQKFCPPHYPDSQRIVPPVSSCSVVPSFEDCLVPTSMGQASFDVFHRAFSTHSGITVYDLPSSSSSLFGESLRSGAEDATFLQISTVDRCPSQLSSVYTEG

SEQ ID NO: 6508 - protein, 406 aa, unidentified; identical to SEQ ID NO: 1737

SEQ ID NO: 6509 - protein, 497 aa, unidentified; identical to SEQ ID NO: 1743

SEQ ID NO: 6510 - protein, 669 aa, unidentified
MMRLRGSGMLRDLLLRSPAGVSATLRRAQPLVTLCRRPRGGGRPAAGPAAAARLHPWWGGGGWPAEPLARGLSSSPSEILQELGKGSTHPQPGVSPPAAPAAPGPKDGPGETDAFGNSEGKELVASGENKIKQGLLPSLEDLLFYTIAEGQEKIPVHKFITALKSTGLRTSDPRLKECMDMLRLTLQTTSDGVMLDKDLFKKCVQSNIVLLTQAFRRKFVIPDFMSFTSHIDELYESAKKQSGGKVADYIPQLAKFSPDLWGVSVCTVDGQRHSTGDTKVPFCLQSCVKPLKYAIAVNDLGTEYVHRYVGKEPSGLRFNKLFLNEDDKPHNPMVNAGAIVVTSLIKQGVNNAEKFDYVMQFLNKMAGNEYVGFSNATFQSERESGDRNFAIGYYLKEKKCFPEGTDMVGILDFYFQLCSIEVTCESASVMAATLANGGFCPITGERVLSPEAVRNTLSLMHSCGMYDFSGQFAFHVGLPAKSGVAGGILLVVPNVMGMMCWSPPLDKMGNSVKGIHFCHDLVSLCNFHNYDNLRHFAKKLDPRREGGDQRVKSVINLLFAAYTGDVSALRRFALSAMDMEQRDYDSRTALHVAAAEGHVEVVKFLLEACKVNPFPKDRWNNTPMDEALHFGHHDVFKILQEYQVQYTPQGDSDNGKENQTVHKNLDGLL

SEQ ID NO: 6511 - protein, 276 aa, unidentified
MNSKRMLLLVLFAFSLMLVERYFRNHQVEELRLSDWFHPRKRPDVITKTDWLAPVLWEGTFDRRVLEKHYRRRNITVGLAVFATGRFAEEYLRPFLHSANKHFMTGYRVIFYIMVDAFFKLPDIEPSPLRTFKAFKVGTERWWLDGPLVHVKSLGEHIASHIQDEVDFLFSMAANQVFQNEFGVETLGPLVAQLHAWWYFRNTKNFPYERRPTSAACIPFGQGDFYYGNLMVGGTPHNILDFIKEYLNGVIHDIKNGLNSTYEKHLNKYFYLNKPT

SEQ ID NO: 6512 - protein, 558 aa, unidentified
MYRYLGEALLLSRAGPAALGSASADSAALLGWARGQPAAAPQPGLALAARRHYSEAVADREDDPNFFKMVEGFFDRGASIVEDKLVEDLRTRESEEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCIAVGESDGSIWNPDGIDPKELEDFKLQHGSILGFPKAKPYEGSILEADCDILIPAASEKQLTKSNAPRVKAKIIAEGANGPTTPEADKIFLERNIMVIPDLYLNAGGVTVSYFEWLKNLNHVSYGRLTFKYERDSNYHLLMSVQESLERKFGKHGGTIPIVPTAEFQDRISGASEKDIVHSGLAYTMERSARQIMRTAMKYNLGLDLRTAAYVNAIEKVFKVYNEAGVTFT

SEQ ID NO: 6513 - protein, 193 aa, unidentified
MQSLMQAPLLIALGLLLAAPAQAHLKKPSQLSSFSWDNCDEGKDPAVIRSLTLEPDPIIVPGNVTLSVMGSTSVPLSSPLKVDLVLEKEVAGLWIKIPCTDYIGSCTFEHFCDVLDMLIPTGEPCPEPLRTYGLPCHCPFKEGTYSLPKSEFVVPDLELPSWLTTGNYRIESVLSSSGKRLGCIKIAASLKGI

SEQ ID NO: 6514 - protein, 158 aa, unidentified
MLLFALLLAMELPLVAASATMRAQWTYSLRCHDCAVINDFNCPNIRVCPYHIRRCMTISIRINSRELLVYKNCTNNCTFVYAAEQPPEAPGKIFKTNSFYWVCCCNSMVCNAGGPTNLERDMLPDEVTEEELPEGTVRLGVSKLLLSFASIIVSNILP

SEQ ID NO: 6515 - protein, 626 aa, unidentified
MMARPVDPQRSPDPTFRSSTRHSGKLEPMEATAHLLRKQCPSRLNSPAWEASGLHWSSLDSPVGSMQALRPSAQHSWSPEPSVVPDQAWEDTALHQKKLCPLSLTSLPREAAVNFSYRSQTLLQEAQVLQGSPELLPRSPKPSGLQRLAPEEATALPLRRLCHLSLMEKDLGTTAHPRGFPELSHKSTAAASSRQSRPRVRSASLPPRTRLPSGSQAPSAAHPKRLSDLLLTSRAAAPGWRSPDPRSRLAAPPLGSTTLPSTWTAPQSRLTARPSRSPEPQIRESEQRDPQLRRKQQRWKEPLMPRREEKYPLRGTDPLPPGQPQRIPLPGQPLQPQPILTPGQPQKIPTPGQHQPILTPGHSQPIPTPGQPLPPQPIPTPGRPLTPQPIPTPGRPLTPQPIQMPGRPLRLPPPLRLLRPGQPMSPQLRQTQGLPLPQPLLPPGQPKSAGRPLQPLPPGPDARSISDPPAPRSRLPIRLLRGLLARLPGGASPRAAAAAACTTMKGWPAATMTPAETSPTMGPPDASAGFSIGEIAAAESPSATYSATFSCKPSGAASVDLRVPSPKPRALSRSRRYPWRRSADRCAKKPWRSGPRSAQRRNAVSSSTNNSRTKRWATCVRTACCF

SEQ ID NO: 6516 - protein, 145 aa, unidentified
MATWALLLLAAMLLGNPGLVFSRLSPEYYDLARAHLRDEEKSCPCLAQEGPQGDLLTKTQELGRDYRTCLTIVQKLKKMVDKPTQRSVSNAATRVCRTGRSRWRDVCRNFMRRYQSRVTQGLVAGETAQQICEDLRLCIPSTGPL

SEQ ID NO: 6517 - protein, 305 aa, unidentified
MAAGLARLLLLLGLSAGGPAPAGAAKMKVVEEPNAFGVNNPFLPQASRLQAKRDPSPVSGPVHLFRLSGKCFSLVESTYKYEFCPFHNVTQHEQTFRWNAYSGILGIWHEWEIANNTFTGMWMRDGDACRSRSRQSKVELACGKSNRLAHVSEPSTCVYALTFETPLVCHPHALLVYPTLPEALQRQWDQVEQDLADELITPQGHEKLLRTLFEDAGYLKTPEENEPTQLEGGPDSLGFETLENCRKAHKELSKEIKRLKGLLTQHGIPYTRPTETSNLEHLGHETPRAKSPEQLRGDPGLRGSL

SEQ ID NO: 6518 - protein, 92 aa, unidentified
MKPIQKLLAGLILLTWCVEGCSSQHWSYGLRPGGKRDAENLIDSFQEIVKEVGQLAETQRFECTTHQPRSPLRDLKGALESLIEEETGQKKI

SEQ ID NO: 6519 - protein, 120 aa, unidentified
MASSRRGLLLLLLLTAHLGPSEAQHWSHGWYPGGKRALSSAQDPQNALRPPGRALDTAAGSPVQTAHGLPSDALAPLDDSMPWEGRTTAQWSLHRKRHLARTLLTAAREPRPAPPSSNKV

SEQ ID NO: 6520 - protein, 552 aa, unidentified
MRLLPLAPGRLRRGSPRHLPSCSPALLLLVLGGCLGVFGVAAGTRRPNVVLLLTDDQDEVLGGMTPLKKTKALIGEMGMTFSSAYVPSALCCPSRASILTGKYPHNHHVVNNTLEGNCSSKSWQKIQEPNTFPAILRSMCGYQTFFAGKYLNEYGAPDAGGLEHVPLGWSYWYALEKNSKYYNYTLSINGKARKHGENYSVDYLTDVLANVSLDFLDYKSNFEPFFMMIATPAPHSPWTAAPQYQKAFQNVFAPRNKNFNIHGTNKHWLIRQAKTPMTNSSIQFLDNAFRKRWQTLLSVDDLVEKLVKRLEFTGELNNTYIFYTSDNGYHTGQFSLPIDKRQLYEFDIKVPLLVRGPGIKPNQTSKMLVANIDLGPTILDIAGYDLNKTQMDGMSLLPILRGASNLTWRSDVLVEYQGEGRNVTDPTCPSLSPGVSQCFPDCVCEDAYNNTYACVRTMSALWNLQYCEFDDQEVFVEVYNLTADPDQITNIAKTIDPELLGKMNYRLMMLQSCSGPTCRTPGVFDPGYRFDPRLMFSNRGSVRTRRFSKHLL

SEQ ID NO: 6521 - protein, 401 aa, unidentified
MMGLGNGRRSMKSPPLVLAALVACIIVLGFNYWIASSRSVDLQTRIMELEGRVRRAAAERGAVELKKNEFQGELEKQREQLDKIQSSHNFQLESVNKLYQDEKAVLVNNITTGERLIRVLQDQLKTLQRNYGRLQQDVLQFQKNQTNLERKFSYDLSQCINQMKEVKEQCEERIEEVTKKGNEAVASRDLSENNDQRQQLQALSEPQPRLQAAGLPHTEVPQGKGNVLGNSKSQTPAPSSEVVLDSKRQVEKEETNEIQVVNEEPQRDRLPQEPGREQVVEDRPVGGRGFGGAGELGQTPQVQAALSVSQENPEMEGPERDQLVIPDGQEEEQEAAGEGRNQQKLRGEDDYNMDENEAESETDKQAALAGNDRNIDVFNVEDQKRDTINLLDQREKRNHTL

SEQ ID NO: 6522 - protein, 394 aa, unidentified
MSWAAVLAVAAARFGHFWGCRWPGPMAQGWAGFSEEELRRLKQTKDPFEPQRRLPAKKSRQQLQREKALVEQSQKLGLQDGSTSLLPEQLLSAPKQRVNVQKPPFSSPTLPSHFTLTSPVGDGQPQGIESQPKELGLENSHDGHNNVEILPPKPDCKLEKKKVELQEKSRWEVLQQEQRLMEEKNKRKKALLAKAIAERSKRTQAETMKLKRIQKELQALDDMVSADIGILRNRIDQASLDYSYARKRFDRAEAEYIAAKLDIQRKTEIKEQLTEHLCTIIQQNELRKAKKLEELMQQLDVEADEETLELEVEVERLLHEQEVESRRPVVRLERPFQPAEESVTLEFAKENRKCQEQAVSPKVDDQCGNSSSIPFLSPNCPNQEGNDISAALAT

SEQ ID NO: 6523 - protein, 430 aa, unidentified
MALLHSGRVLPGIAAAFHPGLAAAASARASSWWTHVEMGPPDPILGVTEAFKRDTNSKKMNLGVGAYRDDNGKPYVLPSVRKAEAQIAAKNLDKEYLPIGGLAEFCKASAELALGENSEVLKSGRFVTVQTISGTGALRIGASFLQRFFKFSRDVFLPKPTWGNHTPIFRDAGMQLQGYRYYDPKTCGFDFTGAVEDISKIPEQSVLLLHACAHNPTGVDPRPEQWKEIATVVKKRNLFAFFDMAYQGFASGDGDKDAWAVRHFIEQGINVCLCQSYAKNMGLYGERVGAFTMVCKDADEAKRVESQLKILIRPMYSNPPLNGARIAAAILNTPDLRKQWLQEVKVMADRIIGMRTQLVSNLKKEGSTHNWQHITDQIGMFCFTGLKPEQVERLIKEFSIYMTKDGRISVAGVTSSNVGYLAHAIHQVTK

SEQ ID NO: 6524 - protein, 537 aa, unidentified; identical to SEQ ID NO: 1756

SEQ ID NO: 6525 - protein, 339 aa, unidentified; identical to SEQ ID NO: 1758

SEQ ID NO: 6526 - protein, 579 aa, unidentified
MSALRPLLLLLLPLCPGPGPGPGSEAKVTRSCAETRQVLGARGYSLNLIPPALISGEHLRVCPQEYTCCSSETEQRLIRETEATFRGLVEDSGSFLVHTLAARHRKFDEFFLEMLSVAQHSLTQLFSHSYGRLYAQHALIFNGLFSRLRDFYGESGEGLDDTLADFWAQLLERVFPLLHPQYSFPPDYLLCLSRLASSTDGSLQPFGDSPRRLRLQITRTLVAARAFVQGLETGRNVVSEALKVPVSEGCSQALMRLIGCPLCRGVPSLMPCQGFCLNVVRGCLSSRGLEPDWGNYLDGLLILADKLQGPFSFELTAESIGVKISEGLMYLQENSAKVSAQVFQECGPPDPVPARNRRAPPPREEAGRLWSMVTEEERPTTAAGTNLHRLVWELRERLARMRGFWARLSLTVCGDSRMAADASLEAAPCWTGAGRGRYLPPVVGGSPAEQVNNPELKVDASGPDVPTRRRRLQLRAATARMKTAALGHDLDGQDADEDASGSGGGQQYADDWMAGAVAPPARPPRPPYPPRRDGSGGKGGGGSARYNQGRSRSGGASIGFHTQTILILSLSALALLGPR

SEQ ID NO: 6527 - protein, 572 aa, unidentified
MDAQTWPVGFRCLLLLALVGSARSEGVQTCEEVRKLFQWRLLGAVRGLPDSPRAGPDLQVCISKKPTCCTRKMEERYQIAARQDMQQFLQTSSSTLKFLISRNAAAFQETLETLIKQAENYTSILFCSTYRNMALEAAASVQEFFTDVGLYLFGADVNPEEFVNRFFDSLFPLVYNHLINPGVTDSSLEYSECIRMARRDVSPFGNIPQRVMGQMGRSLLPSRTFLQALNLGIEVINTTDYLHFSKECSRALLKMQYCPHCQGLALTKPCMGYCLNVMRGCLAHMAELNPHWHAYIRSLEELSDAMHGTYDIGHVLLNFHLLVNDAVLQAHLNGQKLLEQVNRICGRPVRTPTQSPRCSFDQSKEKHGMKTTTRNSEETLANRRKEFINSLRLYRSFYGGLADQLCANELAAADGLPCWNGEDIVKSYTQRVVGNGIKAQSGNPEVKVKGIDPVINQIIDKLKHVVQLLQGRSPKPDKWELLQLGSGGGMVEQVSGDCDDEDGCGGSGSGEVKRTLKITDWMPDDMNFSDVKQIHQTDTGSTLDTTGAGCAVATESMTFTLISVVMLLPGIW

SEQ ID NO: 6528 - protein, 555 aa, unidentified
MPSWIGAVILPLLGLLLSLPAGADVKARSCGEVRQAYGAKGFSLADIPYQEIAGEHLRICPQEYTCCTTEMEDKLSQQSKLEFENLVEETSHFVRTTFVSRHKKFDEFFRELLENAEKSLNDMFVRTYGMLYMQNSEVFQDLFTELKRYYTGGNVNLEEMLNDFWARLLERMFQLINPQYHFSEDYLECVSKYTDQLKPFGDVPRKLKIQVTRAFIAARTFVQGLTVGREVANRVSKVSPTPGCIRALMKMLYCPYCRGLPTVRPCNNYCLNVMKGCLANQADLDTEWNLFIDAMLLVAERLEGPFNIESVMDPIDVKISEAIMNMQENSMQVSAKVFQGCGQPKPAPALRSARSAPENFNTRFRPYNPEERPTTAAGTSLDRLVTDIKEKLKLSKKVWSALPYTICKDESVTAGTSNEEECWNGHSKARYLPEIMNDGLTNQINNPEVDVDITRPDTFIRQQIMALRVMTNKLKNAYNGNDVNFQDTSDESSGSGSGSGCMDDVCPTEFEFVTTEAPAVDPDRREVDSSAAQRGHSLLSWSLTCIVLALQRLCR

SEQ ID NO: 6529 - protein, 727 aa, unidentified
MAFQKAVKGTILVGGGALATVLGLSQFAHYRRKQMNLAYVKAADCISEPVNREPPSREAQLLTLQNTSEFDILVIGGGATGSGCALDAVTRGLKTALVERDDFSSGTSSRSTKLIHGGVRYLQKAIMKLDIEQYRMVKEALHERANLLEIAPHLSAPLPIMLPVYKWWQLPYYWVGIKLYDLVAGSNCLKSSYVLSKSRALEHFPMLQKDKLVGAIVYYDGQHNDARMNLAIALTAARYGAATANYMEVVSLLKKTDPQTGKVRVSGARCKDVLTGQEFDVRAKCVINATGPFTDSVRKMDDKDAAAICQPSAGVHIVMPGYYSPESMGLLDPATSDGRVIFFLPWQKMTIAGTTDTPTDVTHHPIPSEEDINFILNEVRNYLSCDVEVRRGDVLAAWSGIRPLVTDPKSADTQSISRNHVVDISESGLITIAGGKWTTYRSMAEDTINAAVKTHNLKAGPSRTVGLFLQGGKDWSPTLYIRLVQDYGLESEVAQHLAATYGDKAFEVAKMASVTGKRWPIVGVRLVSEFPYIEAEVKYGIKEYACTAVDMISRRTRLAFLNVQAAEEALPRIVELMGRELNWDDYKKQEQLETARKFLYYEMGYKSRSEQLTDRSEISLLPSDIDRYKKRFHKFDADQKGFITIVDVQRVLESINVQMDENTLHEILNEVDLNKNGQVELNEFLQLMSAIQKGRVSGSRLAILMKTAEENLDRRVPIPVDRSCGGL

SEQ ID NO: 6530 - protein, 375 aa, unidentified; identical to SEQ ID NO: 1770

SEQ ID NO: 6531 - protein, 129 aa, unidentified
MPMASPQTLVLYLLVLAVTEAWGQEAVIPGCHLHPFNVTVRSDRQGTCQGSHVAQACVGHCESSAFPSRYSVLVASGYRHNITSVSQCCTISGLKKVKVQLQCVGSRREELEIFTARACQCDMCRLSRY

SEQ ID NO: 6532 - protein, 840 aa, unidentified
MSAFRLWPGLLIMLGSLCHRGSPCGLSTHVEIGHRALEFLQLHNGRVNYRELLLEHQDAYQAGIVFPDCFYPSICKGGKFHDVSESTHWTPFLNASVHYIRENYPLPWEKDTEKLVAFLFGITSHMAADVSWHSLGLEQGFLRTMGAIDFHGSYSEAHSAGDFGGDVLSQFEFNFNYLARRWYVPVKDLLGIYEKLYGRKVITENVIVDCSHIQFLEMYGEMLAVSKLYPTYSTKSPFLVEQFQEYFLGGLDDMAFWSTNIYHLTSFMLENGTSDCNLPENPLFIACGGQQNHTQGSKMQKNDFHRNLTTSLTESVDRNINYTERGVFFSVNSWTPDSMSFIYKALERNIRTMFIGGSQLSQKHVSSPLASYFLSFPYARLGWAMTSADLNQDGHGDLVVGAPGYSRPGHIHIGRVYLIYGNDLGLPPVDLDLDKEAHRILEGFQPSGRFGSALAVLDFNVDGVPDLAVGAPSVGSEQLTYKGAVYVYFGSKQGGMSSSPNITISCQDIYCNLGWTLLAADVNGDSEPDLVIGSPFAPGGGKQKGIVAAFYSGPSLSDKEKLNVEAANWTVRGEEDFSWFGYSLHGVTVDNRTLLLVGSPTWKNASRLGHLLHIRDEKKSLGRVYGYFPPNGQSWFTISGDKAMGKLGTSLSSGHVLMNGTLKQVLLVGAPTYDDVSKVAFLTVTLHQGGATRMYALTSDAQPLLLSTFSGDRRFSRFGGVLHLSDLDDDGLDEIIMAAPLRIADVTSGLIGGEDGRVYVYNGKETTLGDMTGKCKSWITPCPEEKAQYVLISPEASSRFGSSLITVRSKAKNQVVIAAGRSSLGARLSGALHVYSLGSD

SEQ ID NO: 6533 - protein, 572 aa, unidentified; identical to SEQ ID NO: 1774

SEQ ID NO: 6534 - protein, 588 aa, unidentified; identical to SEQ ID NO: 1804

SEQ ID NO: 6535 - protein, 226 aa, unidentified
MARLLQASCLLSLLLAGFVSQSRGQEKSKMDCHGGISGTIYEYGALTIDGEEYIPFKQYAGKYVLFVNVASYUGLTGQYIELNALQEELAPFGLVILGFPCNQFGKQEPGENSEILPTLKYVRPGGGFVPNFQLFEKGDVNGEKEQKFYTFLKNSCPPTSELLGTSDRLFWEPMKVHDIRWNFEKFLVGPDGIPIMRWHHRTTVSNVKMDILSYMRRQAALGVKRK

SEQ ID NO: 6536 - protein, 197 aa, unidentified
MSLGRLCRLLKPALLCGALAAPGLAGTMCASRDDWRCARSMHEFSAKDIDGHMVNLDKYRGFVCIVTNVASQUGKTEVNYTQLVDLHARYAECGLRILAFPCNQFGKQEPGSNEEIKEFAAGYNVKFDMFSKICVNGDDAHPLWKWMKIQPKGKGILGNAIKWNFTKFLIDKNGCVVKRYGPMEEPLVIEKDLPHYF

SEQ ID NO: 6537 - protein, 221 aa, unidentified
MTTQLRVVHLLPLLLACFVQTSPKQEKMKMDCHKDEKGTIYDYEAIALNKNEYVSFKQYVGKHILFVNVATYCGLTAQYPELNALQEELKPYGLVVLGFPCNQFGKQEPGDNKEILPGLKYVRPGGGFVPSFQLFEKGDVNGEKEQKVFSFLKHSCPHPSEILGTFKSISWDPVKVHDIRWNFEKFLVGPDGIPVMRWSHRATVSSVKTDILAYLKQFKTK

SEQ ID NO: 6538 - protein, 221 aa, unidentified
MFQQFQASCLVLFFLVGFAQQTLKPQNRKVDCNKGVTGTIYEYGALTLNGEEYIQFKQFAGKHVLFVNVAAYUGLAAQYPELNALQEELKNFGVIVLAFPCNQFGKQEPGTNSEILLGLKYVCPGSGFVPSFQLFEKGDVNGEKEQKVFTFLKNSCPPTSDLLGSSSQLFWEPMKVHDIRWNFEKFLVGPDGVPVMHWFHQAPVSTVKSDILEYLKQFNTH

SEQ ID NO: 6539 - protein, 187 aa, unidentified
MVAATVAAAWLLLWAAACAQQEQDFYDFKAVNIRGKLVSLEKYRGSVSLVVNVASECGFTDQHYRALQQLQRDLGPHHFNVLAFPCNQFGQQEPDSNKEIESFARRTYSVSFPMFSKIAVTGTGAHPAFKYLAQTSGKEPTWNFWKYLVAPDGKVVGAWDPTVSVEEVRPQITALVRKLILLKREDL

SEQ ID NO: 6540 - protein, 184 aa, unidentified
MSRTAYTVGALLLLLGTLLPAAEGKKKGSQGAIPPPDKAQHNDSEQTQSPQQPGSRNRGRGQGRGTAMPGEEVLESSQEALHVTERKYLKRDWCKTQPLKQTIHEEGCNSRTIINRFCYGQCNSFYIPRHIRKEEGSFQSCSFCKPKKFTTMMVTLNCPELQPPTKKKRVTRVKQCRCISIDLD

SEQ ID NO: 6541 - protein, 168 aa, unidentified
MFWKLSLSLFLVAVLVKVAEARKNRPAGAIPSPYKDGSSNNSERWQHQIKEVLASSQEALVVTERKYLKSDWCKTQPLRQTVSEEGCRSRTILNRFCYGQCNSFYIPRHVKKEEESFQSCAFCKPQRVTSVLVELECPGLDPPFRLKKIQKVKQCRCMSVNLSDSDKQ

SEQ ID NO: 6542 - protein, 626 aa, unidentified
MSNELDFRSVRLLKNDPVNLQKFSYTSEDEAWKTYLENPLTAATKAMMRVNGDDDSVAALSFLYDYYMGPKEKRILSSSTGGRNDQGKRYYHGMEYETDLTPLESPTHLMKFLTENVSGTPEYPDLLKKNNLMSLEGALPTPGKAAPLPAGPSKLEAGSVDSYLLPTTDMYDNGSLNSLFESIHGVPPTQRWQPDSTFKDDPQESMLFPDILKTSPEPPCPEDYPSLKSDFEYTLGSPKAIHIKSGESPMAYLNKGQFYPVTLRTPAGGKGLALSSNKVKSVVMVVFDNEKVPVEQLRFWKHWHSRQPTAKQRVIDVADCKENFNTVEHIEEVAYNALSFVWNVNEEAKVFIGVNCLSTDFSSQKGVKGVPLNLQIDTYDCGLGTERLVHRAVCQIKIFCDKGAERKMRDDERKQFRRKVKCPDSSNSGVKGCLLSGFRGNETTYLRPETDLETPPVLFIPNVHFSSLQRSGGAAPSAGPSSSNRLPLKRTCSPFTEEFEPLPSKQAKEGDLQRVLLYVRRETEEVFDALMLKTPDLKGLRNAISEKYGFPEENIYKVYKKCKRGETSLLHPRLSRHPPPDCLECSHPVTQVRNMGFGDGFWRQRDLDSNPSPTTVNSLHFTVNSE

SEQ ID NO: 6543 - protein, 883 aa, unidentified; identical to SEQ ID NO: 1864

SEQ ID NO: 6544 - protein, 894 aa, unidentified; identical to SEQ ID NO: 1865

SEQ ID NO: 6545 - protein, 902 aa, unidentified; identical to SEQ ID NO: 1866

SEQ ID NO: 6546 - protein, 908 aa, unidentified; identical to SEQ ID NO: 1870

SEQ ID NO: 6547 - protein, 1484 aa, unidentified [sequence omitted]

SEQ ID NO: 6548 - protein, 872 aa, unidentified [sequence omitted]

SEQ ID NO: 6549 - protein, 879 aa, unidentified; identical to SEQ ID NO: 1884

SEQ ID NO: 6550 - protein, 1212 aa, unidentified; identical to SEQ ID NO: 1886

SEQ ID NO: 6551 - protein, 593 aa, unidentified
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDFSTCCVMVDGSWGCCPMPQASCCEDRVHCCPHGAFCDLVHTRCITPTGTHPLAKKLPAQRTNRAVALSSSVMCPDARSRCPDGSTCCELPSGKYGCCPMPNATCCSDHLHCCPQDTVCDLIQSKCLSKENATTDLLTKLPAHTVGDVKCDMEVSCPDGYTCCRLQSGAWGCCPFTQAVCCEDHIHCCPAGFTCDTQKGTCEQGPHQVPWMEKAPAHLSLPDPQALKRDVPCDNVSSCPSSDTCCQLTSGEWGCCPIPEAVCCSDHQHCCPQGYTCVAEGQCQRGSEIVAGLEKMPARRASLSHPRDIGCDQHTSCPVGQTCCPSLGGSWACCQLPHAVCCEDRQHCCPAGYTCNVKARSCEKEVVSAQPATFLARSPHVGVKDVECGEGHFCHDNQTCCRDNRQGWACCPYRQGVCCADRRHCCPAGFRCAARGTKCLRREAPRWDAPLRDPALRQLL

SEQ ID NO: 6552 - protein, 148 aa, unidentified
MRGRELPLVLLALVLCLAPRGRAVPLPAGGGTVLTKMYPRGNHWAVGHLMGKKSTGESSSVSERGSLKQQLREYIRWEEAARNLLGLIEAKENRNHQPPQPKALGNQQPSWDSEDSSNFKDVGSKGKVGRLSAPGSQREGRNPQLNQQ

SEQ ID NO: 6553 - protein, 349 aa, unidentified; identical to SEQ ID NO: 1891

SEQ ID NO: 6554 - protein, 782 aa, unidentified
MAPHRPAPALLCALSLALCALSLPVRAATASRGASQAGAPQGRVPEARPNSMVVEHPEFLKAGKEPGLQIWRVEKFDLVPVPTNLYGDFFTGDAYVILKTVQLRNGNLQYDLHYWLGNECSQDESGAAAIFTVQLDDYLNGRAVQHREVQGFESATFLGYFKSGLKYKKGGVASGFKHVVPNEVVVQRLFQVKGRRVVRATEVPVSWESFNNGDCFILDLGNNIHQWCGSNSNRYERLKATQVSKGIRDNERSGRARVHVSEEGTEPEAMLQVLGPKPALPAGTEDTAKEDAANRKLAKLYKVSNGAGTMSVSLVADENPFAQGALKSEDCFILDHGKDGKIFVWKGKQANTEERKAALKTASDFITKMDYPKQTQVSVLPEGGETPLFKQFFKNWRDPDQTDGLGLSYLSSHIANVERVPFDAATLHTSTAMAAQHGMDDDGTGQKQIWRIEGSNKVPVDPATYGQFYGGDSYIILYNYRHGGRQGQIIYNWQGAQSTQDEVAASAILTAQLDEELGGTPVQSRVVQGKEPAHLMSLFGGKPMIIYKGGTSREGGQTAPASTRLFQVRANSAGATRAVEVLPKAGALNSNDAFVLKTPSAAYLWVGTGASEAEKTGAQELLRVLRAQPVQVAEGSEPDGFWEALGGKAAYRTSPRLKDKKMDAHPPRLFACSNKIGRFVIEEVPGELMQEDLATDDVMLLDTWDQVFVWVGKDSQEEEKTEALTSAKRYIETDPANRDRRTPITVVKQGFEPPSFVGWFLGWDDDYWSVDPLDRAMAELAA

SEQ ID NO: 6555 - protein, 387 aa, unidentified
MVHCSCVLFRKYGNFIDKLRLFTRGGSGGMGYPRLGGEGGKGGDVWVVAQNRMTLKQLKDRYPRKRFVAGVGANSKISALKGSKGKDCEIPVPVGISVTDENGKIIGELNKENDRILVAQGGLGGKLLTNFLPLKGQKRIIHLDLKLIADVGLVGFPNAGKSSLLSCVSHAKPAIADYAFTTLKPELGKIMYSDFKQISVADLPGLIEGAHMNKGMGHKFLKHIERTRQLLFVVDISGFQLSSHTQYRTAFETIILLTKELELYKEELQTKPALLAVNKMDLPDAQDKFHELMSQLQNPKDFLHLFEKNMIPERTVEFQHIIPISAVTGEGIEELKNCIRKSLDEQANQENDALHKKQLLNLWISDTMSSTEPPSKHAVTTSKMDII

SEQ ID NO: 6556 - protein, 115 aa, unidentified
MNAFLLSALCLLGAWAALAGGVTVQDGNFSFSLESVKKLKDLQEPQEPRVGKLRNFAPIPGEPVVPILCSNPNFPEELKPLCKEPNAQEILQRLEEIAEDPGTCEICAYAACTGC

SEQ ID NO: 6557 - protein, 112 aa, unidentified
MGCRAASGLLPGVAVVLLLLLQSTQSVYIQYQGFRVQLESMKKLSDLEAQWAPSPRLQAQSLLPAVCHHPALPQDLQPVCASQEASSIFKTLRTIANDDCELCVNVACTGCL

SEQ ID NO: 6558 - protein, 651 aa, unidentified
MARGSAVAWAALGPLLWGCALGLQGGMLYPQESPSRECKELDGLWSFRADFSDNRRRGFEEQWYRRPLWESGPTVDMPVPSSFNDISQDWRLRHFVGWVWYEREVILPERWTQDLRTRVVLRIGSAHSYAIVWVNGVDTLEHEGGYLPFEADISNLVQVGPLPSRLRITIAINNTLTPTTLPPGTIQYLTDTSKYPKGYFVQNTYFDFFNYAGLQRSVLLYTTPTTYIDDITVTTSVEQDSGLVNYQISVKGSNLFKLEVRLLDAENKVVANGTGTQGQLKVPGVSLWWPYLMHERPAYLYSLEVQLTAQTSLGPVSDFYTLPVGIRTVAVTKSQFLINGKPFYFHGVNKHEDADIRGKGFDWPLLVKDFNLLRWLGANAFRTSHYPYAEEVMQMCDRYGIVVIDECPGVGLALPQFFNNVSLHHHMQVMEEVVRRDKNHPAVVMWSVANEPASHLESAGYYLKMVIAHTKSLDPSRPVTFVSNSNYAADKGAPYVDVICLNSYYSWYHDYGHLELIQLQLATQFENWYKKYQKPIIQSEYGAETIAGFHQDPPLMFTEEYQKSLLEQYHLGLDQKRRKYVVGELIWNFADFMTEQSPTRVLGNKKGIFTRQRQPKSAAFLLRERYWKIANETRYPHSVAKSQCLENSLFT

SEQ ID NO: 6559 - protein, 440 aa, unidentified
MRRYLRVVVLCVACGFCSLLYAFSQLAVSLEEGTGGGGGKPQAAVASWLAGGGRGAVRGAGVAGPAAHPGVSDRCKDFSLCYWNPYWMLPSDVCGMNCFWEAAFRYSLKIQPVEKMHLAVVACGERLEETMTMLKSAIIFSIKPLQFHIFAEDQLHHSFKGRLDNWSFLQTFNYTLYPITFPSENAAEWKKLFKPCASQRLFLPLILKEVDSLLYVDTDILFLRPVDDIWSLLKKFNSTQIAAMAPEHEEPRIGWYNRFARHPYYGKTGVNSGVMLMNMTRMRRKYFKNDMTTVRLQWGDILMPLLKKYKLNITWGDQDLLNIVFFHNPESLFVFPCQWNYRPDHCIYGSNCQEAEEGGIFILHGNRGVYHDDKQPAFRAVYEALRNCSFEDDNIRSLLKPLELELQKTVHTYCGKIYKIFIKQLAKSVRDRYARSPKEK

SEQ ID NO: 6560 - protein, 443 aa, unidentified
MKLRSKAAALLLLALAALLLALLSLRAGRAEPPALPARPASAPQRHPAPVPARWPGPGALPGASPGVRRRRPPRPRPRAGRRGAARLEKLARRPGEPRSFQAVLPPELWIHLAVVACGNRLEETLVMLKSAVLFSHRKIQFHIFTEDSLKPEFDKQLRQWPDSYTKKFEHRIYPITFSVGNPQEWKKLFKPCAAQRLFLPVILKDVDSLLYVDTDVLFLRPVDDIWKLLRLFNSTQLAAMAPEHEIPKIGWYSRFARHPFYGSAGVNSGVMLMNLTRIRSTQFKNSMIPTGLAWEDMLYPLYQKYKNAITWGDQDLLNIIFYFNPECLYVFPCQWNYRPDHCMYGSNCREAEHEGVSVLHGNRGVYHDDKQPTFRALYEAIRDFPFQDNLFQSMYYPLQLKFLETVHTLCGRIPQVFLKQIEKTMKRAYEKHVIIHVGPNQMH

SEQ ID NO: 6561 - protein, 91 aa, unidentified; identical to SEQ ID NO: 1901

SEQ ID NO: 6562 - protein, 262 aa, unidentified
MRNSYRFLASSLSVVVSLLLIPEDVCEKIIGGNEVTPHSRPYMVLLSLDRKTICAGALIAKDWVLTAAHCNLNKRSQVILGAHSITREEPTKQIMLVKKEFPYPCYDPATREGDLKLLQLMEKAKINKYVTILHLPKKGDDVKPGTMCQVAGWGRTHNSASWSDTLREVNITIIDRKVCNDRNHYNFNPVIGMNMVCAGSLRGGRDSCNGDSGSPLLCEGVFRGVTSFGLENKCGDPRGPGVYILLSKKHLNWIIMTIKGAV

SEQ ID NO: 6563 - protein, 247 aa, unidentified
MQPILLLLAFLLLPRADAGEIIGGHEAKPHSRPYMAYLMIWDQKSLKRCGGFLIRDDFVLTAAHCWGSSINVTLGAHNIKEQEPTQQFIPVKRPIPHPAYNPKNFSNDIMLLQLERKAKRTRAVQPLRLPSNKAQVKPGQTCSVAGWGQTAPLGKHSHTLQEVKMTVQEDRKCESDLRHYYDSTIELCVGDPEIKKTSFKGDSGGPLVCNKVAQGIVSYGRNNGMPPRACTKVSSFVHWIKKTMKRY

SEQ ID NO: 6564 - protein, 246 aa, unidentified
MQPFLLLLAFLLTPGAGTEEIIGGHEAKPHSRPYMAFVQFLQEKSRKRCGGILVRKDFVLTAAHCQGSSINVTLGAHNIKEQERTQQFIPVKRPIPHPAYNPKNFSNDIMLLQLERKAKWTTAVRPLRLPSSKAQVKPGQLCSVAGWGYVSMSTLATTLQEVLLTVQKDCQCERLFHGNYSRATEICVGDPKKTQTGFKGDSGGPLVCKDVAQGILSYGNKKGTPPGVYIKVSHFLPWIKRTMKRL

SEQ ID NO: 6565 - protein, 264 aa, unidentified
MTKFSSFSLFFLIVGAYMTHVCFNMEIIGGKEVSPHSRPFMASIQYGGHHVCGGVLIDPQWVLTAAHCQYRFTKGQSPTVVLGAHSLSKNEASKQTLEIKKFIPFSRVTSDPQSNDIMLVKLQTAAKLNKHVKMLHIRSKTSLRSGTKCKVTGWGATDPDSLRPSDTLREVTVTVLSRKLCNSQSYYNGDPFITKDMVCAGDAKGQKDSCKGDSGGPLICKGVFHAIVSGGHECGVATKPGIYTLLTKKYQTWIKSNLVPPHTN

SEQ ID NO: 6566 - protein, 257 aa, unidentified
MEACVSSLLVLALGALSVGSSFGTQIIGGREVIPHSRPYMASLQRNGSHLCGGVLVHPKWVLTAAHCLAQRMAQLRLVLGLHTLDSPGLTFHIKAAIQHPRYKPVPALENDLALLQLDGKVKPSRTIRPLALPSKRQVVAAGTRCSMAGWGLTHQGGRLSRVLRELDLQVLDTRMCNNSRFWNGSLSPSMVCLAADSKDQAPCKGDSGGPLVCGKGRVLARVLSFSSRVCTDIFKPPVATAVAPYVSWIRKVTGRSA

SEQ ID NO: 6567 - protein, 791 aa, unidentified
MWNMLIVAMCLALLGCLQAQELQGHVSIILLGATGDLAKKYLWQGLFQLYLDEAGRGHSFSFHGAALTAPKQGQELMAKALESLSCPKDMAPSHCAEHKDQFLQLSQYRQLKTAEDYQALNKDIEAQLQHAGLREAGRIFYFSVPPFAYEDIARNINSSCRPGPGAWLRVVLEKPFGHDHFSAQQLATELGTFFQEEEMYRVDHYLGKQAVAQILPFRDQNRKALDGLWNRHHVERVEIIMKETVDAEGRTSFYEEYGVIRDVLQNHLTEVLTLVAMELPHNVSSAEAVLRHKLQVFQALRGLQRGSAVVGQYQSYSEQVRRELQKPDSFHSLTPTFAAVLVHIDNLRWEGVPFILMSGKALDERVGYARILFKNQACCVQSEKHWAAAQSQCLPRQLVFHIGHGDLGSPAVLVSRNLFRPSLPSSWKEMEGPPGLRLFGSPLSDYYAYSPVRERDAHSVLLSHIFHGRKNFFITTENLLASWNFWTPLLESLAHKAPRLYPGGAENGRLLDFEFSSGRLFFSQQQPEQLVPGPGPAPMPSDFQVLRAKYRESPLVSAWSEELISKLANDIEATAVRAVRRFGQFHLALSGGSSPVALFQQLATAHYGFPWAHTHLWLVDERCVPLSDPESNFQGLQAHLLQHVRIPYYNIHPMPVHLQQRLCAEEDQGAQIYAREISALVANSSFDLVLLGMGADGHTASLFPQSPTGLDGEQLVVLTTSPSQPHRRMSLSLPLINRAKKVAVLVMGRMKREITTLVSRVGHEPKKWPISGVLPHSGQLVWYMDYDAFLG

SEQ ID NO: 6568 - protein, 560 aa, unidentified
MFARMSDLHVLLLMALVGKTACGFSLMSLLESLDPDWTPDQYDYSYEDYNQEENTSSTLTHAENPDWYYTEDQADPCQPNPCEHGGDCLVHGSTFTCSCLAPFSGNKCQKVQNTCKDNPCGRGQCLITQSPPYYRCVCKHPYTGPSCSQVVPVCRPNPCQNGATCSRHKRRSKFTCACPDQFKGKFCEIGSDDCYVGDGYSYRGKMNRTVNQHACLYWNSHLLLQENYNMFMEDAETHGIGEHNFCRNPDADEKPWCFIKVTNDKVKWEYCDVSACSAQDVAYPEESPTEPSTKLPGFDSCGKTEIAERKIKRIYGGFKSTAGKHPWQASLQSSLPLTISMPQGHFCGGALIHPCWVLTAAHCTDIKTRHLKVVLGDQDLKKEEFHEQSFRVEKIFKYSHYNERDEIPHNDIALLKLKPVDGHCALESKYVKTVCLPDGSFPSGSECHISGWGVTETGKGSRQLLDAKVKLIANTLCNSRQLYDHMIDDSMICAGNLQKPGQDTCQGDSGGPLTCEKDGTYYVYGIVSWGLECGKRPGVYTQVTKFLNWIKATIKSESGF

SEQ ID NO: 6569 - protein, 474 aa, unidentified
MTILTYPFKNLPTASKWALRFSIRPLSCSSQLRAAPAVQTKTKKTLAKPNIRNVVVVDGVRTPFLLSGTSYKDLMPHDLARAALTGLLHRTSVPKEVVDYIIFGTVIQEVKTSNVAREAALGAGFSDKTPAHTVTMACISANQAMTTGVGLIASGQCDVIVAGGVELMSDVPIRHSRKMRKLMLDLNKAKSMGQRLSLISKFRFNFLAPELPAVSEFSTSETMGHSADRLAAAFAVSRLEQDEYALRSHSLAKKAQDEGLLSDVVPFKVPGKDTVTKDNGIRPSSLEQMAKLKPAFIKPYGTVTAANSSFLTDGASAMLIMAEEKALAMGYKPKAYLRDFMYVSQDPKDQLLLGPTYATPKVLEKAGLTMNDIDAFEFHEAFSGQILANFKAMDSDWFAENYMGRKTKVGLPPLEKFNNWGGSLSLGHPFGATGCRLVMAAANRLRKEGGQYGLVAACAAGGQGHAMIVEAYPK

SEQ ID NO: 6570 - protein, 84 aa, unidentified
MALSSQIWAACLLLLLLLASLTSGSVFPQQTGQLAELQPQDRAGARASWMPMFQRRRRRDTHFPICIFCCGCCHRSKCGMCCKT

SEQ ID NO: 6571 - protein, 354 aa, unidentified
MKSLLLLVLISICWADHLSDNYTLDHDRAIHIQAENGPHLLVEAEQAKVFSHRGGNVTLPCKFYRDPTAFGSGIHKIRIKWTKLTSDYLKEVDVFVSMGYHKKTYGGYQGRVFLKGGSDSDASLVITDLTLEDYGRYKCEVIEGLEDDTVVVALDLQGVVFPYFPRLGRYNLNFHEAQQACLDQDAVIASFDQLYDAWRGGLDWCNAGWLSDGSVQYPITKPREPCGGQNTVPGVRNYGFWDKDKSRYDVFCFTSNFNGRFYYLIHPTKLTYDEAVQACLNDGAQIAKVGQIFAAWKILGYDRCDAGWLADGSVRYPISRPRRRCSPTEAAVRFVGFPDKKHKLYGVYCFRAYN

SEQ ID NO: 6572 - protein, 340 aa, unidentified
MPGWLTLPTLCRFLLWAFTIFHKAQGDPASHPGPHYLLPPIHEVIHSHRGATATLPCVLGTTPPSYKVRWSKVEPGELRETLILITNGLHARGYGPLGGRARMRRGHRLDASLVIAGVRLEDEGRYRCELINGIEDESVALTLSLEGVVFPYQPSRGRYQFNYYEAKQACEEQDGRLATYSQLYQAWTEGLDWCNAGWLLEGSVRYPVLTARAPCGGRGRPGIRSYGPRDRMRDRYDAFCFTSALAGQVFFVPGRLTLSEAHAACRRRGAVVAKVGHLYAAWKFSGLDQCDGGWLADGSVRFPITTPRPRCGGLPDPGVRSFGFPRPQQAAYGTYCYAEN

SEQ ID NO: 6573 - protein, 360 aa, unidentified; identical to SEQ ID NO: 1908

SEQ ID NO: 6574 - protein, 402 aa, unidentified
MVCARAALGPGALWAAAWGVLLLTAPAGAQRGRKKVVHVLEGESGSVVVQTAPGQVVSHRGGTIVLPCRYHYEAAAHGHDGVRLKWTKVVDPLAFTDVFVALGPQHRAFGSYRGRAELQGDGPGDASLVLRNVTLQDYGRYECEVTNELEDDAGMVKLDLEGVVFPYHPRGGRYKLTFAEAQRACAEQDGILASAEQLHAAWRDGLDWCNAGWLRDGSVQYPVNRPREPCGGLGGTGSAGGGGDANGGLRNYGYRHNAEERYDAFCFTSNLPGRVFFLKPLRPVPFSGAARACAARGAAVAKVGQLFAAWKLQLLDRCTAGWLADGSARYPIVNPRARCGGRRPGVRSLGFPDATRRLFGVYCYRAPGAPDPAPGGWGWGWAGGGGWAGGARDPAAWTPLHV

SEQ ID NO: 6575 - protein, 506 aa, unidentified
MPLLGLLPRRAWASLLSQLLRPPCASCTGAVRCQSQVAEAVLTSQLKAHQEKPNFIIKTPKGTRDLSPQHMVVREKILDLVISCFKRHGAKGMDTPAFELKETLTEKYGEDSGLMYDLKDQGGELLSLRYDLTVPFARYLAMNKVKKMKRYHVGKVWRRESPTIVQGRYREFCQCDFDIAGQFDPMIPDAECLKIMCEILSGLQLGDFLIKVNDRRIVDGMFAVCGVPESKFRAICSSIDKLDKMAWKDVRHEMVVKKGLAPEVADRIGDYVQCHGGVSLVEQMFQDPRLSQNKQALEGLGDLKLLFEYLTLFGIADKISFDLSLARGLDYYTGVIYEAVLLQTPTQAGEEPLNVGSVAAGGRYDGLVGMFDPKGHKVPCVGLSIGVERIFYIVEQRMKTKGEKVRTTETQVFVATPQKNFLQERLKLIAELWDSGIKAEMLYKNNPKLLTQLHYCESTGIPLVVIIGEQELKEGVIKIRSVASREEVAIKRENFVAEIQKRLSES

SEQ ID NO: 6576 - protein, 364 aa, unidentified; identical to SEQ ID NO: 1912

SEQ ID NO: 6577 - protein, 268 aa, unidentified
MGLSPSAPAVAVQASNASASPPSGCPMHEGKMKGCPVNTEPSGPTCEKKTYSVPAHQERAYEYVECPIRGTAAENKENLDPSNLMPPPNQTPAPDQPFALSTVREESSIPRADSEKKWVYPSEQMFWNAMLKKGWKWKDEDISQKDMYNIIRIHNQNNEQAWKEILKWEALHAAECPCGPSLIRFGGKAKEYSPRARIRSWMGYELPFDRHDWIINRCGTEVRYVIDYYDGGEVNKDYQFTILDVRPALDSLSAVWDRMKVAWWRWTS

SEQ ID NO: 6578 - protein, 131 aa, unidentified
MNLPSTKVSWAAVTLLLLLLLLPPALLSSGAAAQPLPDCCRQKTCSCRLYELLHGAGNHAAGILTLGKRRSGPPGLQGRLQRLLQASGNHAAGILTMGRRAGAEPAPRPCLGRRCSAPAAASVAPGGQSGI

SEQ ID NO: 6579 - protein, 423 aa, unidentified
MAAWGCVAALGAARGLCWRAARAAAGLQGRPARRCYAVGPAQSPPTFGFLLDIDGVLVRGHRVIPAALKAFRRLVNSQGQLRVPVVFVTNAGNILQHSKAQELSALLGCEVDADQVILSHSPMKLFSEYHEKRMLVSGQGPVMENAQGLGFRNVVTVDELRMAFPLLDMVDLERRLKTTPLPRNDFPRIEGVLLLGEPVRWETSLQLIMDVLLSNGSPGAGLATPPYPHLPVLASNMDLLWMAEAKMPRFGHGTFLLCLETIYQKVTGKELRYEGLMGKPSILTYQYAEDLIRRQAERRGWAAPIRKLYAVGDNPMSDVYGANLFHQYLQKATHDGAPELGAGGTRQQQPSASQSCISILVCTGVYNPRNPQSTEPVLGGGEPPFHGHRDLCFSPGLMEASHVVNDVNEAVQLVFRKEGWALE

SEQ ID NO: 6580 - protein, 2040 aa, unidentified; identical to SEQ ID NO: 1928

SEQ ID NO: 6581 - protein, 1158 aa, unidentified; identical to SEQ ID NO: 1933

SEQ ID NO: 6582 - protein, 529 aa, unidentified
MTSSRLWFSLLLAAAFAGRATALWPWPQNFQTSDQRYVLYPNNFQFQYDVSSAAQPGCSVLDEAFQRYRDLLFGSGSWPRPYLTGKRHTLEKNVLVVSVVTPGCNQLPTLESVENYTLTINDDQCLLLSETVWGALRGLETFSQLVWKSAEGTFFINKTEIEDFPRFPHRGLLLDTSRHYLPLSSILDTLDVMAYNKLNVFHWHLVDDPSFPYESFTFPELMRKGSYNPVTHIYTAQDVKEVIEYARLRGIRVLAEFDTPGHTLSWGPGIPGLLTPCYSGSEPSGTFGPVNPSLNNTYEFMSTFFLEVSSVFPDFYLHLGGDEVDFTCWKSNPEIQDFMRKKGFGEDFKQLESFYIQTLLDIVSSYGKGYVVWQEVFDNKVKIQPDTIIQVWREDIPVNYMKELELVTKAGFRALLSAPWYLNRISYGPDWKDFYIVEPLAFEGTPEQKALVIGGEACMWGEYVDNTNLVPRLWPRAGAVAERLWSNKLTSDLTFAYERLSHFRCELLRRGVQAQPLNVGFCEQEFEQT

SEQ ID NO: 6583 - protein, 556 aa, unidentified
MELCGLGLPRPPMLLALLLATLLAAMLALLTQVALVVQVAEAARAPSVSAKPGPALWPLPLSVKMTPNLLHLAPENFYISHSPNSTAGPSCTLLEEAFRRYHGYIFGFYKWHHEPAEFQAKTQVQQLLVSITLQSECDAFPNISSDESYTLLVKEPVAVLKANRVWGALRGLETFSQLVYQDSYGTFTINESTIIDSPRFSHRGILIDTSRHYLPVKIILKTLDAMAFNKFNVLHWHIVDDQSFPYQSITFPELSNKGSYSLSHVYTPNDVRMVIEYARLRGIRVLPEFDTPGHTLSWGKGQKDLLTPCYSRQNKLDSFGPINPTLNTTYSFLTTFFKEISEVFPDQFIHLGGDEVEFKCWESNPKIQDFMRQKGFGTDFKKLESFYIQKVLDIIATINKGSIVWQEVFDDKAKLAPGTIVEVWKDSAYPEELSRVTASGFPVILSAPWYLDLISYGQDWRKYYKVEPLDFGGTQKQKQLFIGGEACLWGEYVDATNLTPRLWPRASAVGERLWSSKDVRDMDDAYDRLTRHRCRMVERGIAAQPLYAGYCNHENM

SEQ ID NO: 6584 - protein, 426 aa, unidentified; identical to SEQ ID NO: 1942

SEQ ID NO: 6585 - protein, 728 aa, unidentified
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCADNTMNDTDVPLETTECIQGQGEGYRGTVNTIWNGIPCQRWDSQYPHEHDMTPENFKCKDLRENYCRNPDGSESPWCFTTDPNIRVGYCSQIPNCDMSHGQDCYRGNGKNYMGNLSQTRSGLTCSMWDKNMEDLHRHIFWEPDASKLNENYCRNPDDDAHGPWCYTGNPLIPWDYCPISRCEGDTTPTIVNLDHPVISCAKTKQLRVVNGIPTRTNIGWMVSLRYRNKHICGGSLIKESWVLTARQCFPSRDLKDYEAWLGIHDVHGRGDEKCKQVLNVSQLVYGPEGSDLVLMKLARPAVLDDFVSTIDLPNYGCTIPEKTSCSVYGWGYTGLINYDGLLRVAHLYIMGNEKCSQHHRGKVTLNESEICAGAEKIGSGPCEGDYGGPLVCEQHKMRMVLGVIVPGRGCAIPNRPGIFVRVAYYAKWIHKIILTYKVPQS

SEQ ID NO: 6586 - protein, 655 aa, unidentified
MGRWAWVPSPWPPPGLGPFLLLLLLLLLLPRGFQPQPGGNRTESPEPNATATPAIPTILVTSVTSETPATSAPEAEGPQSGGLPPPPRAVPSSSSPQAQALTEDGRPCRFPFRYGGRMLHACTSEGSAHRKWCATTHNYDRDRAWGYCVEATPPPGGPAALDPCASGPCLNGGSCSNTQDPQSYHCSCPRAFTGKDCGTEKCFDETRYEYLEGGDRWARVRQGHVEQCECFGGRTWCEGTRHTACLSSPCLNGGTCHLIVATGTTVCACPPGFAGRLCNIEPDERCFLGNGTGYRGVASTSASGLSCLAWNSDLLYQELHVDSVGAAALLGLGPHAYCRNPDNDERPWCYVVKDSALSWEYCRLEACESLTRVQLSPDLLATLPEPASPGRQACGRRHKKRTFLRPRIIGGSSSLPGSHPWLAAIYIGDSFCAGSLVHTCWVVSAAHCFSHSPPRDSVSVVLGQHFFNRTTDVTQTFGIEKYIPYTLYSVFNPSDHDLVLIRLKKKGDRCATRSQFVQPICLPEPGSTFPAGHKCQIAGWGHLDENVSGYSSSLREALVPLVADHKCSSPEVYGADISPNMLCAGYFDCKSDACQGDSGGPLACEKNGVAYLYGIISWGDGCGRLHKPGVYTRVANYVDWINDRIRPPRRLVAPS

SEQ ID NO: 6587 - protein, 700 aa, unidentified; identical to SEQ ID NO: 1946

SEQ ID NO: 6588 - protein, 782 aa, unidentified
MARARAGALLALWVLGAAAHPQCLDFRPPFRPTQPLRLCAQYSDFGCCDEGRDAELTRRFWALASRVDAAEWAACAGYARDLLCQECSPYAAHLYDAEDPFTPLRTVPGLCQDYCLDMWHKCRGLFRHLSTDQELWALEGNLARFCRYLSLDDTDYCFPYLLVNKNLNSNLGHVVADAKGCLQLCLEEVANGLRNPVAMVHARDGTHRFFVAEQVGLVWAYLPDRSRLGKPFLNISRVVLTSPWEGDERGFLGIAFHPSFQHNRRLYVYYSVGIRSSEWIRISEFRVSEDDENAVDHSSERIILEVKEPASNHNGGQLLFGDDGYLYIFTGDGGMAGDPFGTFGNAQNKSALLGKVLRIDVDRKERGLPYGIPPDNPFVGDPAAQPEVYALGVRNMWRCSFDRGDPSSGTGRGRLFCGDVGQNKFEEVDVVERGGNYGWRAREGFECYDRSLCANTSLNDLLPIFAYPHTVGKSVTGGYVYRGCEYPNLNGLYIFGDFMSGRLMSLQENPGTGQWQYSEICMGHGQTCEFPGLINNYYPYIISFGEDEAGELYFMSTGEPSATAPRGVVYKIIDASRRAPPGKCQIQPAQVKIRSRLIPFVPKEKFIPKTRSTPRPTARAPTRAPRRGRPTAAPPAPTPRPARPTQQPGSRRGGGRRRGRLNSASRAFRDGEVRLVRPAGLSSGSGRVEVFVGGRWGTVCDDSWNISGAAVVCRQLGFAYAVRAVKRAEFGQGGSLPILLDDVRCAGWERNLLECQHNGVGTHNCEHDEDAGVVCSHQNPDL

SEQ ID NO: 6589 - protein, 724 aa, unidentified
MLRTSTPNLCGGLHCRAPWLSSGILCLCLIFLLGQVGLLQGHPQCLDYGPPFQPPLHLEFCSDYESFGCCDQHKDRRIAARYWDIMEYFDLKRHELCGDYIKDILCQECSPYAAHLYDAENTQTPLRNLPGLCSDYCSAFHSNCHSAISLLTNDRGLQESHGRDGTRFCHLLDLPDKDYCFPNVLRNDYLNRHLGMVAQDPQGCLQLCLSEVANGLRNPVSMVHAGDGTHRFFVAEQVGVVWVYLPDGSRLEQPFLDLKNIVLTTPWIGDERGFLGLAFHPKFRHNRKFYIYYSCLDKKKVEKIRISEMKVSRADPNKADLKSERVILEIEEPASNHNGGQLLFGLDGYMYIFTGDGGQAGDPFGLFGNAQNKSSLLGKVLRIDVNRAGSHGKRYRVPSDNPFVSEPGAHPAIYAYGIRNMWRCAVDRGDPITRQGRGRIFCGDVGQNRFEEVDLILKGGNYGWRAKEGFACYDKKLCHNASLDDVLPIYAYGHAVGKSVTGGYVYRGCESPNLNGLYIFGDFMSGRLMALQEDRKNKKWKKQDLCLGSTTSCAFPGLISTHSKFIISFAEDEAGELYFLATSYPSAYAPRGSIYKFVDPSRRAPPGKCKYKPVPVRTKSKRIPFRPLAKTVLDLLKEQSEKAARKSSSATLASGPAQGLSEKGSSKKLASPTSSKNTLRGPGTKKKARVGPHVRQGKRRKSLKSHSGRMRPSAEQKRAGRSLP

SEQ ID NO: 6590 - protein, 531 aa, unidentified
MLGFLSRGPSMKLCMGLACVLSLWNTVSGIKGEAKKEKGMTFLPTTVSGLREEERKEKGVAFLATTELPARSIDLSALNLTELVNGMLSRALKDSKKFFSLLSVTSYSSFAFHKFSVAVYNISNLKTVDPAKFPTRYCYCLNNRTNDLSDFTALLVDIIGNSTSYLTEIFKSTSILSVNQSNESDCIFICVMTGKSGRNLSDFWEIEEKYPIINYTFTSGLSGVLGAATRGTARTSKPTTKSQKTLPSTSPGHWTQSTPWASALRSSPWTETAAPSETEETLNTGRPPELPARATATWFSASHTLPALATRRVARTQWLTADRQTWASISSVPWAQTISEKKPGGSLWETRSSPPTTAGTEEAMNTTSLLAPAAEIMATPGSPSQASPTLGAFTHGTQTPSPTKATAPRYPQTGDLSAEWPFTAGEEPVLVPRPHQVSRCPQPLFKVGAMAAAPLTLAIQRLNPCLMELCQFFQQCLCMSQRSPRTEDMRYCLEYYSWFLKNATYICQRVKRVSHSHTLKQKCLENICKSV

SEQ ID NO: 6591 - protein, 414 aa, unidentified; identical to SEQ ID NO: 1947

SEQ ID NO: 6592 - protein, 336 aa, unidentified
MAASLRLLGAASGLRYWSRRLRPAAGSFAAVCSRSVASKTPVGFIGLGNMGNPMAKNLMKHGYPLIIYDVFPDACKEFQDAGEQVVSSPADVAEKADRIITMLPTSINAIEAYSGANGILKKVKKGSLLIDSSTIDPAVSKELAKEVEKMGAVFMDAPVSGGVGAARSGNLTFMVGGVEDEFAAAQELLGCMGSNVVYCGAVGTGQAAKICNNMLLAISMIGTAEAMNLGIRLGLDPKLLAKILNMSSGRCWSSDTYNPVPGVMDGVPSANNYQGGFGTTLMAKDLGLAQDSATSTKSPILLGSLAHQIYRMMCAKGYSKKDFSSVFQFLREEETF

SEQ ID NO: 6593 - protein, 163 aa, unidentified
MAAAVVLAAGLRAARRAVAATGVRGGQVRGAAGVTDGNEVAKAQQATPGGAAPTIFSRILDKSLPADILYEDQQCLVFRDVAPQAPVHFLVIPKKPIPRISQAEEEDQQLLGHLLLVAKQTAKAEGLGDGYRLVINDGKLGAQSVYHLHIHVLGGRQLQWPPG

SEQ ID NO: 6594 - protein, 1210 aa, unidentified; identical to SEQ ID NO: 1953

SEQ ID NO: 6595 - protein, 365 aa, unidentified; identical to SEQ ID NO: 1956

SEQ ID NO: 6596 - protein, 366 aa, unidentified; identical to SEQ ID NO: 1958

SEQ ID NO: 6597 - protein, 250 aa, unidentified; identical to SEQ ID NO: 1961

SEQ ID NO: 6598 - protein, 260 aa, unidentified; identical to SEQ ID NO: 1963

SEQ ID NO: 6599 - protein, 254 aa, unidentified; identical to SEQ ID NO: 1965

SEQ ID NO: 6600 - protein, 261 aa, unidentified; identical to SEQ ID NO: 1967

SEQ ID NO: 6601 - protein, 268 aa, unidentified; identical to SEQ ID NO: 1968

SEQ ID NO: 6602 - protein, 5635 aa, unidentified
MISWEVVHTVFLFALLYSSLAQDASPQSEIRAEEIPEGASTLAFVFDVTGSMYDDLVQVIEGASKILETSLKRPKRPLFNFALVPFHDPEIGPVTITTDPKKFQYELRELYVQGGGDCPEMSIGAIKIALEISLPGSFIYVFTDARSKDYRLTHEVLQLIQQKQSQVVFVLTGDCDDRTHIGYKVYEEIASTSSGQVFHLDKKQVNEVLKWVEEAVQASKVHLLSTDHLEQAVNTWRIPFDPSLKEVTVSLSGPSPMIEIRNPLGKLIKKGFGLHELLNIHNSAKVVNVKEPEAGMWTVKTSSSGRHSVRITGLSTIDFRAGFSRKPTLDFKKTVSRPVQGIPTYVLLNTSGISTPARIDLLELLSISGSSLKTIPVKYYPHRKPYGIWNISDFVPPNEAFFLKVTGYDKDDYLFQRVSSVSFSSIVPDAPKVTMPEKTPGYYLQPGQIPCSVDSLLPFTLSFVRNGVTLGVDQYLKESASVNLDIAKVTLSDEGFYECIAVSSAGTGRAQTFFDVSEPPPVIQVPNNVTVTPGERAVLTCLIISAVDYNLTWQRNDRDVRLAEPARIRTLANLSLELKSVKFNDAGEYHCMVSSEGGSSAASVFLTVQEPPKVTVMPKNQSFTGGSEVSIMCSATGYPKPKIAWTVNDMFIVGSHRYRMTSDGTLFIKNAAPKDAGIYGCLASNSAGTDKQNSTLRYIEAPKLMVVQSELLVALGDITVMECKTSGIPPPQVKWFKGDLELRPSTFLIIDPLLGLLKIQETQDLDAGDYTCVAINEAGRATGKITLDVGSPPVFIQEPADVSMEIGSNVTLPCYVQGYPEPTIKWRRLDNMPIFSRPFSVSSISQLRTGALFILNLWASDKGTYICEAENQFGKIQSETTVTVTGLVAPLIGISPSVANVIEGQQLTLPCTLLAGNPIPERRWIKNSAMLLQNPYITVRSDGSLHIERVQLQDGGEYTCVASNVAGTNNKTTSVVVHVLPTIQHGQQILSTIEGIPVTLPCKASGNPKPSVIWSKKGELISTSSAKFSAGADGSLYVVSPGGEESGEYVCTATNTAGYAKRKVQLTVYVRPRVFGDQRGLSQDKPVEISVLAGEEVTLPCEVKSLPPPIITWAKETQLISPFSPRHTFLPSGSMKITETRTSDSGMYLCVATNIAGNVTQAVKLNVHVPPKIQRGPKHLKVQVGQRVDIPCNAQGTPLPVITWSKGGSTMLVDGEHHVSNPDGTLSIDQATPSDAGIYTCVATNIAGTDETEITLHVQEPPTVEDLEPPYNTTFQERVANQRIEFPCPAKGTPKPTIKWLHNGRELTGREPGISILEDGTLLVIASVTPYDNGEYICVAVNEAGTTERKYNLKVHVPPVIKDKEQVTNVSVLLNQLTNLFCEVEGTPSPIIMWYKDNVQVTESSTIQTVNNGKILKLFRATPEDAGRYSCKAINIAGTSQKYFNIDVLVPPTIIGTNFPNEVSVVLNRDVALECQVKGTPFPDIHWFKDGKPLFLGDPNVELLDRGQVLHLKNARRNDKGRYQCTVSNAAGKQAKDIKLTIYIPPSIKGGNVTTDISVLINSLIKLECETRGLPMPAITWYKDGQPIMSSSQALYIDKGQYLHIPRAQVSDSATYTCHVANVAGTAEKSFHVDVYVPPMIEGNLATPLNKQVVIAHSLTLECKAAGNPSPILTWLKDGVPVKANDNIRIEAGGKKLEIMSAQEIDRGQYICVATSVAGEKEIKYEVDVLVPPAIEGGDETSYFIVMVNNLLELDCHVTGSPPPTIMWLKDGQLIDERDGFKILLNGRKLVIAQAQVSNTGLYRCMAANTAGDHKKEFEVTVHVPPTIKSSGLSERVVVKYKPVALQCIANGIPNPSITWLKDDQPVNTAQGNLKIQSSGRVLQIAKTLLEDAGRYTCVATNAAGETQQHIQLHVHEPPSLEDAGKMLNETVLVSNPVQLECKAAGNPVPVITWYKDNRLLSGSTSMTFLNRGQIIDIESAQISDAGIYKCVAINSAGATELFYSLQVHVAPSISGSNNMVAVVVNNPVRLECEARGIPAPSLTWLKDGSPVSSFSNGLQVLSGGRILALTSAQISDTGRYTCVAVNAAGEKQRDIDLRVYVPPNIMGEEQNVSVLISQAVELLCQSDAIPPPTLTWLKDGHPLLKKPGLSISENRSVLKIEDAQVQDTGRYTCEATNVAGKTEKNYNVNIWVPPNIGGSDELTQLTVIEGNLISLLCESSGIPPPNLIWKKKGSPVLTDSMGRVRILSGGRQLQISIAEKSDAALYSCVASNVAGTAKKEYNLQVYIRPTITNSGSHPTEIIVTRGKSISLECEVQGIPPPTVTWMKDGHPLIKAKGVEILDEGHILQLKNIHVSDTGRYVCVAVNVAGMTDKKYDLSVHAPPSIIGNHRSPENISVVEKNSVSLTCEASGIPLPSITWFKDGWPVSLSNSVRILSGGRMLRLMQTTMEDAGQYTCVVRNAAGEERKIFGLSVLVPPHIVGENTLEDVKVKEKQSVTLTCEVTGNPVPEITWHKDGQPLQEDEAHHIISGGRFLQITNVQVPHTGRYTCLASSPAGHKSRSFSLNVFVSPTIAGVGSDGNPEDVTVILNSPTSLVCEAYSYPPATITWFKDGTPLESNRNIRILPGGRTLQILNAQEDNAGRYSCVATNEAGEMIKHYEVKVYIPPIINKGDLWGPGLSPKEVKIKVNNTLTLECEAYAIPSASLSWYKDGQPLKSDDHVNIAANGHTLQIKEAQISDTGRYTCVASNIAGEDELDFDVNIQVPPSFQKLWEIGNMLDTGRNGEAKDVIINNPISLYCETNAAPPPTLTWYKDGHPLTSSDKVLILPGGRVLQIPRAKVEDAGRYTCVAVNEAGEDSLQYDVRVLVPPIIKGANSDLPEEVTVLVNKSALIECLSSGSPAPRNSWQKDGQPLLEDDHHKFLSNGRILQILNTQITDIGRYVCVAENTAGSAKKYFNLNVHVPPSVIGPKSENLTVVVNNFISLTCEVSGFPPPDLSWLKNEQPIKLNTNTLIVPGGRTLQIIRAKVSDGGEYTCIAINQAGESKKKFSLTVYVPPSIKDHDSESLSVVNVREGTSVSLECESNAVPPPVITWYKNGRMITESTHVEILADGQMLHIKKAEVSDTGQYVCRAINVAGRDDKNFHLNVYVPPSIEGPEREVIVETISNPVTLTCDATGIPPPTIAWLKNHKRIENSDSLEVRILSGGSKLQIARSQHSDSGNYTCIASNMEGKAQKYYFLSIQVPPSVAGAEIPSDVSVLLGENVELVCNANGIPTPLIQWLKDGKPIASGETERIRVSANGSTLNIYGALTSDTGKYTCVATNPAGEEDRIFNLNVYVTPTIRGNKDEAEKLMTLVDTSINIECRATGTPPPQINWLKNGLPLPLSSHIRLLAAGQVIRIVRAQVSDVAVYTCVASNRAGVDNKHYNLQVFAPPNMDNSMGTEEITVLKGSSTSMACITDGTPAPSMAWLRDGQPLGLDAHLTVSTHGMVLQLLKAETEDSGKYTCIASNEAGEVSKHFILKVLEPPHINGSEEHEEISVIVNNPLELTCIASGIPAPKMTWMKDGRPLPQTDQVQTLGGGEVLRISTAQVEDTGRYTCLASSPAGDDDKEYLVRVHVPPNIAGTDEPRDITVLRNRQVTLECKSDAVPPPVITWLRNGERLQATPRVRILSGGRYLQINNADLGDTANYTCVASNIAGKTTREFILTVNVPPNIKGGPQSLVILLNKSTVLECIAEGVPTPRITWRKDGAVLAGNHARYSILENGFLHIQSAHVTDTGRYLCMATNAAGTDRRRIDLQVHVPPSIAPGPTNMTVIVNVQTTLACEATGIPKPSINWRKNGHLLNVDQNQNSYRLLSSGSLVIISPSVDDTATYECTVTNGAGDDKRTVDLTVQVPPSIADEPTDFLVTKHAPAVITCTASGVPFPSIHWTKNGIRLLPRGDGYRILSSGAIEILATQLNHAGRYTCVARNAAGSAHRHVTLHVHEPPVIQPQPSELHVILNNPILLPCEATGTPSPFITWQKEGINVNTSGRNHAVLPSGGLQISRAVREDAGTYMCVAQNPAGTALGKIKLNVQVPPVISPHLKEYVIAVDKPITLSCEADGLPPPDITWHKDGRAIVESIRQRVLSSGSLQIAFVQPGDAGHYTCMAANVAGSSSTSTKLTVHVPPRIRSTEGHYTVNENSQAILPCVADGIPTPAINWKKDNVLLANLLGKYTAEPYGELILENVVLEDSGFYTCVANNAAGEDTHTVSLTVHVLPTFTELPGDVSLNKGEQLRLSCKATGIPLPKLTWTFNNNIIPAHFDSVNGHSELVIERVSKEDSGTYVCTAENSVGFVKAIGFVYVKEPPVFKGDYPSNWIEPLGGNAILNCEVKGDPTPTIQWNRKGVDIEISHRIRQLGNGSLAIYGTVNEDAGDYTCVATNEAGVVERSMSLTLQSPPIITLEPVETVINAGGKIILNCQATGEPQPTITWSRQGHSISWDDRVNVLSNNSLYIADAQKEDTSEFECVARNLMGSVLVRVPVIVQVHGGFSQWSAWRACSVTCGKGIQKRSRLCNQPLPANGGKPCQGSDLEMRNCQNKPCPVDGSWSEWSLWEECTRSCGRGNQTRTRTCNNPSVQHGGRPCEGNAVEIIMCNIRPCPVHGAWSAWQPWGTCSESCGKGTQTRARLCNNPPPAFGGSYCDGAETQMQVCNERNCPIHGKWATWASWSACSVSCGGGARQRTRGCSDPVPQYGGRKCEGSDVQSDFCNSDPCPTHGNWSPWSGWGTCSRTCNGGQMRRYRTCDNPPPSNGGRACGGPDSQIQRCNTDMCPVDGSWGSWHSWSQCSASCGGGEKTRKRLCDHPVPVKGGRPCPGDTTQVTRCNVQACPGGPQRARGSVIGNINDVEFGIAFLNATITDSPNSDTRIIRAKITNVPRSLGSAMRKIVSILNPIYWTTAKEIGEAVNGFTLTNAVFKRETQVEFATGEILQMSHIARGLDSDGSLLLDIVVSGYVLQLQSPAEVTVKDYTEDYIQTGPGQLYAYSTRLFTIDGISIPYTWNHTVFYDQAQGRMPFLVETLHASSVESDYNQIEETLGFKIHASISKGDRSNQCPSGFTLDSVGPFCADEDECAAGNPCSHSCHNAMGTYYCSCPKGLTIAADGRTCQDIDECALGRHTCHAGQDCDNTIGSYRCVVRCGSGFRRTSDGLSCQDINECQESSPCHQRCFNAIGSFHCGCEPGYQLKGRKCMDVNECRQNVCRPDQHCKNTRGGYKCIDLCPNGMTKAENGTCIDIDECKDGTHQCRYNQICENTRGSYRCVCPRGYRSQGVGRPCMDINECEQVPKPCAHQCSNTPGSFKCICPPGQHLLGDGKSCAGLERLPNYGTQYSSYNLARFSPVRNNYQPQQHYRQYSHLYSSYSEYRNSRTSLSRTRRTIRKTCPEGSEASHDTCVDIDECENTDACQHECKNTFGSYQCICPPGYQLTHNGKTCQDIDECLEQNVHCGPNRMCFNMRGSYQCIDTPCPPNYQRDPVSGFCLKNCPPNDLECALSPYALEYKLVSLPFGIATNQDLIRLVAYTQDGVMHPRTTFLMVDEEQTVPFALRDENLKGVVYTTRPLREAETYRMRVRASSYSANGTIEYQTTFIVYIAVSAYPY

SEQ ID NO: 6603 - protein, 139 aa, unidentified
MSISSALAMVFMGAKGNTAAQMSQALCFSKIGGEDGDIHRGFQSLLVAINRTDTEYVLRTANGLFGEKSYDFLTGFTDSCGKFYQATIKQLDFVNDTEKSTTRVNSWVADKTKGENILLFYFDNILNSFIVSSLQNCQI

SEQ ID NO: 6604 - protein, 406 aa, unidentified
MSALGAVIALLLWGQLFAVDSGNDVTDIADDGCPKPPEIAHGYVEHSVRYQCKNYYKLRTEGDGVYTLNDKKQWINKAVGDKLPECEADDGCPKPPEIAHGYVEHSVRYQCKNYYKLRTEGDGVYTLNNEKQWINKAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYSQVDIGLIKLKQKVSVNERVMPICLPSKDYAEVGRVGYVSGWGRNANFKFTDHLKYVMLPVADQDQCIRHYEGSTVPEKKTPKSPVGVQPILNEHTFCAGMSKYQEDTCYGDAGSAFAVHDLEEDTWYATGILSFDKSCAVAEYGVYVKVTSIQDWVQKTIAEN

SEQ ID NO: 6605 - protein, 348 aa, unidentified
MSDLGAVISLLLWGRQLFALYSGNDVTDISDDRFPKPPEIANGYVEHLFRYQCKNYYRLRTEGDGVYTLNDKKQWINKAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYHQVDIGLIKLKQKVLVNERVMPICLPSKNYAEVGRVGYVSGWGQSDNFKLTDHLKYVMLPVADQYDCITHYEGSTCPKWKAPKSPVGVQPILNEHTFCVGMSKYQEDTCYGDAGSAFAVHDLEEDTWYAAGILSFDKSCAVAEYGVYVKVTSIQHWVQKTIAEN

SEQ ID NO: 6606 - protein, 543 aa, unidentified
MLLRSKPALPPPLMLLLLGPLGPLSPGALPRPAQAQDVVDLDFFTQEPLHLVSPSFLSVTIDANLATDPRFLILLGSPKLRTLARGLSPAYLRFGGTKTDFLIFDPKKESTFEERSYWQSQVNQDICKYGSIPPDVEEKLRLEWPYQEQLLLREHYQKKFKNSTYSRSSVDVLYTFANCSGLDLIFGLNALLRTADLQWNSSNAQLLLDYCSSKGYNISWELGNEPNSFLKKADIFINGSQLGEDFIQLHKLLRKSTFKNAKLYGPDVGQPRRKTAKMLKSFLKAGGEVIDSVTWHHYYLNGRTATKEDFLNPDVLDIFISSVQKVFQVVESTRPGKKVWLGETSSAYGGGAPLLSDTFAAGFMWLDKLGLSARMGIEVVMRQVFFGAGNYHLVDENFDPLPDYWLSLLFKKLVGTKVLMASVQGSKRRKLRVYLHCTNTDNPRYKEGDLTLYAINLHNVTKYLRLPYPFSNKQVDKYLLRPLGPHGLLSKSVQLNGLTLKMVDDQTLPPLMEKPLRPGSSLGLPAFSYSFFVIRNAKVAACI

SEQ ID NO: 6607 - protein, 592 aa, unidentified
MRVLCAFPEAMPSSNSRPPACLAPGALYLALLLHLSLSSQAGDRRPLPVDRAAGLKEKTLILLDVSTKNPVRTVNENFLSLQLDPSIIHDGWLDFLSSKRLVTLARGLSPAFLRFGGKRTDFLQFQNLRNPAKSRGGPGPDYYLKNYEDDIVRSDVALDKQKGCKIAQHPDVMLELQREKAAQMHLVLLKEQFSNTYSNLILTARSLDKLYNFADCSGLHLIFALNALRRNPNNSWNSSSALSLLKYSASKKYNISWELGNEPNNYRTMHGRAVNGSQLGKDYIQLKSLLQPIRIYSRASLYGPNIGRPRKNVIALLDGFMKVAGSTVDAVTWQHCYIDGRVVKVMDFLKTRLLDTLSDQIRKIQKVVNTYTPGKKIWLEGVVTTSAGGTNNLSDSYAAGFLWLNTLGMLANQGIDVVIRHSFFDHGYNHLVDQNFNPLPDYWLSLLYKRLIGPKVLAVHVAGLQRKPRPGRVIRDKLRIYAHCTNHHNHNYVRGSITLFIINLHRSRKKIKLAGTLRDKLVHQYLLQPYGQEGLKSKSVQLNGQPLVMVDDGTLPELKPRPLRAGRTLVIPPVTMGFYVVKNVNALACRYR

SEQ ID NO: 6608 - protein, 462 aa, unidentified
MARVLGAPVALGLWSLCWSLAIATPLPPTSAHGNVAEGETKPDPDVTERCSDGWSFDATTLDDNGTMLFFKGEFVWKSHKWDRELISERWKNFPSPVDAAFRQGHNSVFLIKGDKVWVYPPEKKEKGYPKLLQDEFPGIPSPLDAAVECHRGECQAEGVLFFQGDREWFWDLATGTMKERSWPAVGNCSSALRWLGRYYCFQGNQFLRFDPVRGEVPPRYPRDVRDYFMPCPGRGHGHRNGTGHGNSTHHGPEYMRCSPHLVLSALTSDNHGATYAFSGTHYWRLDTSRDGWHSWPIAHQWPQGPSAVDAAFSWEEKLYLVQGTQVYVFLTKGGYTLVSGYPKRLEKEVGTPHGIILDSVDAAFICPGSSRLHIMAGRRLWWLDLKSGAQATWTELPWPHEKVDGALCMEKSLGPNSCSANGPGLYLIHGPNLYCYSDVEKLNAAKALPQPQNVTSLLGCTH

SEQ ID NO: 6609 - protein, 699 aa, unidentified
MGHHRPWLHASVLWAGVASLLLPPAMTQQLRGDGLGFRNRNNSTGVAGLSEEASAELRHHLHSPRDHPDENKDVSTENGHHFWSHPDREKEDEDVSKEYGHLLPGHRSQDHKVGDEGVSGEEVFAEHGGQARGHRGHGSEDTEDSAEHRHHLPSHRSHSHQDEDEDEVVSSEHHHHILRHGHRGHDGEDDEGEEEEEEEEEEEEASTEYGHQAHRHRGHGSEEDEDVSDGHHHHGPSHRHQGHEEDDDDDDDDDDDDDDDDVSIEYRHQAHRHQGHGIEEDEDVSDGHHHRDPSHRHRSHEEDDNDDDDVSTEYGHQAHRHQDHRKEEVEAVSGEHHHHVPDHRHQGHRDEEEDEDVSTERWHQGPQHVHHGLVDEEEEEEEITVQFGHYVASHQPRGHKSDEEDFQDEYKTEVPHHHHHRVPREEDEEVSAELGHQAPSHRQSHQDEETGHGQRGSIKEMSHHPPGHTVVKDRSHLRKDDSEEEKEKEEDPGSHEEDDESSEQGEKGTHHGSRDQEDEEDEEEGHGLSLNQEEEEEEDKEEEEEEEDEERREERAEVGAPLSPDHSEEEEEEEEGLEEDEPRFTIIPNPLDRREEAGGASSEEESGEDTGPQDAQEYGNYQPGSLCGYCSFCNRCTECESCHCDEENMGEHCDQCQHCQFCYLCPLVCETVCAPGSYVDYFSSSLYQALADMLETPEP

SEQ ID NO: 6610 - protein, 525 aa, unidentified
MKALIAALLLITLQYSCAVSPTDCSAVEPEAEKALDLINKRRRDGYLFQLLRIADAHLDRVENTTVYYLVLDVQESDCSVLSRKYWNDCEPPDSRRPSEIVIGQCKVIATRHSHESQDLRVIDFNCTTSSVSSALANTKDSPVLIDFFEDTERYRKQANKALEKYKEENDDFASFRVDRIERVARVRGGEGTGYFVDFSVRNCPRHHFPRHPNVFGFCRADLFYDVEALDLESPKNLVINCEVFDPQEHENINGVPPHLGHPFHWGGHERSSTTKPPFKPHGSRDHHHPHKPHEHGPPPPPDERDHSHGPPLPQGPPPLLPMSCSSCQHATFGTNGAQRHSHNNNSSDLHPHKHHSHEQHPHGHHPHAHHPHEHDTHRQHPHGHHPHGHHPHGHHPHGHHPHGHHPHCHDFQDYGPCDPPPHNQGHCCHGHGPPPGHLRRRGPGKGPRPFHCRQIGSVYRLPPLRKGEVLPLPEANFPSFPLPHHKHPLKPDNQPFPQSVSESCPGKFKSGFPQVSMFFTHTFPK

SEQ ID NO: 6611 - protein, 356 aa, unidentified
MGLLRIMMPPKLQLLAVVAFAVAMLFLENQIQKLEESRSKLERAIARHEVREIEQRHTMDGPRQDATLDEEEDMVIIYNRVPKTASTSFTNIAYDLCAKNKYHVLHINTTKNNPVMSLQDQVRFVKNITSWKEMKPGFYHGHVSYLDFAKFGVKKKPIYINVIRDPIERLVSYYYFLRFGDDYRPGLRRRKQGDKKTFDECVAEGGSDCAPEKLWLQIPFFCGHSSECWNVGSRWAMDQAKYNLINEYFLVGVTEELEDFIMLLEAALPRFFRGATELYRTGKKSHLRKTTEKKLPTKQTIAKLQQSDIWKMENEFYEFALEQFQFIRAHAVREKDGDLYILAQNFFYEKIYPKSN

SEQ ID NO: 6612 - protein, 307 aa, unidentified
MAALLLGAVLLVAQPQLVPSRPAELGQQELLRKAGTLQDDVRDGVAPNGSAQQLPQTIIIGVRKGGTRALLEMLSLHPDVAAAENEVHFFDWEEHYSHGLGWYLSQMPFSWPHQLTVEKTPAYFTSPKVPERVYSMNPSIRLLLILRDPSERVLSDYTQVFYNHMQKHKPYPSIEEFLVRDGRLNVDYKALNRSLYHVHMQNWLRFFPLRHIHIVDGDRLIRDPFPEIQKVERFLKLSPQINASNFYFNKTKGFYCLRDSGRDRCLHESKGRAHPQVDPKLLNKLHEYFHEPNKKFFELVGRTFDWH

SEQ ID NO: 6613 - protein, 411 aa, unidentified
MRRRRAGGRTMVERASKFVLVVAGSVCFMLILYQYAGPGLSLGAPGGRAPPDDLDLFPTPDPHYEKKYYFPVRELERSLRFDMKGDDVIVFLHIQKTGGTTFGRHLVQNVRLEVPCDCRPGQKKCTCYRPNRRETWLFSRFSTGWSCGLHADWTELTNCVPGVLDRRDSAALRTPRKFYYITLLRDPVSRYLSEWRHVQRGATWKTSLHMCDGRTPTPEELPPCYEGTDWSGCTLQEFMDCPYNLANNRQVRMLADLSLVGCYNLSFIPEGKRAQLLLESAKKNLRGMAFFGLTEFQRKTQYLFERTFNLKFIRPFMQYNSTRAGGVEVDEDTIRRIEELNDLDMQLYDYAKDLFQQRYQYKRQLERREQRLRSREERLLHRAKEALPREDADEPGRVPTEDYMSHIIEKW

SEQ ID NO: 6614 - protein, 605 aa, unidentified; identical to SEQ ID NO: 1988

SEQ ID NO: 6615 - protein, 471 aa, unidentified
MDERFNKWLLTPVLTLLFVVIMYQYVSPSCTSSCTNFGEQPRAGEAGPPAVPGPARRAQAPPEEWERRPQLPPPPRGPPEGPRGAAAPEEEDEEPGDPREGEEEEEEDEPDPEAPENGSLPRFVPRFNFSLKDLTRFVDFNIKGRDVIVFLHIQKTGGTTFGRHLVKNIRLEQPCSCKAGQKKCTCHRPGKKETWLFSRFSTGWSCGLHADWTELTNCVPAIMEKKDCPRNHSHTRNFYYITMLRDPVSRYLSEWKHVQRGATWKTSLHMCDGRSPTPDELPTCYPGDDWSGVSLREFMDCTYNLANNRQVRMLADLSLVGCYNLTFMNESERNTILLQSAKNNLKNMAFFGLTEFQRKTQFLFERTFNLKFISPFTQFNITRASNVEINEGARQRIEDLNFLDMQLYEYAKDLFQQRYHHTKQLEHQRDRQKRREERRLQREHRDHQWPKEDGAAEGTVTEDYNSQVVRW

SEQ ID NO: 6616 - protein, 315 aa, unidentified; identical to SEQ ID NO: 1989

SEQ ID NO: 6617 - protein, 300 aa, unidentified
MKFLLDILLLLPLLIVCSLESFVKLFIPKRRKSVTGEIVLITGAGHGIGRLTAYEFAKLKSKLVLWDINKHGLEETAAKCKGLGAKVHTFVVDCSNREDIYSSAKKVKAEIGDVSILVNNAGVVYTSDLFATQDPQIEKTFEVNVLAHFWTTKAFLPAMTKNNHGHIVTVASAAGHVSVPFLLAYCSSKFAAVGFHKTLTDELAALQITGVKTTCLCPNFVNTGFIKNPSTSLGPTLEPEEVVNRLMHGILTEQKMIFIPSSIAFLTTLERILPERFLAVLKQKISVKFDAVIGYKMKAQ

SEQ ID NO: 6618 - protein, 341 aa, unidentified; identical to SEQ ID NO: 1994

SEQ ID NO: 6619 - protein, 803 aa, unidentified
MRALWVLGLCCVLLTFGSVRADDEVDVDGTVEEDLGKSREGSRTDDEVVQREEEAIQLDGLNASQIRELREKSEKFAFQAEVNRMMKLIINSLYKNKEIFLRELISNASDALDKIRLISLTDENALSGNEELTVKIKCDKEKNLLHVTDTGVGMTREELVKNLGTIAKSGTSEFLNKMTEAQEDGQSTSELIGQFGVGFYSAFLVADKVIVTSKHNNDTQHIWESDSNEFSVIADPRGNTLGRGTTITLVLKEEASDYLELDTIKNLVKKYSQFINFPIYVWSSKTETVEEPMEEEEAAKEEKEESDDEAAVEEEEEEKKPKTKKVEKTVWDWELMNDIKPIWQRPSKEVEEDEYKAFYKSFSKESDDPMAYIHFTAEGEVTFKSILFVPTSAPRGLFDEYGSKKSDYIKLYVRRVFITDDFHDMMPKYLNFVKGVVDSDDLPLNVSRETLQQHKLLKVIRKKLVRKTLDMIKKIADDKYNDTFWKEFGTNIKLGVIEDHSNRTRLAKLLRFQSSHHPTDITSLDQYVERMKEKQDKIYFMAGSSRKEAESSPFVERLLKKGYEVIYLTEPVDEYCIQALPEFDGKRFQNVAKEGVKFDESEKTKESREAVEKEFEPLLNWMKDKALKDKIEKAVVSQRLTESPCALVASQYGWSGNMERIMKAQAYQTGKDISTNYYASQKKTFEINPRHPLIRDMLRRIKEDEDDKTVLDLAVVLFETATLRSGYLLPDTKAYGDRIERMLRLSLNIDPDAKVEEEPEEEPEETAEDTTEDTEQDEDEEMDVGTDEEEETAKESTAEKDEL

SEQ ID NO: 6620 - protein, 471 aa, unidentified
MAREMTILGSAVLTLLLAGYLAQQYLPLPTPKVIGIDLGTTYCSVGVFFPGTGKVKVIPDENGHISIPSMVSFTDNDVYVGYESVELADSNPQNTIYDAKRFIGKIFTAEELEAEIGRYPFKVLNKNGMVEFSVTSNETITVSPEYVGSRLLLKLKEMAEAYLGMPVANAVISVPAEFDLKQRNSTIEAANLAGLKILRVINEPTAAAMAYGLHKADVFHVLVIDLGGGTLDVSLLNKQGGMFLTRAMSGNNKLGGQDFNQRLLQYLYKQIYQTYGFVPSRKEEIHRLRQAVEMVKLNLTLHQSAQLSVLLTVEEQDRKEPHSSDTELPKDKLSSADDHRVNSGFGRGLSDKKSGESQVLFETEISRKLFDTLNEDLFQKILVPIQQVLKEGHLEKTEIDEVVLVGGSTRIPRIRQVIQEFFGKDPNTSVDPDLAVVTGVAIQAGIDGGSWPLQVSALEIPNKHLQKTNFN

SEQ ID NO: 6621 - protein, 654 aa, unidentified
MKLSLVAAMLLLLSAARAEEEDKKEDVGTVVGIDLGTTYSCVGVFKNGRVEIIANDQGNRITPSYVAFTPEGERLIGDAAKNQLTSNPENTVFDAKRLIGRTWNDPSVQQDIKFLPFKVVEKKTKPYIQVDIGGGQTKTFAPEEISAMVLTKMKETAEAYLGKKVTHAVVTVPAYFNDAQRQATKDAGTIAGLNVMRIINEPTAAAIAYGLDKREGEKNILVFDLGGGTFDVSLLTIDNGVFEVVATNGDTHLGGEDFDQRVMEHFIKLYKKKTGKDVRKDNRAVQKLRREVEKAKRALSSQHQARIEIESFYEGEDFSETLTRAKFEELNMDLFRSTMKPVQKVLEDSDLKKSDIDEIVLVGGSTRIPKIQQLVKEFFNGKEPSRGINPDEAVAYGAAVQAGVLSGDQDTGDLVLLDVCPLTLGIETVGGVMTKLIPRNTVVPTKKSQIFSTASDNQPTVTIKVYEGERPLTKDNHLLGTFDLTGIPPAPRGVPQIEVTFEIDVNGILRVTAEDKGTGNKNKITITNDQNRLTPEEIERMVNDAEKFAEEDKKLKERIDTRNELESYAYSLKNQIGDKEKLGGKLSSEDKETMEKAVEEKIEWLESHQDADIEDFKAKKKELEEIVQPIISKLYGSAGPPPTGEEDTAEKDEL

SEQ ID NO: 6622 - protein, 4391 aa, unidentified
MGWRAAGALLLALLLHGRLLAVTHGLRAYDGLSLPEDIETVTASQMRWTHSYLSDDEDMLADSISGDDLGSGDLGSGDFQMVYFRALVNFTRSIEYSPQLEDAGSREFREVSEAVVDTLESEYLKIPGDQVVSVVFIKELDGWVFVELDVGSEGNADGAQIQEMLLRVISSGSVASYVTSPQGFQFRRLGTVPQFPRACTEAEFACHSYNECVALEYRCDRRPDCRDMSDELNCEEPVLGISPTFSLLVETTSLPPRPETTIMRQPPVTHAPQPLLPGSVRPLPCGPQEAACRNGHCIPRDYLCDGQEDCEDGSDELDCGPPPPCEPNEFPCGNGHCALKLWRCDGDFDCEDRTDEANCPTKRPEEVCGPTQFRCVSTNMCIPASFHCDEESDCPDRSDEFGCMPPQVVTPPRESIQASRGQTVTFTCVAIGVPTPIINWRLNWGHIPSHPRVTVTSEGGRGTLIIRDVKESDQGAYTCEAMNARGMVFGIPDGVLELVPQRGPCPDGHFYLEHSAACLPCFCFGITSVCQSTRRFRDQIRLRFDQPDDFKGVNVTMPAQPGTPPLSSTQLQIDPSLHEFQLVDLSRRFLVHDSFWALPEQFLGNKVDSYGGSLRYNVRYELARGMLEPVQRPDVVLMGAGYRLLSRGHTPTQPGALNQRQVQFSEEHWVHESGRPVQRAELLQVLQSLEAVLIQTVYNTKMASVGLSDIAMDTTVTHATSHGRAHSVEECRCPIGYSGLSCESCDAHFTRVPGGPYLGTCSGCNCNGHASSCDPVYGHCLNCQHNTEGPQCNKCKAGFFGDAMKATATSCRPCPCPYIDASRRFSDTCFLDTDGQATCDACAPGYTGRRCESCAPGYEGNPIQPGGKCRPVNQEIVRCDERGSMGTSGEACRCKNNVVGRLCNECADGSFHLSTRNPDGCLKCFCMGVSRHCTSSSWSRAQLHGASEEPGHFSLTNAASTHTTNEGIFSPTPGELGFSSFHRLLSGPYFWSLPSRFLGDKVTSYGGELRFTVTQRSQPGSTPLHGQPLVVLQGNNIILEHHVAQEPSPGQPSTFIVPFREQAWQRPDGQPATREHLLMALAGIDTLLIRASYAQQPAESRVSGISMDVAVPEETGQDPALEVEQCSCPPGYRGPSCQDCDTGYTRTPSGLYLGTCERCSCHGHSEACEPETGACQGCQHHTEGPRCEQCQPGYYGDAQRGTPQDCQLCPCYGDPAAGQAAHTCFLDTDGHPTCDACSPGHSGRHCERCAPGYYGNPSQGQPCQRDSQVPGPIGCNCDPQGSVSSQCDAAGQCQCKAQVEGLTCSHCRPHHFHLSASNPDGCLPCFCMGITQQCASSAYTRHLISTHFAPGDFQGFALVNPQRNSRLTGEFTVEPVPEGAQLSFGNFAQLGHESFYWQLPETYQGDKVAAYGGKLRYTLSYTAGPQGSPLSDPDVQITGNNIMLVASQPALQGPERRSYEIMFREEFWRRPDGQPATREHLLMALADLDELLIRATFSSVPLAASISAVSLEVAQPGPSNRPRALEVEECRCPPGYIGLSCQDCAPGYTRTGSGLYLGHCELCECNGHSDLCHPETGACSQCQHNAAGEFCELCAPGYYGDATAGTPEDCQPCACPLTNPENMFSRTCESLGAGGYRCTACEPGYTGQYCEQCGPGYVGNPSVQGGQCLPETNQAPLVVEVHPARSIVPQGGSHSLRCQVSGSPPHYFYWSREDGRPVPSGTQQRHQGSELHFPSVQPSDAGVYICTCRNLHQSNTSRAELLVTEAPSKPITVTVEEQRSQSVRPGADVTFICTAKSKSPAYTLVWTRLHNGKLPTRAMDFNGILTIRNVQLSDAGTYVCTGSNMFAMDQGTATLHVQASGTLSAPVVSIHPPQLTVQPGQLAEFRCSATGSPTPTLEWTGGPGGQLPAKAQIHGGILRLPAVEPTDQAQYLCRAHSSAGQQVARAVLHVHGGGGPRVQVSPERTQVHAGRTVRLYCRAAGVPSATITWRKEGGSLPPQARSERTDIATLLIPAITTADAGFYLCVATSPAGTAQARIQVVVLSASDASPPPVKIESSSPSVTEGQTLDLNCVVAGSAHAQVTWYRRGGSLPPHTQVHGSRLRLPQVSPADSGEYVCRVENGSGPKEASITVSVLHGTHSGPSYTPVPGSTRPIRIEPSSSHVAEGQTLDLNCVVPGQAHAQVTWHKRGGSLPARHQTHGSLLRLHQVTPADSGEYVCHVVGTSGPLEASVLVTIEASVIPGPIPPVRIESSSSTVAEGQTLDLSCVVAGQAHAQVTWYKRGGSLPARHQVRGSRLYIFQASPADAGQYVCRASNGMEASITVTVTGTQGANLAYPAGSTQPIRIEPSSSQVAEGQTLDLNCVVPGQSHAQVTWHKRGGSLPVRHQTHGSLLRLYQASPADSGEYVCRVLGSSVPLEASVLVTIEPAGSVPALGVTPTVRIESSSSQVAEGQTLDLNCLVAGQAHAQVTWHKRGGSLPARHQVHGSRLRLLQVTPADSGEYVCRVVGSSGTQEASVLVTIQQRLSGSHSQGVAYPVRIESSSASLANGHTLDLNCLVASQAPHTITWYKRGGSLPSRHQIVGSRLRIPQVTPADSGEYVCHVSNGAGSRETSLIVTIQGSGSSHVPSVSPPIRIESSSPTVVEGQTLDLNCVVARQPQAIITWYKRGGSLPSRHQTHGSHLRLHQMSVADSGEYVCRANNNIDALEASIVISVSPSAGSPSAPGSSMPIRIESSSSHVAEGETLDLNCVVPGQAHAQVTWHKRGGSLPSHHQTRGSRLRLHHVSPADSGEYVCRVMGSSGPLEASVLVTIEASGSSAVHVPAPGGAPPIRIEPSSSRVAEGQTLDLKCVVPGQAHAQVTWHKRGGNLPARHQVHGPLLRLNQVSPADSGEYSCQVTGSSGTLEASVLVTIEPSSPGPIPAPGLAQPIYIEASSSHVTEGQTLDLNCVVPGQAHAQVTWYKRGGSLPARHQTHGSQLRLHLVSPADSGEYVCRAASGPGPEQEASFTVTVPPSEGSSYRLRSPVISIDPPSSTVQQGQDASFKCLIHDGAAPISLEWKTRNQELEDNVHISPNGSIITIVGTRPSNHGTYRCVASNAYGVAQSVVNLSVHGPPTVSVLPEGPVWVKVGKAVTLECVSAGEPRSSARWTRISSTPAKLEQRTYGLMDSHAVLQISSAKPSDAGTYVCLAQNALGTAQKQVEVIVDTGAMAPGAPQVQAEEAELTVEAGHTATLRCSATGSPAPTIHWSKLRSPLPWQHRLEGDTLIIPRVAQQDSGQYICNATSPAGHAEATIILHVESPPYATTVPEHASVQAGETVQLQCLAHGTPPLTFQWSRVGSSLPGRATARNELLHFERAAPEDSGRYRCRVTNKVGSAEAFAQLLVQGPPGSLPATSIPAGSTPTVQVTPQLETKSIGASVEFHCAVPSDRGTQLRWFKEGGQLPPGHSVQDGVLRIQNLDQSCQGTYICQAHGPWGKAQASAQLVIQALPSVLINIRTSVQTVVVGHAVEFECLALGDPKPQVTWSKVGGHLRPGIVQSGGVVRIAHVELADAGQYRCTATNAAGTTQSHVLLLVQALPQISMPQEVRVPAGSAAVFPCIASGYPTPDISWSKLDGSLPPDSRLENNMLMLPSVRPQDAGTYVCTATNRQGKVKAFAHLQVPERVVPYFTQTPYSFLPLPTIKDAYRKFEIKITFRPDSADGMLLYNGQKRVPGSPTNLANRQPDFISFGLVGGRPEFRFDAGSGMATIRHPTPLALGHFHTVTLLRSLTQGSLIVGDLAPVNGTSQGKFQGLDLNEELYLGGYPDYGAIPKAGLSSGFIGCVRELRIQGEEIVFHDLNLTAHGISHCPTCRDRPCQNGGQCHDSESSSYVCVCPAGFTGSRCEHSQALHCHPEACGPDATCVNRPDGRGYTCRCHLGRSGLRCEEGVTVTTPSLSGAGSYLALPALTNTHHELRLDVEFKPLAPDGVLLFSGGKSGPVEDFVSLAMVGGHLEFRYELGSGLAVLRSAEPLALGRWHRVSAERLNKDGSLRVNGGRPVLRSSPGKSQGLNLHTLLYLGGVEPSVPLSPATNMSAHFRGCVGEVSVNGKRLDLTYSFLGSQGIGQCYDSSPCERQPCQHGATCMPAGEYEFQCLCRDGFKGDLCEHEENPCQLREPCLHGGTCQGTRCLCLPGFSGPRCQQGSGHGIAESDWHLEGSGGNDAPGQYGAYFHDDGFLAFPGHVFSRSLPEVPETIELEVRTSTASGLLLWQGVEVGEAGQGKDFISLGLQDGHLVFRYQLGSGEARLVSEDPINDGEWHRVTALREGRRGSIQVDGEELVSGRSPGPNVAVNAKGSVYIGGAPDVATLTGGRFSSGITGCVKNLVLHSARPGAPPPQPLDLQHRAQAGANTRPCPS

SEQ ID NO: 6623 - protein, 242 aa, unidentified; identical to SEQ ID NO: 1999

SEQ ID NO: 6624 - protein, 57 aa, unidentified
MKFFVFALVLALMISMISADSHEKRHHGYRRKFHEKHHSHREFPFYGDYGSNYLYDN

SEQ ID NO: 6625 - protein, 51 aa, unidentified
MKFFVFALILALMLSMTGADSHAKRHHGYKRKFHEKHHSHRGYRSNYLYDN

SEQ ID NO: 6626 - protein, 480 aa, unidentified
MQIPRAALLPLLLLLLAAPASAQLSRAGRSAPLAAGCPDRCEPARCPPQPEHCEGGRARDACGCCEVCGAPEGAACGLQEGPCGEGLQCVVPFGVPASATVRRRAQAGLCVCASSEPVCGSDANTYANLCQLRAASRRSERLHRPPVIVLQRGACGQGQEDPNSLRHKYNFIADVVEKIAPAVVHIELFRKLPFSKREVPVASGSGFIVSEDGLIVTNAHVVTNKHRVKVELKNGATYEAKIKDVDEKADIALIKIDHQGKLPVLLLGRSSELRPGEFVVAIGSPFSLQNTVTTGIVSTTQRGGKELGLRNSDMDYIQTDAIINYGNSGGPLVNLDGEVIGINTLKVTAGISFAIPSDKIKKFLTESHDRQAKGKAITKKKYIGIRMMSLTSSKAKELKDRHRDFPDVISGAYIIEVIPDTPAEAGGLKENDVIISINGQSVVSANDVSDVIKRESTLNMVVRRGNEDIMITVIPEEIDP

SEQ ID NO: 6627 - protein, 453 aa, unidentified
MQARALLLAALAALALAREPPAAPCPARCDVSRCPSPRCPGGYVPDLCNCCLVCAASEGEPCGGPLDSPCGESLECVRGLCRCRWSHAVCGTDGHTYANVCALQAASRRALQLSGTPVRQLQKGACPLGLHQLSSPRYKFNFIADVVEKIAPAVVHIELFLRHPLFGRNVPLSSGSGFIMSEAGLIITNAHVVSSNSAAPGRQQLKVQLQNGDSYEATIKDIDKKSDIATIKIHPKKKLPVLLLGHSADLRPGEFVVAIGSPFALQNTVTTGIVSTAQREGRELGLRDSDMDYIQTDAIINYGNSGGPLVNLDGEVIGINTLKVTAGISFAIPSDRITRFLTEFQDKQIKDWKKRFIGIRMRTITPSLVDELKASNPDFPEVSSGIYVQEVAPNSPSQRGGIQDGDIIVKVNGRPLVDSSELQEAVLTESPLLLEVRRGNDDLLFSIAPEVVM

SEQ ID NO: 6628 - protein, 476 aa, unidentified
MIRPQLRTAGLGRCLLPGLLLLLVPVLWAGAEKLHTQPSCPAVCQPTRCPALPTCALGTTPVFDLCRCCRVCPAAEREVCGGAQGQPCAPGLQCLQPLRPGFPSTCGCPTLGGAVCGSDRRTYPSMCALRAENRAARRLGKVPAVPVQWGNCGDTGTRSAGPLRRNYNFIAAVVEKVAPSVVHVQLWGRLLHGSRLVPVYSGSGFIVSEDGLIITNAHVVRNQQWIEVVLQNGARYEAVVKDIDLKLDLAVIKIESNAELPVLMLGRSSDLRAGEFVVALGSPFSLQNTATAGIVSTKQRGGKELGMKDSDMDYVQIDATINYGNSGGPLVNLDGDVIGVNSLRVTDGISFAIPSDRVRQFLAEYHEHQMKGKAFSNKKYLGLQMLSLTVPLSEELKMHYPDFPDVSSGVYVCKVVEGTAAQSSGLRDHDVIVNINGKPITTTTDVVKALDSDSLSMAVLRGKDNLLLTVIPETIN

SEQ ID NO: 6629 - protein, 435 aa, unidentified
MAAHLLPICALFLTLLDMAQGFRGPLLPNRPFTTVWNANTQWCLERHGVDVDVSVFDVVANPGQTFRGPDMTIFYSSQLGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 6630 - protein, 473 aa, unidentified; identical to SEQ ID NO: 2021

SEQ ID NO: 6631 - protein, 417 aa, unidentified
MTTQLGPALVLGVALCLGCGQPLPQVPERPFSVLWNVPSAHCEARFGVHLPLNALGIIANRGQHFHGQNMTIFYKNQLGLYPYFGPRGTAHNGGIPQALPLDRHLALAAYQIHHSLRPGFAGPAVLDWEEWCPLWAGNWGRRRAYQAASWAWAQQVFPDLDPQEQLYKAYTGFEQAARALMEDTLRVAQALRPHGLWGFYHYPACGNGWHSMASNYTGRCHAATLARNTQLHWLWAASSALFPSIYLPPRLPPAHHQAFVRHRLEEAFRVALVGHRHPLPVLAYVRLTHRRSGRFLSQDDLVQSIGVSAALGAAGVVLWGDLSLSSSEEECWHLHDYLVDTLGPYVINVTRAAMACSHQRCHGHGRCARRDPGQMEAFLHLWPDGSLGDWKSFSCHCYWGWAGPTCQEPRPGPKEAV

SEQ ID NO: 6632 - protein, 999 aa, unidentified
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQEEEESPAEGSKDEPGEQVELKEEAEAPVEDGSQPPPPEPKGDATPEGEKATEKENGDKSEAQKPSEKAEAGPEGVAPAPEGEKKQKPARKRRMVEEIGVELVVLDLPDLPEDKLAQSVQKLQDLTLRDLEKQEREKAANSLEAFIFETQDKLYQPEYQEVSTEEQREEISGKLSAASTWLEDEGVGATTVMLKEKLAELRKLCQGLFFRVEERKKWPERLSALDNLLNHSSMFLKGARLIPEMDQIFTEVEMTTLEKVINETWAWKNATLAEQAKLPATEKPVLLSKDIEAKMMALDREVQYLLNKAKFTKPRPRPKDKNGTRAEPPLNASASDQGEKVIPPAGQTEDAEPISEPEKVETGSEPGDTEPLELGGPGAEPEQKEQSTGQKRPLKNDEL

SEQ ID NO: 6633 - protein, 89 aa, unidentified
MGILKLQVFLIVLSVALNHLKATPIESHQVEKRKCNTATCATQRLANFLVHSSNNFGAILSSTNVGSNTYGKRNAVEVLKREPLNYLPL

SEQ ID NO: 6634 - protein, 317 aa, unidentified
MKTALILLSILGMACAFSMKNLHRRVKIEDSEENGVFKYRPRYYLYKHAYFYPHLKRFPVQGSSDSSEENGDDSSEEEEEEEETSNEGENNEESNEDEDSEAENTTLSATTLGYGEDATPGTGYTGLAAIQLPKKAGDITNKATKEKESDEEEEEEEEGNENEESEAEVDENEQGINGTSTNSTEAENGNGSSGGDNGEEGEEESVTGANAEDTTETGRQGKGTSKTTTSPNGGFEPTTPPQVYRTTSPPFGKTTTVEYEGEYEYTGANEYDNGYEIYESENGEPRGDNYRAYEDEYSYFKGQGYDGYDGQNYYHHQ

SEQ ID NO: 6635 - protein, 532 aa, unidentified; identical to SEQ ID NO: 2024

SEQ ID NO: 6636 - protein, 275 aa, unidentified; identical to SEQ ID NO: 2025

SEQ ID NO: 6637 - protein, 271 aa, unidentified; identical to SEQ ID NO: 2027

SEQ ID NO: 6638 - protein, 155 aa, unidentified
MKVASGSTATAAAGPSCALKAGKTASGAGEVVRCLSEQSVAISRCAGGAGARLPALLDEQQVNVLLYDMNGCYSRLKELVPTLPQNRKVSKVEILQHVIDYIRDLQLELNSESEVGTPGGRGLPVRAPLSTLNGEISALTAEAACVPADDRILCR

SEQ ID NO: 6639 - protein, 1019 aa, unidentified [sequence omitted]

SEQ ID NO: 6640 - protein, 187 aa, unidentified
MAAPGALLVMGVSGSGKSTVGALLASELGWKFYDADDYHPEENRRKMGKGIPLNDQDRIPWLCNLHDILLRDVASGQRVVLACSALKKTYRDILTQGKDGVALKCEESGKEAKQAEMQLLVVHLSGSFEVISGRLLKREGHFMPPELLQSQFETLEPPAAPENFIQISVDKNVSEIIATIMETLKMK

SEQ ID NO: 6641 - protein, 550 aa, unidentified
MPPPRTGRGLLWLGLVLSSVCVALGSETQANSTTDALNVLLIIVDDLRPSLGCYGDKLVRSPNIDQLASHSLLFQNAFAQQAVCAPSRVSFLTGRRPDTTRLYDFNSYWRVHAGNFSTIPQYFKENGYVTMSVGKVFHPGISSNHTDDSPYSWSFPPYHPSSEKYENTKTCRGPDGELHANLLCPVDVLDVPEGTLPDKQSTEQAIQLLEKMKTSASPFFLAVGYHKPHIPFRYPKEFQKLYPLENITLAPDPEVPDGLPPVAYNPWMDIRQREDVQALNISVPYGPIPVDFQRKIRQSYFASVSYLDTQVGRLLSALDDLQLANSTIIAFTSDHGWALGEHGEWAKYSNFDVATHVPLIFYVPGRTASLPEAGEKLFPYLDPFDSASQLMEPGRQSMDLVELVSLFPTLAGLAGLQVPPRCPVPSFHVELCREGKNLLKHFRFRDLEEDPYLPGNPRELIAYSQYPRPSDIPQWNSDKPSLKDIKIMGYSIRTIDYRYTVWVGFNPDEFLANFSDIHAGELYFVDSDPLQDHNMYNDSQGGDLFQLLMP

SEQ ID NO: 6642 - protein, 653 aa, unidentified
MRPLRPRAALLALLASLLAAPPVAPAEAPHLVHVDAARALWPLRRFWRSTGFCPPLPHSQADQYVLSWDQQLNLAYVGAVPHRGIKQVRTHWLLELVTTRGSTGRGLSYNFTHLDGYLDLLRENQLLPGFELMGSASGHFTDFEDKQQVFEWKDLVSSLARRYIGRYGLAHVSKWNFETWNEPDHHDFDNVSMTMQGFLNYYDACSEGLRAASPALRLGGPGDSFHTPPRSPLSWGLLRHCHDGTNFFTGEAGVRLDYISLHRKGARSSISILEQEKVVAQQIRQLFPKFADTPIYNDEADPLVGWSLPQPWRADVTYAAMVVKVIAQHQNLLLANTTSAFPYALLSNDNAFLSYHPHPFAQRTLTARFQVNNTRPPHVQLLRKPVLTAMGLLALLDEEQLWAEVSQAGTVLDSNHTVGVLASAHRPQGPADAWRAAVLIYASDDTRAHPNRSVAVTLRLRGVPPGPGLVYVTRYLDNGLCSPDGEWRRLGRPVFPTAEQFRRMRAAEDPVAAAPRPLPAGGRLTLRPALRLPSLLLVHVCARPEKPPGQVTRLRALPLTQGQLVLVWSDEHVGSKCLWTYEIQFSQDGKAYTPVSRKPSTFNLFVFSPDTGAVSGSYRVRALDYWARPGPFSDPVPYLEVPVPRGPPSPGNP

SEQ ID NO: 6643 - protein, 82 aa, unidentified; identical to SEQ ID NO: 2033

SEQ ID NO: 6644 - protein, 130 aa, unidentified
MMKRAAAAAVGGALAVGAVPVVLSAMGFTGAGIAASSIAAKMMSAAAIANGGGVSAGSLVATLQSVGAAGLSTSSNILLASVGSVLGACLGNSPSSSLPAEPEAKEDEARENVPQGEPPKPPLKSEKHEE

SEQ ID NO: 6645 - protein, 250 aa, unidentified; identical to SEQ ID NO: 2035

SEQ ID NO: 6646 - protein, 189 aa, unidentified
MASPFALLMVLVVLSCKSSCSLGCDLPETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 6647 - protein, 189 aa, unidentified
MALSFSLLMAVLVLSYKSICSLGCDLPQTHSLGNRRALILLGQMGRISPFSCLKDRHDFRIPQEEFDGNQFQKAQAISVLHEMIQQTFNLFSTEDSSAAWEQSLLEKFSTELYQQLNDLEACVIQEVGVEETPLMNEDSILAVRKYFQRITLYLIERKYSPCAWEVVRAEIMRSLSFSTNLQKRLRRKD

SEQ ID NO: 6648 - protein, 189 aa, unidentified
MALPFALMMALVVLSCKSSCSLGCNLSQTHSLNNRRTLMLMAQMRRISPFSCLKDRHDFEFPQEEFDGNQFQKAQAISVLHEMMQQTFNLFSTKNSSAAWDETLLEKFYIELFQQMNDLEACVIQEVGVEETPLMNEDSILAVKKYFQRITLYLMEKKYSPCAWEVVRAEIMRSLSFSTNLQKRLRRKD

SEQ ID NO: 6649 - protein, 189 aa, unidentified
MALSFSLLMAVLVLSYKSICSLGCDLPQTHSLGNRRALILLAQMGRISHFSCLKDRYDFGFPQEVFDGNQFQKAQAISAFHEMIQQTFNLFSTKDSSAAWDETLLDKFYIELFQQLNDLEACVTQEVGVEEIALMNEDSILAVRKYFQRITLYLMGKKYSPCAWEVVRAEIMRSFSFSTNLQKGLRRKD

SEQ ID NO: 6650 - protein, 189 aa, unidentified
MALSFSLLMAVLVLSYKSICSLGCDLPQTHSLGNRRALILLAQMGRISPFSCLKDRHDFGLPQEEFDGNQFQKTQAISVLHEMIQQTFNLFSTEDSSAAWEQSLLEKFSTELYQQLNNLEACVIQEVGMEETPLMNEDSILAVRKYFQRITLYLTEKKYSPCAWEVVRAEIMRSLSFSTNLQKILRRKD

SEQ ID NO: 6651 - protein, 188 aa, unidentified [sequence omitted]

SEQ ID NO: 6652 - protein, 189 aa, unidentified
MALSFSLLMAVLVLSYKSICSLGCDLPQTHSLGNRRALILLAQMGRISPFSCLKDRHDFGFPQEEFDGNQFQKAQAISVLHEMIQQTFNLFSTKDSSATWEQSLLEKFSTELNQQLNDLEACVIQEVGVEETPLMNVDSILAVKKYFQRITLYLTEKKYSPCAWEVVRAEIMRSFSLSKIFQERLRRKE

SEQ ID NO: 6653 - protein, 189 aa, unidentified
MALSFSLLMAVLVLSYKSICSLGCDLPQTHSLGNRRALILLAQMGRISHFSCLKDRHDFGFPEEEFDGHQFQKAQAISVLHEMIQQTFNLFSTEDSSAAWEQSLLEKFSTELYQQLNDLEACVIQEVGVEETPLMNEDSILAVRKYFQRITLYLTEKKYSPCAWEVVRAEIMRSLSFSTNLQKRLRRKD

SEQ ID NO: 6654 - protein, 189 aa, unidentified
MALPFVLLMALVVLNCKSICSLGCDLPQTHSLSNRRTLMIMAQMGRISPFSCLKDRHDFGFPQEEFDGNQFQKAQAISVLHEMIQQTFNLFSTKDSSATWDETLLDKFYTELYQQLNDLEACMMQEVGVEDTPLMNVDSILTVRKYFQRITLYLTEKKYSPCAWEVVRAEIMRSFSLSANLQERLRRKE

SEQ ID NO: 6655 - protein, 189 aa, unidentified
MALPFALLMALVVLSCKSSCSLDCDLPQTHSLGHRRTMMLLAQMRRISLFSCLKDRHDFRFPQEEFDGNQFQKAEAISVLHEVIQQTFNLFSTKDSSVAWDERLLDKLYTELYQQLNDLEACVMQEVWVGGTPLMNEDSILAVRKYFQRITLYLTEKKYSPCAWEVVRAEIMRSFSSSRNLQERLRRKE

SEQ ID NO: 6656 - protein, 189 aa, unidentified
MARSFSLLMVVLVLSYKSICSLGCDLPQTHSLRNRRALILLAQMGRISPFSCLKDRHEFRFPEEEFDGHQFQKTQAISVLHEMIQQTFNLFSTEDSSAAWEQSLLEKFSTELYQQLNDLEACVIQEVGVEETPLMNEDFILAVRKYFQRITLYLMEKKYSPCAWEVVRAEIMRSFSFSTNLKKGLRRKD

SEQ ID NO: 6657 - protein, 189 aa, unidentified
MALTFYLLVALVVLSYKSFSSLGCDLPQTHSLGNRRALILLAQMRRISPFSCLKDRHDFEFPQEEFDDKQFQKAQAISVLHEMIQQTFNLFSTKDSSAALDETLLDEFYIELDQQLNDLESCVMQEVGVIESPLMYEDSILAVRKYFQRITLYLTEKKYSSCAWEVVRAEIMRSFSLSINLQKRLKSKE

SEQ ID NO: 6658 - protein, 557 aa, unidentified; identical to SEQ ID NO: 2042

SEQ ID NO: 6659 - protein, 187 aa, unidentified
MTNKCLLQIALLLCFSTTALSMSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 6660 - protein, 208 aa, unidentified
MIIKHFFGTVLVLLASTTIFSLDLKLIIFQQRQVNQESLKLLNKLQTLSIQQCLPHRKNFLLPQKSLSPQQYQKGHTLAILHEMLQQIFSLFRANISLDGWEENHTEKFLIQLHQQLEYLEALMGLEAEKLSGTLGSDNLRLQVKMYFRRIHDYLENQDYSTCAWAIVQVEISRCLFFVFSLTEKLSKQGRPLNDMKQELTTEFRSPR

SEQ ID NO: 6661 - protein, 166 aa, unidentified
MKYTSYILAFQLCIVLGSLGCYCQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 6662 - protein, 489 aa, unidentified; identical to SEQ ID NO: 2044

SEQ ID NO: 6663 - protein, 200 aa, unidentified
MAAAWTVVLVTLVLGLAVAGPVPTSKPTTTGKGCHIGRFKSLSPQELASFKKARDALEESLKLKNWSCSSPVFPGNWDLRLLQVRERPVALEAELALTLKVLEAAAGPALEDVLDQPLHTLHHILSQLQACIQPQPTAGPRPRGRLHHWLHRLQEAPKKESAGCLEASVTFNLFRLLTRDLKYVADGNLCLRTSTHPEST

SEQ ID NO: 6664 - protein, 200 aa, unidentified
MKLDMTGDCTPVLVLMAAVLTVTGAVPVARLHGALPDARGCHIAQFKSLSPQELQAFKRAKDALEESLLLKDCRCHSRLFPRTWDLRQLQVRERPMALEAELALTLKVLEATADTDPALVDVLDQPLHTLHHILSQFRACIQPQPTAGPRTRGRLHHWLYRLQEAPKKESPGCLEASVTFNLFRLLTRDLNCVASGDLCV

SEQ ID NO: 6665 - protein, 196 aa, unidentified
MTGDCMPVLVLMAAVLTVTGAVPVARLRGALPDARGCHIAQFKSLSPQELQAFKRAKDALEESLLLKDCKCRSRLFPRTWDLRQLQVRERPVALEAELALTLKVLEATADTDPALGDVLDQPLHTLHHILSQLRACIQPQPTAGPRTRGRLHHWLHRLQEAPKKESPGCLEASVTFNLFRLLTRDLNCVASGDLCV

SEQ ID NO: 6666 - protein, 520 aa, unidentified; identical to SEQ ID NO: 2046

SEQ ID NO: 6667 - protein, 195 aa, unidentified
MALLFPLLAALVMTSYSPVGSLGCDLPQNHGLLSRNTLVLLHQMRRISPFLCLKDRRDFRFPQEMVKGSQLQKAHVMSVLHEMLQQIFSLFHTERSSAAWNMTLLDQLHTGLHQQLQHLETCLLQVVGEGESAGAISSPALTLRRYFQGIRVYLKEKKYSDCAWEVVRMEIMKSLFLSTNMQERLRSKDRDLGSS

SEQ ID NO: 6668 - protein, 195 aa, unidentified
MGKISSLPTQLFKCCFCDFLKVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKYQPPSTNKNTKSQRRKGWPKTHPGGEQKEGTEASLQIRGKKKEQRREIGSRNAECRGKKGK

SEQ ID NO: 6669 - protein, 180 aa, unidentified; identical to SEQ ID NO: 2051

SEQ ID NO: 6670 - protein, 605 aa, unidentified; identical to SEQ ID NO: 2053

SEQ ID NO: 6671 - protein, 259 aa, unidentified
MSEVPVARVWLVLLLLTVQVGVTAGAPWQCAPCSAEKLALCPPVSASCSEVTRSAGCGCCPMCALPLGAACGVATARCARGLSCRALPGEQQPLHALTRGQGACVQESDASAPHAAEAGSPESPESTEITEEELLDNFHLMAPSEEDHSILWDAISTYDGSKALHVTNIKKWKEPCRIELYRVVESLAKAQETSGEEISKFYLPNCNKNGFYHSRQCETSMDGEAGLCWCVYPWNGKRIPGSPEIRGDPNCQIYFNVQN

SEQ ID NO: 6672 - protein, 325 aa, unidentified
MLPRVGCPALPLPPPPLLPLLLLLLGASGGGGGARAEVLFRCPPCTPERLAACGPPPVAPPAAVAAVAGGARMPCAELVREPGCGCCSVCARLEGEACGVYTPRCGQGLRCYPHPGSELPLQALVMGEGTCEKRRDAEYGASPEQVADNGDDHSEGGLVENHVDSTMNMLGGGGSAGRKPLKSGMKELAVFREKVTEQHRQMGKGGKHHLGLEEPKKLRPPPARTPCQQELDQVLERISTMRLPDERGPLEHLYSLHIPNCDKHGLYNLKQCKMSLNGQRGECWCVNPNTGKLIQGAPTIRGDPECHLFYNEQQEARGVHTQRMQ

SEQ ID NO: 6673 - protein, 291 aa, unidentified
MQRARPTLWAAALTLLVLLRGPPVARAGASSAGLGPVVRCEPCDARALAQCAPPPAVCAELVREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 6674 - protein, 258 aa, unidentified
MLPLCLVAALLLAAGPGPSLGDEAIHCPPCSEEKLARCRPPVGCEELVREPGCGCCATCALGLGMPCGVYTPRCGSGLRCYPPRGVEKPLHTLMHGQGVCMELAEIEAIQESLQPSDKDEGDHPNNSFSPCSAHDRRCLQKHFAKIRDRSTSGGKMKVNGAPREDARPVPQGSCQSELHRALERLAASQSRTHEDLYIIPIPNCDRNGNFHPKQCHPALDGQRGKCWCVDRKTGVKLPGGLEPKGELDCHQLADSFRE

SEQ ID NO: 6675 - protein, 272 aa, unidentified
MVLLTAVLLLLAAYAGPAQSLGSFVHCEPCDEKALSMCPPSPLGCELVKEPGCGCCMTCALAEGQSCGVYTERCAQGLRCLPRQDEEKPLHALLHGRGVCLNEKSYREQVKIERDSREHEEPTTSEMAEETYSPKIFRPKHTRISELKAEAVKKDRRKKLTQSKFVGGAENTAHPRIISAPEMRQESEQGPCRRHMEASLQELKASPRMVPRAVYLPNCDRKGFYKRKQCKPSRGRKRGICWCVDKYGMKLPGMEYVDGDFQCHTFDSSNVE

SEQ ID NO: 6676 - protein, 240 aa, unidentified
MTPHRLLPPLLLLLALLLAASPGGALARCPGCGQGVQAGCPGGCVEEEDGGSPAEGCAEAEGCLRREGQECGVYTPNCAPGLQCHPPKDDEAPLRALLLGRGRCLPARAPAVAEENPKESKPQAGTARPQDVNRRDQQRNPGTSTTPSQPNSAGVQDTEMGPCRRHLDSVLQQLQTEVYRGAQTLYVPNCDHRGFYRKRQCRSSQGQRRGPCWCVDRMGKSLPGSPDGNGSSSCPTGSSG

SEQ ID NO: 6677 - protein, 282 aa, unidentified
MERPSLRALLLGAAGLLLLLLPLSSSSSSDTCGPCEPASCPPLPPLGCLLGETRDACGCCPMCARGEGEPCGGGGAGRGYCAPGMECVKSRKRRKGKAGAAAGGPGVSGVCVCKSRYPVCGSDGTTYPSGCQLRAASQRAESRGEKAITQVSKGTCEQGPSIVTPPKDIWNVTGAQVYLSCEVIGIPTPVLIWNKVKRGHYGVQRTELLPGDRDNLAIQTRGGPEKHEVTGWVLVSPLSKEDAGEYECHASNSQGQASASAKITVVDALHEIPVKKGEGAEL

SEQ ID NO: 6678 - protein, 278 aa, unidentified
MPRLSLLLPLLLLLLLPLLPPLSPSLGIRDVGGRRPKCGPCRPEGCPAPAPCPAPGISALDECGCCARCLGAEGASCGGRAGGRCGPGLVCASQAAGAAPEGTGLCVCAQRGTVCGSDGRSYPSVCALRLRARHTPRAHPGHLHKARDGPCEFAPVVVVPPRSVHNVTGAQVGLSCEVRAVPTPVITWRKVTKSPEGTQALEELPGDHVNIAVQVRGGPSDHEATAWILINPLRKEDEGVYQCHAANMVGEAESHSTVTVLDLSKYRSFHFPAPDDRM

SEQ ID NO: 6679 - protein, 110 aa, unidentified
MAPRGCIVAVFAIFCISRLLCSHGAPVAPMTPYLMLCQPHKRCGDKFYDPLQHCCYDDAVVPLARTQTCGNCTFRVCFEQCCPWTFMVKLINQNCDSARTSDDRLCRSVS

SEQ ID NO: 6680 - protein, 119 aa, unidentified
MVPRIFAPAYVSVCLLLLCPREVIAPAGSEPWLCQPAPRCGDKIYNPLEQCCYNDAIVSLSETRQCGPPCTFWPCFELCCLDSFGLTNDFVVKLKVQGVNSQCHSSPISSKCESRRRFP

SEQ ID NO: 6681 - protein, 125 aa, unidentified
MRPRCCILALVCWITVFLLQCSKGTTDAPVGSGLWLCQPTPRCGNKIYNPSEQCCYDDAILSLKETRRCGSTCTFWPCFELCCPESFGPQQKFLVKLRVLGMKSQCHLSPISRSCTRNRRHVLYP

SEQ ID NO: 6682 - protein, 355 aa, unidentified; identical to SEQ ID NO: 2054

SEQ ID NO: 6683 - protein, 53 aa, unidentified
MCSYYHMKKRSVSGCNITIFAVMFSHLSAGKSPCGNQANVLCISRLEFVQYQS

SEQ ID NO: 6684 - protein, 336 aa, unidentified
MPPPAPGARLRLLAAAALAGLAVISRGLLSQSLEFNSPADNYTVCEGDNATLSCFIDEHVTRVAWLNRSNILYAGNDRWTSDPRVRLLINTPEEFSILITEVGLGDEGLYTCSFQTRHQPYTTQVYLIVHVPARIVNISSPVTVNEGGNVNLLCLAVGRPEPTVTWRQLRDGFTSEGEILEISDIQRGQAGEYECVTHNGVNSAPDSRRVLVTVNYPPTITDVTSARTALGRAALLRCEAMAVPPADFQWYKDDRLLSSGTAEGLKVQTERTRSMLLFANVSARHYGNYTCRAANRLGASSASMRLLRPGSLENSAPRPPGLLALLSALGWLWWRM

SEQ ID NO: 6685 - protein, 1336 aa, unidentified; identical to SEQ ID NO: 2055

SEQ ID NO: 6686 - protein, 2623 aa, unidentified
MKVKGRGITCLLVSFAVICLVATPGGKACPRRCACYMPTEVHCTFRYLTSIPDSIPPNVERINLGYNSLVRLMETDFSGLTKLELLMLHSNGIHTIPDKTFSDLQALQVLKMSYNKVRKLQKDTFYGLRSLTRLHMDHNNIEFINPEVFYGLNFLRLVHLEGNQLTKLHPDTFVSLSYLQIFKISFIKFLYLSDNFLTSLPQEMVSYMPDLDSLYLHGNPWTCDCHLKWLSDWIQEKPDVIKCKKDRSPSSAQQCPLCMNPRTSKGKPLAMVSAAAFQCAKPTIDSSLKSKSLTILEDSSSAFISPQGFMAPFGSLTLNMTDQSGNEANMVCSIQKPSRTSPIAFTEENDYIVLNTSFSTFLVCNIDYGHIQPVWQILALYSDSPLILERSHLLSETPQLYYKYKQVAPKPEDIFTNIEADLRADPSWLMQDQISLQLNRTATTFSTLQIQYSSDAQITLPRAEMRPVKHKWTMISRDNNTKLEHTVLVGGTVGLNCPGQGDPTPHVDWLLADGSKVRAPYVSEDGRILIDKSGKLELQMADSFDTGVYHCISSNYDDADILTYRITVVEPLVEAYQENGIHHTVFIGETLDLPCHSTGIPDASISWVIPGNNVLYQSSRDKKVLNNGTLRILQVTPKDQGYYRCVAANPSGVDFLIFQVSVKMKGQRPLEHDGETEGSGLDESNPIAHLKEPPGAQLRTSALMEAEVGKHTSSTSKRHNYRELTLQRRGDSTHRRFRENRRHFPPSARRIDPQHWAALLEKAKKNAMPDKRENTTVSPPPVVTQLPNIPGEEDDSSGMLALHEEFMVPATKALNLPARTVTADSRTISDSPMTNINYGTEFSPVVNSQILPPEEPTDFKLSTAIKTTAMSKNINPTMSSQIQGTTNQHSSTVFPLLLGATEFQDSDQMGRGREHFQSRPPITVRTMIKDVNVKMLSSTTNKLLLESVNTTNSHQTSVREVSEPRHNHFYSHTTQILSTSTFPSDPHTAAHSQFPIPRNSTVNIPLFRRFGRQRKIGGRGRIISPYRTPVLRRHRYSIFRSTTRGSSEKSTTAFSATVLNVTCLSCLPRERLTTATAALSFPSAAPITFPKADIARVPSEESTTLVQNPLLLLENKPSVEKTTPTIKYFRTEISQVTPTGAVMTYAPTSIPMEKTHKVNASYPRVSSTNEAKRDSVITSSLSGAITKPPMTIIAITRFSRRKIPWQQNFVNNHNPKGRLRNQHKVSLQKSTAVMLPKTSPALPRDKVSPFHFTTLSTSVMQIPSNTLTTAHHTTTKTHNPGSLPTKKELPFPPLNPMLPSIISKDSSTKSIISTQTAIPATTPTFPASVITYETQTERSRAQTIQREQEPQKKNRTDPNISPDQSSGFTTPTAMTPPVLTTAETSVKPSVSAFTHSPPENTTGISSTISFHSRTLNLTDVIEELAQASTQTLKSTIASETTLSSKSHQSTTTRKAIIRHSTIPPFLSSSATLMPVPISPPFTQRAVTDNVATPISGLMTNTVVKLHESSRHNAKPQQLVAEVATSPKVHPNAKFTIGTTHFIYSNLLHSTPMPALTTVKSQNSKLTPSPWAENQFWHKPYSEIAEKGKKPEVSMLATTGLSEATTLVSDWDGQKNTKKSDFDKKPVQEATTSKLLPFDSLSRYIFEKPRIVGGKAASFTIPANSDAFLPCEAVGNPLPTIHWTRVPSGLDLSKRKQNSRVQVLPNGTLSIQRVEIQDRGQYLCSASNLFGTDHLHVTLSVVSYPPRILERRTKEITVHSGSTVELKCRAEGRPSPTVTWILANQTVVSESSQGSRQAVVTVDGTLVLHNLSIYDRGFYKCVASNPGGQDSLLVKIQVIAAPPVILEQRRQVIVGTWGESLKLPCTAKGTPQPSVYWVLSDGTEVKPLQFTNSKLFLFSNGTLYIRNLASSDRGTYECIATSSTGSERRVVMLTMEERVTSPRIEAASQKRTEVNFGDKLLLNCSATGEPKPQIMWRLPSKAVVDQQHRVGSWIHVYPNGSLFIGSVTEKDSGVYLCVARNKMGDDLILMHVSLRLKPAKIDHKQYFRKQVLHGKDFQVDCKASGSPVPEISWSLPDGTMINNAMQADDSGHRTRRYTLFNNGTLYFNKVGVAEEGDYTCYAQNTLGKDEMKVHLTVITAAPRIRQSNKTNKRIKAGDTAVLDCEVTGDPKPKIFWLLPSNDMISFSIDRYTFHANGSLTINKVKLLDSGEYVCVARNPSGDDTKMYKLDVVSKPPLINGLYTNRTVIKATAVRHSKKHFDCRAEGTPSPEVMWIMPDNIFLTAPYYGSRITVHKNGTLEIRNVRLSDSADFICVARNEGGESVLVVQLEVLEMLRRPTFRNPFNEKIVAQLGKSTALNCSVDGNPPPEIIWILPNGTRFSNGPQSYQYLIASNGSFIISKTTREDAGKYRCAARNKVGYIEKLVILEIGQKPVILTYAPGTVKGISGESLSLHCVSDGIPKPNIKWTMPSGYVVDRPQINGKYILHDNGTLVIKEATAYDRGNYICKAQNSVGHTLITVPVMIVAYPPRITNRPPRSIVTRTGAAFQLHCVALGVPKPEITWEMPDHSLLSTASKERTHGSEQLHLQGTLVIQNPQTSDSGIYKCTAKNPLGSDYAATYIQVI

SEQ ID NO: 6687 - protein, 431 aa, unidentified; identical to SEQ ID NO: 2056

SEQ ID NO: 6688 - protein, 467 aa, unidentified
MRTAPSLRRCVCLLLAAILDLARGYLTVNIEPLPPVVAGDAVTLKCNFKTDGRMREIVWYRVTDGGTIKQKIFTFDAMFSTNYSHMENYRKREDLVYQSTVRLPEVRISDNGPYECHVGIYDRATREKVVLASGNIFLNVMAPPTSIEVVAADTPAPFSRYQAQNFTLVCIVSGGKPAPMVYFKRDGEPIDAVPLSEPPAASSGPLQDSRPFRSLLHRDLDDTKMQKSLSLLDAENRGGRPYTERPSRGLTPDPNILLQPTTENIPETVVSREFPRWVHSAEPTYFLRHSRTPSSDGTVEVRALLTWTLNPQIDNEALFSCEVKHPALSMPMQAEVTLVAPKGPKIVMTPSRARVGDTVRILVHGFQNEVFPEPMFTWTRVGSRLLDGSAEFDGKELVLERVPAELNGSMYRCTAQNPLGSTDTHTRLIVFENPNIPRGTEDSNGSIGPTGARLTLVLALTVILELT

SEQ ID NO: 6689 - protein, 613 aa, unidentified; identical to SEQ ID NO: 2061

SEQ ID NO: 6690 - protein, 1179 aa, unidentified; identical to SEQ ID NO: 2062

SEQ ID NO: 6691 - protein, 411 aa, unidentified
MSPARLRPRLHFCLVLLLLLVVPAAWGCGPGRVVGSRRRPPRKLVPLAYKQFSPNVPEKTLGASGRYEGKIARSSERFKELTPNYNPDIIFKDEENTGADRLMTQRCKDRLNSLAISVMNQWPGVKLRVTEGWDEDGHHSEESLHYEGRAVDITTSDRDRNKYGLLARLAVEAGFDWVYYESKAHVHCSVKSEHSAAAKTGGCFPAGAQVRLESGARVALSAVRPGDRVLAMGEDGSPTFSDVLIFLDREPHRLRAFQVIETQDPPRRLALTPAHLLFTADNHTEPAARFRATFASHVQPGQYVLVAGVPGLQPARVAAVSTHVALGAYAPLTKHGTLVVEDVVASCFAAVADHHLAQLAFWPLRLFHSLAWGSWTPGEGVHWYPQLLYRLGRLLLEEGSFHPLGMSGAGS

SEQ ID NO: 6692 - protein, 178 aa, unidentified
MHSSALLCCLVLLTGVRASPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 6693 - protein, 199 aa, unidentified
MNCVCRLVLVVLSLWPDTAVAPGPPPGPPRVSPDPRAELDSTVLLTRSLLADTRQLAAQLRDKFPADGDHNLDSLPTLAMSAGALGALQLPGVLTRLRADLLSYLRHVQWLRRAGGSSLKTLEPELGTLQARLDRLLRRLQLLMSRLALPQPPPDPPAPPLAPPSSAWGGIRAAHAILGGLHLTLDWAVRGLLLLKTRL

SEQ ID NO: 6694 - protein, 422 aa, unidentified; identical to SEQ ID NO: 2068

SEQ ID NO: 6695 - protein, 328 aa, unidentified
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 6696 - protein, 662 aa, unidentified; identical to SEQ ID NO: 2070

SEQ ID NO: 6697 - protein, 862 aa, unidentified; identical to SEQ ID NO: 2071

SEQ ID NO: 6698 - protein, 146 aa, unidentified [sequence omitted]

SEQ ID NO: 6699 - protein, 427 aa, unidentified; identical to SEQ ID NO: 2072

SEQ ID NO: 6700 - protein, 267 aa, unidentified; identical to SEQ ID NO: 2074

SEQ ID NO: 6701 - protein, 155 aa, unidentified
MTPGKTSLVSLLLLLSLEAIVKAGITIPRNPGCPNSEDKNFPRTVMVNLNIHNRNTNTNPKRSSDYYNRSTSPWNLHRNEDPERYPSVIWEAKCRHLGCINADGNVDYHMNSVPIQQEILVLRREPPHCPNSFRLEKILVSVGCTCVTPIVHHVA

SEQ ID NO: 6702 - protein, 180 aa, unidentified
MDWPHNLLFLLTISIFLGLGQPRSPKSKRKGQGRPGPLAPGPHQVPLDLVSRMKPYARMEEYERNIEEMVAQLRNSSELAQRKCEVNLQLWMSNKRSLSPWGYSINHDPSRIPVDLPEARCLCLGCVNPFTMQEDRSMVSVPVFSQVPVRRRLCPPPPRTGPCRQRAVMETIAVGCTCIF

SEQ ID NO: 6703 - protein, 197 aa, unidentified
MTLLPGLLFLTWLHTCLAHHDPSLRGHPHSHGTPHCYSAEELPLGQAPPHLLARGAKWGQALPVALVSSLEAASHRGRHERPSATTQCPVLRPEEVLEADTHQRSISPWRYRVDTDEDRYPQKLAFAECLCRGCIDARTGRETAALNSVRLLQSLLVLRRRPCSRDGSGLPTPGAFAFHTEFIHVPVGCTCVLPRSV

SEQ ID NO: 6704 - protein, 202 aa, unidentified
MLVAGFLLALPPSWAAGAPRAGRRPARPRGCADRPEELLEQLYGRLAAGVLSAFHHTLQLGPREQARNASCPAGGRPADRRFRPPTNLRSVSPWAYRISYDPARYPRYLPEAYCLCRGCLTGLFGEEDVRFRSAPVYMPTVVLRRTPACAGGRSVYTEAYVTIPVGCTCVPEPEKDADSINSSIDKQGAKLLLGPNDAPAGP

SEQ ID NO: 6705 - protein, 163 aa, unidentified
MTVKTLHGPAMVKYLLLSILGLAFLSEAAARKIPKVGHTFFQKPESCPPVPGGSMKLDIGIINENQRVSMSRNIESRSTSPWNYTVTWDPNRYPSEVVQAQCRNLGCINAQGKEDISMNSVPIQQETLVVRRKHQGCSVSFQLEKVLVTVGCTCVTPVIHHVQ

SEQ ID NO: 6706 - protein, 866 aa, unidentified; identical to SEQ ID NO: 2075

SEQ ID NO: 6707 - protein, 791 aa, unidentified; identical to SEQ ID NO: 2077

SEQ ID NO: 6708 - protein, 667 aa, unidentified; identical to SEQ ID NO: 2079

SEQ ID NO: 6709 - protein, 199 aa, unidentified
MTMRHNWTPDLSPLWVLLLCAHVVTLLVRATPVSQTTTAATASVRSTKDPCPSQPPVFPAAKQCPALEVTWPEVEVPLNGTLSLSCVACSRFPNFSILYWLGNGSFIEHLPGRLWEGSTSRERGSTGTQLCKALVLEQLTPALHSTNFSCVLVDPEQVVQRHVVLAQLWVRSPRRGLQEQEELCFHMWGGKGGLCQSSL

SEQ ID NO: 6710 - protein, 541 aa, unidentified; identical to SEQ ID NO: 2080

SEQ ID NO: 6711 - protein, 599 aa, unidentified; identical to SEQ ID NO: 2081

SEQ ID NO: 6712 - protein, 177 aa, unidentified; identical to SEQ ID NO: 2082

SEQ ID NO: 6713 - protein, 569 aa, unidentified; identical to SEQ ID NO: 2083

SEQ ID NO: 6714 - protein, 398 aa, unidentified; identical to SEQ ID NO: 2084

SEQ ID NO: 6715 - protein, 570 aa, unidentified; identical to SEQ ID NO: 2085

SEQ ID NO: 6716 - protein, 556 aa, unidentified; identical to SEQ ID NO: 2088

SEQ ID NO: 6717 - protein, 575 aa, unidentified; identical to SEQ ID NO: 2089

SEQ ID NO: 6718 - protein, 177 aa, unidentified
MEICRGLRSHLITLLLFLFHSETICRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 6719 - protein, 153 aa, unidentified
MYRMQLLSCIALSLALVTNSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 6720 - protein, 176 aa, unidentified
MKASSLAFSLLSAAFYLLWTPSTGLKTLNLGSCVIATNLQEIRNGFSEIRGSVQAKDGNIDIRILRRTESLQDTKPANRCCLLRHLLRLYLDRVFKNYQTPDHYTLRKISSLANSFLTIKKDLRLCHAHMTCHCGEEAMKKYSQILSHFEKLEPQAAVVKALGELDILLQWMEETE

SEQ ID NO: 6721 - protein, 553 aa, unidentified; identical to SEQ ID NO: 2090

SEQ ID NO: 6722 - protein, 162 aa, unidentified
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 6723 - protein, 179 aa, unidentified
MAALQKSVSSFLMGTLATSCLLLLALLVQGGAAAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 6724 - protein, 263 aa, unidentified
MMPKHCFLGFLISFFLTGVAGTQSTHESLKPQRVQFQSRNFHNILQWQPGRALTGNSSVYFVQYKIMFSCSMKSSHQKPSGCWQHISCNFPGCRTLAKYGQRQWKNKEDCWGTQELSCDLTSETSDIQEPYYGRVRAASAGSYSEWSMTPRFTPWWETKIDPPVMNITQVNGSLLVILHAPNLPYRYQKEKNVSIEDYYELLYRVFIINNSLEKEQKVYEGAHRAVEIEALTPHSSYCVVAEIYQPMLDRRSQRSEERCVEIP

SEQ ID NO: 6725 - protein, 189 aa, unidentified
MLGSRAVMLLLLLPWTAQGRAVPGGSSPAWTQCQQLSQKLCTLAWSAHPLVGHMDLREEGDEETTNDVPHIQCGDGCDPQGLRDNSQFCLQRIHQGLIFYEKLLGSDIFTGEPSLLPDSPVGQLHASLLGLSQLLQPEGHHWETQQIPSLSPSQPWQRLLLRFKILRSLQAFVAVAARVFAHGAATLSP

SEQ ID NO: 6726 - protein, 206 aa, unidentified
MNFQQRLQSLWTLARPFCPPLLATASQMQMVVLPCLGFTLLLWSQVSGAQGQEFHFGPCQVKGVVPQKLWEAFWAVKDTMQAQDNITSARLLQQEVLQNVSDAESCYLVHTLLEFYLKTVFKNYHNRTVEVRTLKSFSTLANNFVLIVSQLQPSQENEMFSIRDSAHRRFLLFRRAFKQLDVEAALTKALGEVDILLTWMQKFYKL

SEQ ID NO: 6727 - protein, 177 aa, unidentified
MRERPRLGEDSSLISLFLQVVAFLAMVMGTHTYSHWPSCCPSKGQDTSEELLRWSTVPVPPLEPARPNRHPESCRASEDGPLNSRAISPWRYELDRDLNRLPQDLYHARCLCPHCVSLQTGSHMDPRGNSELLYHNQTVFYRRPCHGEKGTHKGYCLERRLYRVSLACVCVRPRVMG

SEQ ID NO: 6728 - protein, 171 aa, unidentified
MLVNFILRCGLLLVTLSLAIAKHKQSSFTKSCYPRGTLSQAVDALYIKAAWLKATIPEDRIKNIRLLKKKTKKQFMKNCQFQEQLLSFFMEDVFGQLQLQGCKKIRFVEDFHSLRQKLSHCISCASSAREMKSITRMKRIFYRIGNKGIYKAISELDILLSWIKKLLESSQ

SEQ ID NO: 6729 - protein, 243 aa, unidentified
MGQTAGDLGWRLSLLLLPLLLVQAGVWGFPRPPGRPQLSLQELRREFTVSLHLARKLLSEVRGQAHRFAESHLPGVNLYLLPLGEQLPDVSLTFQAWRRLSDPERLCFISTTLQPFHALLGGLGTQGRWTNMERMQLWAMRLDLRDLQRHLRFQVLAAGFNLPEEEEEEEEEEEEERKGLLPGALGSALQGPAQVSWPQLLSTYRLLHSLELVLSRAVRELLLLSKAGHSVWPLGFPTLSPQP

SEQ ID NO: 6730 - protein, 551 aa, unidentified; identical to SEQ ID NO: 2097

SEQ ID NO: 6731 - protein, 152 aa, unidentified
MSRLPVLLLLQLLVRPGLQAPMTQTTPLKTSWVNCSNMIDEIITHLKQPPLPLLDFNNLNGEDQDILMENNLRRPNLEAFNRAVKSLQNASAIESILKNLLPCLPLATAAPTRHPIHIKDGDWNEFRRKLTFYLKTLENAQAQQTTLSLAIF

SEQ ID NO: 6732 - protein, 164 aa, unidentified
MASHSGPSTSVLFLFCCLGGWLASHTLPVRLLRPSDDVQKIVEELQSLSKMLLKDVEEEKGVLVSQNYTLPCLSPDAQPPNNIHSPAIRAYLKTIRQLDNKSVIDEIIEHLDKLIFQDAPETNISVPTDTHECKRFILTISQQFSECMDLALKSLTSGAQQATT

SEQ ID NO: 6733 - protein, 732 aa, unidentified; identical to SEQ ID NO: 2099

SEQ ID NO: 6734 - protein, 234 aa, unidentified
MCFPKVLSDDMKKLKARMVMLLPTSAQGLGAWVSACDTEDTVGHLGPWRDKDPALWCQLCLSSQHQAIERFYDKMQNAESGRGQVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 6735 - protein, 242 aa, unidentified
MPRGFTWLRYLGIFLGVALGNEPLEMWPLTQNEECTVTGFLRDKLQYRSRLQYMKHYFPINYKISVPYEGVFRIANVTRLQRAQVSERELRYLWVLVSLSATESVQDVLLEGHPSWKYLQEVETLLLNVQQGLTDVEVSPKVESVLSLLNAPGPNLKLVRPKALLDNCFRVMELLYCSCCKQSSVLNWQDCEVPSPQSCSPEPSLQYAATQLYPPPPWSPSSPPHSTGSVRPVRAQGEGLLP

SEQ ID NO: 6736 - protein, 378 aa, unidentified; identical to SEQ ID NO: 2100

SEQ ID NO: 6737 - protein, 153 aa, unidentified [sequence omitted]

SEQ ID NO: 6738 - protein, 567 aa, unidentified
MAPLALHLLVLVPILLSLVASQDWKAERSQDPFEKCMQDPDYEQLLKVVTWGLNRTLKPQRVIVVGAGVAGLVAAKVLSDAGHKVTILEADNRIGGRIFTYRDQNTGWIGELGAMRMPSSHRILHKLCQGLGLNLTKFTQYDKNTWTEVHEVKLRNYVVEKVPEKLGYALRPQEKGHSPEDIYQMALNQALKDLKALGCRKAMKKFERHTLLEYLLGEGNLSRPAVQLLGDVMSEDGFFYLSFAEALRAHSCLSDRLQYSRIVGGWDLLPRALLSSLSGLVLLNAPVVAMTQGPHDVHVQIETSPPARNLKVLKADVVLLTASGPAVKRITFSPPLPRHMQEALRRLHYVPATKVFLSFRRPFWREEHIEGGHSNTDRPSRMIFYPPPREGALLLASYTWSDAAAAFAGLSREEALRLALDDVAALHGPVVRQLWDGTGVVKRWAEDQHSQGGFVVQPPALWQTEKDDWTVPYGRIYFAGEHTAYPHGWVETAVKSALRAAIKINSRKGPASDTASPEGHASDMEGQGHVHGVASSPSHDLAKEEGSHPPVQGQLSLQNTTHTRTSH

SEQ ID NO: 6739 - protein, 825 aa, unidentified; identical to SEQ ID NO: 2101

SEQ ID NO: 6740 - protein, 134 aa, unidentified
MRMLLHLSLLALGAAYVYAIPTEIPTSALVKETLALLSTHRTLLIANETLRIPVPVHKNHQLCTEEIFQGIGTLESQTVQGGTVERLFKNLSLIKKYIDGQKKKCGEERRRVNQFLDYLQEFLGVMNTEWIIES

SEQ ID NO: 6741 - protein, 420 aa, unidentified; identical to SEQ ID NO: 2102

SEQ ID NO: 6742 - protein, 212 aa, unidentified
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 6743 - protein, 468 aa, unidentified; identical to SEQ ID NO: 2103

SEQ ID NO: 6744 - protein, 918 aa, unidentified; identical to SEQ ID NO: 2104

SEQ ID NO: 6745 - protein, 177 aa, unidentified
MFHVSFRYIFGLPPLILVLLPVASSDCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEH

SEQ ID NO: 6746 - protein, 459 aa, unidentified; identical to SEQ ID NO: 2105

SEQ ID NO: 6747 - protein, 144 aa, unidentified
MLLAMVLTSALLLCSVAGQGCPTLAGILDINFLINKMQEDPASKCHCSANVTSCLCLGIPSDNCTRPCFSERLSQMTNTTMQTRYPLIFSRVKKSVEVLKNNKCPYFSCEQPCNQTTAGNALTFLKSLLEIFQKEKMRGMRGKI

SEQ ID NO: 6748 - protein, 546 aa, unidentified; identical to SEQ ID NO: 2107

SEQ ID NO: 6749 - protein, 639 aa, unidentified; identical to SEQ ID NO: 2108

SEQ ID NO: 6750 - protein, 632 aa, unidentified; identical to SEQ ID NO: 2109

SEQ ID NO: 6751 - protein, 291 aa, unidentified
MLRREARLRREYLYRKAREEAQRSAQERKERLRRALEENRLIPTELRREALALQGSLEFDDAGGEGVTSHVDDEYRWAGVEDPKVMITTSRDPSSRLKMFAKELKLVFPGAQRMNRGRHEVGALVRACKANGVTDLLVVHEHRGTPVGLIVSHLPFGPTAYFTLCNVVMRHDIPDLGTMSEAKPHLITHGFSSRLGKRVSDILRYLFPVPKDDSHRVITFANQDDYISFRHHVYKKTDHRNVELTEVGPRFELKLYMIRLGTLEQEATADVEWRWHPYTNTARKRVFLSTE

SEQ ID NO: 6752 - protein, 797 aa, unidentified
MYLETRRAIFVFWIFLQVQGTKDISINIYHSETKDIDNPPRNETTESTEKMYKMSTMRRIFDLAKHRTKRSAFFPTGVKVCPQESMKQILDSLQAYYRLRVCQEAVWEAYRIFLDRIPDTGEYQDWVSICQQETFCLFDIGKNFSNSQEHLDLLQQRIKQRSFPDRKDEISAEKTLGEPGETIVISTDVANVSLGPFPLTPDDTLLNEILDNTLNDTKMPTTERETEFAVLEEQRVELSVSLVNQKFKAELADSQSPYYQELAGKSQLQMQKIFKKLPGFKKIHVLGFRPKKEKDGSSSTEMQLTAIFKRHSAEAKSPASDLLSFDSNKIESEEVYHGTMEEDKQPEIYLTATDLKRLISKALEEEQSLDVGTIQFTDEIAGSLPAFGPDTQSELPTSFAVITEDATLSPELPPVEPQLETVDGAEHGLPDTSWSPPAMASTSLSEAPPFFMASSIFSLTDQGTTDTMATDQTMLVPGLTIPTSDYSAISQLALGISHPPASSDDSRSSAGGEDMVRHLDEMDLSDTPAPSEVPELSEYVSVPDHFLEDTTPVSALQYITTSSMTIAPKGRELVVFFSLRVANMAFSNDLFNKSSLEYRALEQQFTQLLVPYLRSNLTGFKQLEILNFRNGSVIVNSKMKFAKSVPYNLTKAVHGVLEDFRSAAAQQLHLEIDSYSLNIEPADQADPCKFLACGEFAQCVKNERTEEAECRCKPGYDSQGSLDGLEPGLCGPGTKECEVLQGKGAPCRLPDHSENQAYKTSVKKFQNQQNNKVISKRNSELLTVEYEEFNHQDWEGN

SEQ ID NO: 6753 - protein, 366 aa, unidentified
MVLHLLLFLLLTPQGGHSCQGLELARELVLAKVRALFLDALGPPAVTREGGDPGVRRLPRRHALGGFTHRGSEPEEEEDVSQAILFPATDASCEDKSAARGLAQEAEEGLFRYMFRPSQHTRSRQVTSAQLWFHTGLDRQGTAASNSSEPLLGLLALSPGGPVAVPMSLGHAPPHWAVLHLATSALSLLTHPVLVLLLRCPLCTCSARPEATPFLVAHTRTRPPSGGERARRSTPLMSWPWSPSALRLLQRPPEEPAAHANCHRVALNISFQELGWERWIVYPPSFIFHYCHGGCGLHIPPNLSLPVPGAPPTPAQPYSLLPGAQPCCAALPGTMRPLHVRTTSDGGYSFKYETVPNLLTQHCACI

SEQ ID NO: 6754 - protein, 426 aa, unidentified
MPLLWLRGFLLASCWIIVRSSPTPGSEGHSAAPDCPSCALAALPKDVPNSQPEMVEAVKKHILNMLHLKKRPDVTQPVPKAALLNAIRKLHVGKVGENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRRGLECDGKVNICCKKQFFVSFKDIGWNDWIIAPSGYHANYCEGECPSHIAGTSGSSLSFHSTVINHYRMRGHSPFANLKSCCVPTKLRPMSMLYYDDGQNIIKKDIQNMIVEECGCS

SEQ ID NO: 6755 - protein, 407 aa, unidentified
MDGLPGRALGAACLLLLAAGWLGPEAWGSPTPPPTPAAPPPPPPPGSPGGSQDTCTSCGGFRRPEELGRVDGDFLEAVKRHILSRLQMRGRPNITHAVPKAAMVTALRKLHAGKVREDGRVEIPHLDGHASPGADGQERVSEIISFAETDGLASSRVRLYFFISNEGNQNLFVVQASLWLYLKLLPYVLEKGSRRKVRVKVYFQEQGHGDRWNMVEKRVDLKRSGWHTFPLTEAIQALFERGERRLNLDVQCDSCQELAVVPVFVDPGEESHRPFVVVQARLGDSRHRIRKRGLECDGRTNLCCRQQFFIDFRLIGWNDWIIAPTGYYGNYCEGSCPAYLAGVPGSASSFHTAVVNQYRMRGLNPGTVNSCCIPTKLSTMSMLYFDDEYNIVKRDVPNMIVEECGCA

SEQ ID NO: 6756 - protein, 352 aa, unidentified
MTSSLLLAFLLLAPTTVATPRAGGQCPACGGPTLELESQRELLLDLAKRSILDKLHLTQRPTLNRPVSRAALRTALQHLHGVPQGALLEDNREQECEIISFAETGLSTINQTRLDFHFSSDRTAGDREVQQASLMFFVQLPSNTTWTLKVRVLVLGPHNTNLTLATQYLLEVDASGWHQLPLGPEAQAACSQGHLTLELVLEGQVAQSSVILGGAAHRPFVAARVRVGGKHQIHRRGIDCQGGSRMCCRQEFFVDFREIGWHDWIIQPEGYAMNFCIGQCPLHIAGMPGIAASFHTAVLNLLKANTAAGTTGGGSCCVPTARRPLSLLYYDRDSNIVKTDIPDMVVEACGCS

SEQ ID NO: 6757 - protein, 350 aa, unidentified
MRLPDVQLWLVLLWALVRAQGTGSVCPSCGGSKLAPQAERALVLELAKQQILDGLHLTSRPRITHPPPQAALTRALRRLQPGSVAPGNGEEVISFATVTDSTSAYSSLLTFHLSTPRSHHLYHARLWLHVLPTLPGTLCLRIFRWGPRRRRQGSRTLLAEHHITNLGWHTLTLPSSGLRGEKSGVLKLQLDCRPLEGNSTVTGQPRRLLDTAGHQQPFLELKIRANEPGAGRARRRTPTCEPATPLCCRRDHYVDFQELGWRDWILQPEGYQLNYCSGQCPPHLAGSPGIAASFHSAVFSLLKANNPWPASTSCCVPTARRPLSLLYLDHNGNVVKTDVPDMVVEACGCS

SEQ ID NO: 6758 - protein, 412 aa, unidentified
MAGKAAAPGTAVLLVTANVGSLFDDPENLQKNWLREFYQVVHTHKPHFMALHCQEFGGKNYEASMSHVDKFVKELLSSDAMKEYNRARVYLDENYKSQEHFTALGSFYFLHESLKNIYQFDFKAKKYRKVAGKEIYSDTLESTPMLEKEKFPQDYFPECKWSRKGFIRTRWCIADCAFDLVNIHLFHDASNLVAWETSPSVYSGIRHKALGYVLDRIIDQRFEKVSYFVFGDFNFRLDSKSVVETLCTKATMQTVRAADTNEVVKLIFRESDNDRKVMLQLEKKLFDYFNQEVFRDNNGTALLEFDKELSVFKDRLYELDISFPPSYPYSEDARQGEQYMNTRCPAWCDRILMSPSAKELVLRSESEEKVVTYDHIGPNVCMGDHKPVFLAFRIMPGAGKPHAHVHKCCVVQ

SEQ ID NO: 6759 - protein, 110 aa, unidentified
MALWMRLLPLLALLALWGPDPAAAFVNQHLCGSHLVEALYLVCGERGFFYTPKTRREAEDLQVGQVELGGGPGAGSLQPLALEGSLQKRGIVEQCCTSICSLYQLENYCN

SEQ ID NO: 6760 - protein, 200 aa, unidentified
MALWMRLLPLLALLALWGPDPAAAFVNQHLCGSHLVEALYLVCGERGFFYTPKTRREAEDLQASALSLSSSTSTWPEGLDATARAPPALVVTANIGQAGGSSSRQFRQRALGTSDSPVLFIHCPGAAGTAQGLEYRGRRVTTELVWEEVDSSPQPQGSESLPAQPPAQPAPQPEPQQAREPSPEVSCCGLWPRRPQRSQN

SEQ ID NO: 6761 - protein, 131 aa, unidentified
MDPRLPAWALVLLGPALVFALGPAPTPEMREKLCGHHFVRALVRVCGGPRWSTEARRPATGGDRELLQWLERRHLLHGLVADSNLTLGPGLQPLPQTSHHHRHHRAAATNPARYCCLSGCTQQDLLTLCPY

SEQ ID NO: 6762 - protein, 139 aa, unidentified
MASLFRSYLPAIWLLLSQLLRESLAAELRGCGPRFGKHLLSYCPMPEKTFTTTPGGWLLESGRPKEMVSTSNNKDGQALGTTSEFIPNLSPELKKPLSEGQPSLKKIILSRKKRSGRHRFDPFCCEVICDDGTSVKLCT

SEQ ID NO: 6763 - protein, 135 aa, unidentified
MKGSIFTLFLFSVLFAISEVRSKESVRLCGLEYIRTVIYICASSRWRRHQEGIPQAQQAETGNSFQLPHKREFSEENPAQNLPKVDASGEDRLWGGQMPTEELWKSKKHSVMSRQDLQTLCCTDGCSMTDLSALC

SEQ ID NO: 6764 - protein, 213 aa, unidentified
MPRLLRLSLLWLGLLLVRFSRELSDISSARKLCGRYLVKEIEKLCGHANWSQFRFEEETPFSRLIAQASEKVEAYSPYQFESPQTASPARGRGTNPVSTSWEEAVNSWEMQSLPEYKDKKGYSPLGKTREFSSSHNINVYIHENAKFQKKRRNKIKTLSNLFWGHHPQRKRRGYSEKCCLTGCTKEELSIACLPYIDFKRLKEKRSSLVTKIY

SEQ ID NO: 6765 - protein, 1043 aa, unidentified
MELQKGKGAAAAAAASGAAGGGGGGAGAGAPGGGRLLLSTSLDAKDELEERLERCMSIVTSMTAGVSEREANDALNAYVCKGLPQHEEICLGLFTLILTEPAQAQKCYRDLALVSRDGMNIVLNKINQILMEKYLKLQDTCRTQLVWLVRELVKSGVLGADGVCMTFMKQIAGGGDVTAKNIWLAESVLDILTEQREWVLKSSILIAMAVYTYLRLIVDHHGTAQLQALRQKEVDFCISLLRERFMECLMIGRDLVRLLQNVARIPEFELLWKDIIHNPQALSPQFTGILQLLQSRTSRKFLACRLTPDMETKLLFMTSRVRFGQQKRYQDWFQRQYLSTPDSQSLRCDLIRYICGVVHPSNEVLSSDILPRWAIIGWLLTTCTSNVAASNAKLALFYDWLFFSPDKDSIMNIEPAILVMHHSMKPHPAITATLLDFMCRIIPNFYPPLEGHVRQGVFSSLNHIVEKRVLAHLAPLFDNPKLDKELRAMLREKFPEFCSSPSPPVEVKIEEPVSMEMDNHMSDKDESCYDNAEAAFSDDEEDLNSKGKKREFRFHPIKETVVEEPVDITPYLDQLDESLRDKVLQLQKGSDTEAQCEVMQEIVDQVLEEDFDSEQLSVLASCLQELFKAHFRGEVLPEEITEESLEESVGKPLYLIFRNLCQMQEDNSSFSLLLDLLSELYQKQPKIGYHLLYYLRASKAAAGKMNLYESFAQATQLGDLHTCLMMDMKACQEDDVRLLCHLTPSIYTEFPDETLRSGELLNMIVAVIDSAQLQELVCHVMMGNLVMFRKDSVLNILIQSLDWETFEQYCAWQLFLAHNIPLETIIPILQHLKYKEHPEALSCLLLQLRREKPSEEMVKMVLSRPCHPDDQFTTSILRHWCMKHDELLAEHIKSLLIKNNSLPRKRQSLRSSSSKLAQLTLEQILEHLDNLRLNLTNTKQNFFSQTPILQALQHVQASCDEAHKMKFSDLFSLAEEYEDSSTKPPKSRRKAALSSPRSRKNATQPPNAEEESGSSSASEEEDTKPKPTKRKRKGSSAVGSDSD

SEQ ID NO: 6766 - protein, 975 aa, unidentified
MDLNSASTVVLQVLTQATSQDTAVLKPAEEQLKQWETQPGFYSVLLNIFTNHTLDINVRWLAVLYFKHGIDRYWRRVAPHALSEEEKTTLRAGLITNFNEPINQIATQIAVLIAKVARLDCPRQWPELIPTLIESVKVQDDLRQHRALLTFYHVTKTLASKRLAADRKLFYDLASGIYNFACSLWNHHTDTFLQEVSSGNEAAILSSLERTLLSLKVLRKLTVNGFVEPHKNMEVMGFLHGIFERLKQFLECSRSIGTDNVCRDRLEKTIILFTKVLLDFLDQHPFSFTPLIQRSLEFSVSYVFTEVGEGVTFERFIVQCMNLIKMIVKNYAYKPSKNFEDSSPETLEAHKIKMAFFTYPTLTEICRRLVSHYFLLTEEELTMWEEDPEGFTVEETGGDSWKYSLRPCTEVLFIDIFHEYNQTLTPVLLEMMQTLQGPTNVEDMNALLIKDAVYNAVGLAAYELFDSVDFDQWFKNQLLPELQVIHNRYKPLRRRVIWLIGQWISVKFKSDLRPMLYEAICNLLQDQDLVVRIETATTLKLTVDDFEFRTDQFLPYLETMFTLLFQLLQQVTECDTKMHVLHVLSCVIERVNMQIRPYVGCLVQYLPLLWKQSEEHNMLRCAILTTLIHLVQGLGADSKNLYPFLLPVIQLSTDVSQPPHVYLLEDGLELWLVTLENSPCITPELLRIFQNMSPLLELSSENLRTCFKIINGYIFLSSTEFLQTYAVGLCQSFCELLKEITTEGQVQVLKVVENALKVNPILGPQMFQPILPYVFKGIIEGERYPVVMSTYLGVMGRVLLQNTSFFSSLLNEMAHKFNQEMDQLLGNMIEMWVDRMDNITQPERRKLSALALLSLLPSDNSVIQDKFCGIINISVEGLHDVMTEDPETGTYKDCMLMSHLEEPKVTEDEEPPTEQDKRKKMLALKDPVHTVSLQQFIYEKLKAQQEMLGEQGFQSLMETVDTEIVTQLQEFLQGF

SEQ ID NO: 6767 - protein, 1041 aa, unidentified
MAAAAAAGAASGLPGPVAQGLKEALVDTLTGILSPVQEVRAAAEEQIKVLEVTEEFGVHLAELTVDPQGALAIRQLASVILKQYVETHWCAQSEKFRPPETTERAKIVIRELLPNGLRESISKVRSSVAYAVSAIAHWDWPEAWPQLFNLLMEMLVSGDLNAVHGAMRVLTEFTREVTDTQMPLVAPVILPEMYKIFTMAEVYGIRTRSRAVEIFTTCAHMICNMEELEKGAAKVLIFPVVQQFTEAFVQALQIPDGPTSDSGFKMEVLKAVTALVKNFPKHMVSSMQQILPIVWNTLTESAAFYVRTEVNYTEEVEDPVDSDGEVLGFENLVFSIFEFVHALLENSKFKSTVKKALPELIYYIILYMQITEEQIKVWTANPQQFVEDEDDDTFSYTVRIAAQDLLLAVATDFQNESAAALAAAATRHLQEAEQTKNSGTEHWWKIHEACMLALGSVKAIITDSVKNGRIHFDMHGFLTNVILADLNLSVSPFLLGRALWAASRFTVAMSPELIQQFLQATVSGLHETQPPSVRISAVRAIWGYCDQLKVSESTHVLQPFLPSILDGLIHLAAQFSSEVLNLVMETLCIVCTVDPEFTASMESKICPFTIAIFLKYSNDPVVASLAQDIFKELSQIEACQGPMQMRLIPTLVSIMQAPADKIPAGLCATAIDILTTVVRNTKPPLSQLLICQAFPAVAQCTLHTDDNATMQNGGECLRAYVSVTLEQVAQWHDEQGHNGLWYVMQVVSQLLDPRTSEFTAAFVGRLVSTLISKAGRELGENLDQILRAILSKMQQAETLSVMQSLIMVFAHLVHTQLEPLLEFLCSLPGPTGKPALEFVMAEWTSRQHLFYGQYEGKVSSVALCKLLQHGINADDKRLQDIRVKGEEIYSMDEGIRTRSKSAKNPERWTNIPLLVKILKLIINELSNVMEANAARQATPAEWSQDDSNDMWEDQEEEEEEEEDGLAGQLLSDILATSKYEEDYYEDDEEDDPDALKDPLYQIDLQAYLTDFLCQFAQQPCYIMFSGHLNDNERRVLQTIGI

SEQ ID NO: 6768 - protein, 596 aa, unidentified
MAGNCGARGALSAHTLLFDLPPALLGELCAVLDSCDGALGWRGLAERLSSSWLDVRHIEKYVDQGKSGTRELLWSWAQKNKTIGDLLQVLQEMGHRRAIHLITNYGAVLSPSEKSYQEGGFPNILFKETANVTVDNVLIPEHNEKGILLKSSISFQNIIEGTRNFHKDFLIGEGEIFEVYRVEIQNLTYAVKLFKQEKKMQCKKHWKRFLSELEVLLLFHHPNILELAAYFTETEKFCLIYPYMRNGTLFDRLQCVGDTAPLPWHIRIGILIGISKAIHYLHNVQPCSVICGSISSANILLDDQFQPKLTDFAMAHFRSHLEHQSCTINMTSSSSKHLWYMPEEYIRQGKLSIKTDVYSFGIVIMEVLTGCRVVLDDPKHIQLRDLLRELMEKRGLDSCLSFLDKKVPPCPRNFSAKLFCLAGRCAATRAKLRPSMDEVLNTLESTQASLYFAEDPPTSLKSFRCPSPLFLENVPSIPVEDDESQNNNLLPSDEGLRIDRMTQKTPFECSQSEVMFLSLDKKPESKRNEEACNMPSSSCEESWFPKYIVPSQDLRPYKVNIDPSSEAPGHSCRSRPVESSCSSKFSWDEYEQYKKE

SEQ ID NO: 6769 - protein, 1257 aa, unidentified
MASCSFTRDQATRRLRGAAAAAAAALAAVVTTPLLSSGTPTALIGTGSSCPGAMWLSTATGSRSDSESEEEDLPVGEEVCKRGYLRKQKHGHRRYFVLKLETADAPARLEYYENARKFRHSVRAAAAAAAAAASGAAIPPLIPPRRVITLYQCFSVSQRADARYRHLIALFTQDEYFAMVAENESEQESWYLLLSRLILESKRRRCGTLGAQPDGEPAALAAAAAAEPPFYKDVWQVIVKPRGLGHRKELSGVFRLCLTDEEVVFVRLNTEVASVVVQLLSIRRCGHSEQYFFLEVGRSTVIGPGELWMQVDDCVVAQNMHELFLEKMRALCADEYRARCRSYSISIGAHLLTLLSARRHLGLVPLEPGGWLRRSRFEQFCHLRAIGDGEDEMLFTRRFVTPSEPVAHSRRGRLHLPRGRRSRRAVSVPASFFRRLAPSPARPRHPAEAPNNGARLSSEVSGSGSGNFGEEGNPQGKEDQEGSGGDYMPMNNWGSGNGRGSGGGQGSNGQGSSSHSSGGNQCSGEGQGSRGGQGSNGQGSGGNQCSRDGQGTAGGHGSGGGQRPGGGHGSGGGQGPGDGHGSGGGKNSGGGKGSGSGKGSDGDGERGKSLKKRSYFGKLTQSKQQQMPPPPPPPPPPPPAGGTGGKGKSGGRFRLYFCVDRGATKECKEAKEVKDAEIPEGAARGPHRARAFDEDEDDPYVPMRPGVATPLVSSSDYMPMAPQNVSASKKRHSRSPFEDSRGYMMMFPRVSPPPAPSPPKAPDTNKEDDSKDNDSESDYMFMAPGAGAIPKNPRNPQGGSSSKSWSSYFSLPNPFRSSPLGQNDNSEYVPMLPGKFLGRGLDKEVSYNWDPKDAASKPSGEGSFSKPGDGGSPSKPSDHEPPKNKAKRPNRLSFITKGYKIKPKPQKPTHEQREADSSSDYVNMDFTKRESNTPAPSTQGLPDSWGIIAEPRQSAFSNYVNVEFGVPFPNPANDLSDLLRAIPRANPLSLDSARWPLPPLPLSATGSNAIEEEGDYIEVIFNSAMTPAMALADSAIRYDAETGRIYVVDPFSECCMDISLSPSRCSEPPPVARLLQEEEQERRRPQSRSQSFFAAARAAVSAFPTDSLERDLSPSSAPAVASAAEPTLALSQVVAAASALAAAPGIGAAAAAAGFDSASARWFQPVANAADAEAVRGAQDVAGGSNPGAHNPSANLARGDNQAGGAAAAAAAPEPPPRSRRVPRPPEREDSDNDDDTHVRMDFARRDNQFDSPKRGR

SEQ ID NO: 6770 - protein, 428 aa, unidentified
MQELHLLWWALLLGLAQACPEPCDCGEKYGFQIADCAYRDLESVPPGFPANVTTLSLSANRLPGLPEGAFREVPLLQSLWLAHNEIRTVAAGALASLSHLKSLDLSHNLISDFAWSDLHNLSALQLLKMDSNELTFIPRDAFRSLRALRSLQLNHNRLHTLAEGTFTPLTALSHLQINENPFDCTCGIVWLKTWALTTAVSIPEQDNIACTSPHVLKGTPLSRLPPLPCSAPSVQLSYQPSQDGAELRPGFVLALHCDVDGQPAPQLHWHIQIPSGIVEITSPNVGTDGRALPGTPVASSQPRFQAFANGSLLIPDFGKLEEGTYSCLATNELGSAESSVDVALATPGEGGEDTLGRRFHGKAVEGKGCYTVDNEVQPSGPEDNVVIIYLSRAGNPEAAVAEGVPGQLPPGLLLLGQSLLLFFFLTSF

SEQ ID NO: 6771 - protein, 745 aa, unidentified; identical to SEQ ID NO: 2128

SEQ ID NO: 6772 - protein, 464 aa, unidentified
MVRLAAELLLLLGLLLLTLHITVLRGSGAADGPDAAAGNASQAQLQNNLNVGSDTTSETSFSLSKEAPREHLDHQAAHQPFPRPRFRQETGHPSLQRDFPRSFLLDLPNFPDLSKADINGQNPNIQVTIEVVDGPDSEADKDQHPENKPSWSVPSPDWRAWWQRSLSLARANSGDQDYKYDSTSDDSNFLNPPRGWDHTAPGHRTFETKDQPEYDSTDGEGDWSLWSVCSVTCGNGNQKRTRSCGYACTATESRTCDRPNCPGIEDTFRTAATEVSLLAGSEEFNATKLFEVDTDSCERWMSCKSEFLKKYMHKVMNDLPSCPCSYPTEVAYSTADIFDRIKRKDFRWKDASGPKEKLEIYKPTARYCIRSMLSLESTTLAAQHCCYGDNMQLITRGKGAGTPNLISTEFSAELHYKVDVLPWIICKGDWSRYNEARPPNNGQKCTESPSDEDYIKQFQEAREY

SEQ ID NO: 6773 - protein, 571 aa, unidentified
MRALRDRAGLLLCVLLLAALLEAALGLPVKKPRLRGPRPGSLTRLAEVSASPDPRPLKEEEEAPLLPRTHLQAEPHQHGCWTVTEPAAMTPGNATPPRTPEVTPLRLELQKLPGLANTTLSTPNPDTQASASPDPRPLREEEEARLLPRTHLQAELHQHGCWTVTEPAALTPGNATPPRTQEVTPLLLELQKLPELVHATLSTPNPDNQVTIKVVEDPQAEVSIDLLAEPSNPPPQDTLSWLPALWSFLWGDYKGEEKDRAPGEKGEEKEEDEDYPSEDIEGEDQEDKEEDEEEQALWFNGTTDNWDQGWLAPGDWVFKDSVSYDYEPQKEWSPWSPCSGNCSTGKQQRTRPCGYGCTATETRTCDLPSCPGTEDKDTLGLPSEEWKLLARNATDMHDQDVDSCEKWLNCKSDFLIKYLSQMLRDLPSCPCAYPLEAMDSPVSLQDEHQGRSFRWRDASGPRERLDIYQPTARFCLRSMLSGESSTLAAQHCCYDEDSRLLTRGKGAGMPNLISTDFSPKLHFKFDTTPWILCKGDWSRLHAVLPPNNGRACTDNPLEEEYLAQLQEAKEY

SEQ ID NO: 6774 - protein, 1032 aa, unidentified [sequence omitted]

SEQ ID NO: 6775 - protein, 1035 aa, unidentified; identical to SEQ ID NO: 2141

SEQ ID NO: 6776 - protein, 1170 aa, unidentified; identical to SEQ ID NO: 2144

SEQ ID NO: 6777 - protein, 1163 aa, unidentified; identical to SEQ ID NO: 2147

SEQ ID NO: 6778 - protein, 798 aa, unidentified; identical to SEQ ID NO: 2148

SEQ ID NO: 6779 - protein, 769 aa, unidentified; identical to SEQ ID NO: 2149

SEQ ID NO: 6780 - protein, 788 aa, unidentified; identical to SEQ ID NO: 2150

SEQ ID NO: 6781 - protein, 798 aa, unidentified; identical to SEQ ID NO: 2154

SEQ ID NO: 6782 - protein, 494 aa, unidentified
MRPPGFRNFLLLASSLLFAGLSAVPQSFSPSLRSWPGAACRLSRAESERRCRAPGQPPGAALCHGRGRCDCGVCICHVTEPGMFFGPLCECHEWVCETYDGSTCAGHGKCDCGKCKCDQGWYGDACQYPTNCDLTKKKSNQMCKNSQDIICSNAGTCHCGRCKCDNSDGSGLVYGKFCECDDRECIDDETEEICGGHGKCYCGNCYCKAGWHGDKCEFQCDITPWESKRRCTSPDGKICSNRGTCVCGECTCHDVDPTGDWGDIHGDTCECDERDCRAVYDRYSDDFCSGHGQCNCGRCDCKAGWYGKKCEHPQSCTLSAEESIRKCQGSSDLPCSGRGKCECGKCTCYPPGDRRVYGKTCECDDRRCEDLDGVVCGGHGTCSCGRCVCERGWFGKLCQHPRKCNMTEEQSKNLCESADGILCSGKGSCHCGKCICSAEEWYISGEFCDCDDRDCDKHDGLICTGNGICSCGNCECWDGWNGNACEIWLGSEYP

SEQ ID NO: 6783 - protein, 911 aa, unidentified
MDGAMGPRGLLLCMYLVSLLILQAMPALGSATGRSKSSEKRQAVDTAVDGVFIRSLKVNCKVTSRFAHYVVTSQVVNTANEAREVAFDLEIPKTAFISDFAVTADGNAFIGDIKDKVTAWKQYRKAAISGENAGLVRASGRTMEQFTIHLTVNPQSKVTFQLTYEEVLKRNHMQYEIVIKVKPKQLVHHFEIDVDIFEPQGISKLDAQASFLPKELAAQTIKKSFSGKKGHVLFRPTVSQQQSCPTCSTSLLNGHFKVTYDVSRDKICDLLVANNHFAHFFAPQNLTNMNKNVVFVIDISGSMRGQKVKQTKEALLKILGDMQPGDYFDLVLFGTRVQSWKGSLVQASEANLQAAQDFVRGFSLDEATNLNGGLLRGIEILNQVQESLPELSNHASILIMLTDGDPTEGVTDRSQILKNVRNAIRGRFPLYNLGFGHNVDFNFLEVMSMENNGRAQRIYEDHDATQQLQGFYSQVAKPLLVDVDLQYPQDAVLALTQNHHKQYYEGSEIVVAGRIADNKQSSFKADVQAHGEGQEFSITCLVDEEEMKKLLRERGHMLENHVERLWAYLTIQELLAKRMKVDREERANLSSQALQMSLDYGFVTPLTSMSIRGMADQDGLKPTIDKPSEDSPPLEMLGPRRTFVLSALQPSPTHSSSNTQRLPDRVTGVDTDPHFIIHVPQKEDTLCFNINEEPGVILSLVQDPNTGFSVNGQLIGNKARSPGQHDGTYFGRLGIANPATDFQLEVTPQNITLNPGFGGPVFSWRDQAVLRQDGVVVTINKKRNLVVSVDDGGTFEVVLHRVWKGSSVHQDFLGFYVLDSHRMSARTHGLLGQFFHPIGFEVSDIHPGSDPTKPDATMVVRNRRLTVTRGLQKDYSKDPWHGAEVSCWFIHNNGAGLIDGAYTDYIVPDIF

SEQ ID NO: 6784 - protein, 946 aa, unidentified
MKRLTCFFICFFLSEVSGFEIPINGLSEFVDYEDLVELAPGKFQLVAENRRYQRSLPGESEEMMEEVDQVTLYSYKVQSTITSRMATTMIQSKVVNNSPQPQNVVFDVQIPKGAFISNFSMTVDGKTFRSSIKEKTVGRALYAQARAKGKTAGLVRSSALDMENFRTEVNVLPGAKVQFELHYQEVKWRKLGSYEHRIYLQPGRLAKHLEVDVWVIEPQGLRFLHVPDTFEGHFDGVPVISKGQQKAHVSFKPTVAQQRICPNCRETAVDGELVVLYDVKREEKAGELEVFNGYFVHFFAPDNLDPIPKNILFVIDVSGSMWGVKMKQTVEAMKTILDDLRAEDHFSVIDFNQNIRTWRNDLISATKTQVADAKRYIEKIQPSGGTNINEALLRAIFILNEANNLGLLDPNSVSLIILVSDGDPTVGELKLSKIQKNVKENIQDNISLFSLGMGFDVDYDFLKRLSNENHGIAQRIYGNQDTSSQLKKFYNQVSTPLLRNVQFNYPHTSVTDVTQNNFHNYFGGSEIVVAGKFDPAKLDQIESVITATSANTQLVLETLAQMDDLQDFLSKDKHADPDFTRKLWAYLTINQLLAERSLAPTAAAKRRITRSILQMSLDHHIVTPLTSLVIENEAGDERMLADAPPQDPSCCSGALYYGSKVVPDSTPSWANPSPTPVISMLAQGSQVLESTPPPHVMRVENDPHFIIYLPKSQKNICFNIDSEPGKILNLVSDPESGIVVNGQLVGAKKPNNGKLSTYFGKLGFYFQSEDIKIEISTETITLSHGSSTFSLSWSDTAQVTNQRVQISVKKEKVVTITLDKEMSFSVLLHRVWKKHPVNVDFLGIYIPPTNKFSPKAHGLIGQFMQEPKIHIFNERPGKDPEKPEASMEVKGQKLIITRGLQKDYRTDLVFGTDVTCWFVHNSGKGFIDGHYKDYFVPQLYSFLKRP

SEQ ID NO: 6785 - protein, 890 aa, unidentified
MAFAWWPCLILALLSSLAASGFPRSPFRLLGKRSLPEGVANGIEVYSTKINSKVTSRFAHNVVTMRAVNRADTAKEVSFDVELPKTAFITNFTLTIDGVTYPGNVKEKEVAKKQYEKAVSQGKTAGLVKASGRKLEKFTVSVNVAAGSKVTFELTYEELLKRHKGKYEMYLKVQPKQLVKHFEIEVDIFEPQGISMLDAEASFITNDLLGSALTKSFSGKKGHVSFKPSLDQQRSCPTCTDSLLNGDFTITYDVNRESPGNVQIVNGYFVHFFAPQGLPVVPKNVAFVIDISGSMAGRKLEQTKEALLRILEDMQEEDYLNFILFSGDVSTWKEHLVQATPENLQEARTFVKSMEDKGMTNINDGLLRGISMLNKAREEHRIPERSTSIVIMLTDGDANVGESRPEKIQENVRNAIGGKFPLYNLGFGNNLNYNFLENMALENHGFARRIYEDSDADLQLQGFYEEVANPLLTGVEMEYPENAILDLTQNTYQHFYDGSEIVVAGRLVDEDMNSFKADVKGHGATNDLTFTEEVDMKEMEKALQERDYIFGNYIERLWAYLTIEQLLEKRKNAHGEEKENLTARALDLSLKYHFVTPLTSMVVTKPEDNEDERAIADKPGEDAEATPVSPAMSYLTSYQPPQNPYYYVDGDPHFIIQIPEKDDALCFNIDEAPGTVLRLIQDAVTGLTVNGQITGDKRGSPDSKTRKTYFGKLGIANAQMDFQVEVTTEKITLWNRAVPSTFSWLDTVTVTQDGLSMMINRKNMVVSFGDGVTFVVVLHQVWKKHPVHRDFLGFYVVDSHRMSAQTHGLLGQFFQPFDFKVSDIRPGSDPTKPDATLVVKNHQLIVTRGSQKDYRKDASIGTKVVCWFVHNNGEGLIDGVHTDYIVPNLF

SEQ ID NO: 6786 - protein, 930 aa, unidentified
MKPPRPVRTCSKVLVLLSLLAIHQTTTAEKNGIDIYSLTVDSRVSSRFAHTVVTSRVVNRANTVQEATFQMELPKKAFITNFSMIIDGMTYPGIIKEKAEAQAQYSAAVAKGKSAGLVKATGRNMEQFQVSVSVAPNAKITFELVYEELLKRRLGVYELLLKVRPQQLVKHLQMDIHIFEPQGISFLETESTFMTNQLVDALTTWQNKTKAHIRFKPTLSQQQKSPEQQETVLDGNLIIRYDVDRAISGGSIQIENGYFVHYFAPEGLTTMPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSEMVVAGKLQDRGPDVLTATVSGKLPTQNITFQTESSVAEQEAEFQSPKYIFHNFMERLWAYLTIQQLLEQTVSASDADQQALRNQALNLSLAYSFVTPLTSMVVTKPDDQEQSQVAEKPMEGESRNRNVHSGSTFFKYYLQGAKIPKPEASFSPRRGWNRQAGAAGSRMNFRPGVLSSRQLGLPGPPDVPDHAAYHPFRRLAILPASAPPATSNPDPAVSRVMNMKIEETTMTTQTPAPIQAPSAILPLPGQSVERLCVDPRHRQGPVNLLSDPEQGVEVTGQYEREKAGFSWIEVTFKNPLVWVHASPEHVVVTRNRRSSAYKWKETLFSVMPGLKMTMDKTGLLLLSDPDKVTIGLLFWDGRGEGLRLLLRDTDRFSSHVGGTLGQFYQEVLWGSPAASDDGRRTLRVQGNDHSATRERRLDYQEGPPGVEISCWSVEL

SEQ ID NO: 6787 - protein, 942 aa, unidentified
MLLLLGLCLGLSLCVGSQEEAQSWGHSSEQDGLRVPRQVRLLQRLKTKPLMTEFSVKSTIISRYAFTTVSCRMLNRASEDQDIEFQMQIPAAAFITNFTMLIGDKVYQGEITEREKKSGDRVKEKRNKTTEENGEKGTEIFRASAVIPSKDKAAFFLSYEELLQRRLGKYEHSISVRPQQLSGRLSVDVNILESAGIASLEVLPLHNSRQRGSGRGEDDSGPPPSTVINQNETFANIIFKPTVVQQARIAQNGILGDFIIRYDVNREQSIGDIQVLNGYFVHYFAPKDLPPLPKNVVFVLDSSASMVGTKLRQTKDALFTILHDLRPQDRFSIIGFSNRIKVWKDHLISVTPDSIRDGKVYIHHMSPTGGTDINGALQRAIRLLNKYVAHSGIGDRSVSLIVFLTDGKPTVGETHTLKILNNTREAARGQVCIFTIGIGNDVDFRLLEKLSLENCGLTRRVHEEEDAGSQLIGFYDEIRTPLLSDIRIDYPPSSVVQATKTLFPNYFNGSEIIIAGKLVDRKLDHLHVEVTASNSKKFIILKTDVPVRPQKAGKDVTGSPRPGGDGEGDTNHIERLWSYLTTKELLSSWLQSDDEPEKERLRQRAQALAVSYRFLTPFTSMKLRGPVPRMDGLEEAHGMSAAMGPEPVVQSVRGAGTQPGPLLKKPYQPRIKISKTSVDGDPHFVVDFPLSRLTVCFNIDGQPGDILRLVSDHRDSGVTVNGELIGAPAPPNGHKKQRTYLRTITILINKPERSYLEITPSRVILDGGDRLVLPCNQSVVVGSWGLEVSVSANANVTVTIQGSIAFVILIHLYKKPAPFQRHHLGFYIANSEGLSSNCHGLLGQFLNQDARLTEDPAGPSQNLTHPLLLQVGEGPEAVLTVKGHQVPVVWKQRKIYNGEEQIDCWFARNNAAKLIDGEYKDYLAFHPFDTGMTLGQGMSREL

SEQ ID NO: 6788 - protein, 1313 aa, unidentified
MSGWRYLICVSFLLTILLELTYQGPPVPASSSTKLLMTSYSMRSTVVSRYAHTLVTSVLFNPHAEAHEAIFDLDLPHLAFISNFTMTINNKVYIAEVKEKHQAKKIYEEAHQQGKTAAHVGIRDRESEKFRISTSLAAGTEVTFSLAYEELLQRHQGQYQLVVSLRPGQLVKRLSIEVTVSERTGISYVHIPPLRTGRLRTNAHASEVDSPPSTRIERGETCVRITYCPTLQDQSSISGSGIMADFLVQYDVVMEDIIGDVQIYDDYFIHYFAPRGLPPMEKNVVFVIDVSSSMFGTKMEQTKTAMNVILSDLQANDYFNIISFSDTVNVWKAGGSIQATIQNVHSAKDYLHCMEADGWTDVNSALLAAASVLNHSNQEPGRGPSVGRIPLIIFLTDGEPTAGVTTPSVILSNVRQALGHRVSLFSLAFGDDADFTLLRRLSLENRGIARRIYEDTDAALQLKGLYEEISMPLLADVRLNYLGGLVGASPWAVFPNYFGGSELVVAGQVQPGKQELGIHLAARGPKDQLLVAHHSEGATNNSQKAFGCPGEPAPNVAHFIRRLWAYVTIGELLDAHFQARDTTTRHLLAAKVLNLSLEYNFVTPLTSLVMVQPKQASEETRRQTSTSAGPDTIMPSSSSRHGLGVSTAQPALVPKVISPKSRPVKPKFYLSSTTTASTKKMLSSKELEPLGESPHTLSMPTYPKAKIPAQQDSGTLAQPTLRTKPTILVPSNSGTLLPLKPGSLSHQNPDILPTNSRTQVPPVKPGIPASPKADTVKCVTPLHSKPGAPSHPQLGALTSQAPKGLPQSRPGVSTLQVPKYPLHTRPRVPAPKTRNNMPHLGPGILLSKTPKILLSLKPSAPPHQISTSISLSKPETPNPHMPQTPLPPRPDRPRPPLPESLSTFPNTISSSTGPSSTTTTSVLGEPLPMPFTPTLPPGRFWHQYDLLPGPQRTRQVLGPSRPGVPTMSLLNSSRPTPEGSPPNLPILLPSSILPEAISLLLLPEELELLSESMVESKFVESLNPPAFYTFLTPDEDGSPNWDGNSEEILGGAGGSMESQGSSVGLAKGTLPSIFTFSSSVDGDPHFVIQIPHSEEKICFTLNGHPGDLLQLIEDPKAGLHVSGKLLGAPPRPGHKDQTRTYFQIITVTTDKPRAYTITISRSSISLRGEGTLRLSWDQPALLKRPQLELYVAAAARLTLRLGPYLEFLVLRHRYRHPSTLQLPHLGFYVANGSGLSPSARGLIGQFQHADIRLVTGPMGPCLRRHHGPDVPVILGKRLLKDSPRLLPRWASCWLVKRSHVELLLGHPYLSYVL

SEQ ID NO: 6789 - protein, 313 aa, unidentified
MNQLSFLLFLIATTRGWSTDEANTYFKEWTCSSSPSLPRSCKEIKDECPSAFDGLYFLRTENGVIYQTFCDMTSGGGGWTLVASVHENDMRGKCTVGDRWSSQQGSKAVYPEGDGNWANYNTFGSAEAATSDDYKNPGYYDIQAKDLGIWHVPNKSPMQHWRNSSLLRYRTDTGFLQTLGHNLFGIYQKYPVKYGEGKCWTDNGPVIPVVYDFGDAQKTASYYSPYGQREFTAGFVQFRVFNNERAANALCAGMRVTGCNTEHHCIGGGGYFPEASPQQCGDFSGFDWSGYGTHVGYSSSREITEAAVLLFYR

SEQ ID NO: 6790 - protein, 325 aa, unidentified
MLSMLRTMTRLCFLLFFSVATSGCSAAAASSLEMLSREFETCAFSFSSLPRSCKEIKERCHSAGDGLYFLRTKNGVVYQTFCDMTSGGGGWTLVASVHENDMRGKCTVGDRWSSQQGNKADYPEGDGNWANYNTFGSAEAATSDDYKNPGYYDIQAKDLGIWHVPNKSPMQHWRNSALLRYRTNTGFLQRLGHNLFGIYQKYPVKYRSGKCWNDNGPAIPVVYDFGDAKKTASYYSPYGQREFVAGFVQFRVFNNERAANALCAGIKVTGCNTEHHCIGGGGFFPQGKPRQCGDFSAFDWDGYGTHVKSSCSREITEAAVLLFYR

SEQ ID NO: 6791 - protein, 250 aa, unidentified
MACWWPLLLELWTVMPTWAGDELLNICMNAKHHKRVPSPEDKLYEECIPWKDNACCTLTTSWEAHLDVSPLYNFSLFHCGLLMPGCRKHFIQAICFYECSPNLGPWIQPVGSLGWEVAPSGQGERVVNVPLCQEDCEEWWEDCRMSYTCKSNWRGGWDWSQGKNRCPKGAQCLPFSHYFPTPADLCEKTWSNSFKASPERRNSGRCLQKWFEPAQGNPNVAVARLFASSAPSWELSYTIMVCSLFLPFLS

SEQ ID NO: 6792 - protein, 232 aa, unidentified
MALLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGYFPNELRNIFREQVHLIQNAIIESRIDCQHRCGIFQYETISCNNCTDSHVACFGYNCESSAQWKSAVQGLLNYINNWHKQDTSMRPRSSAFSWPGTHRATPAFLVSPALRCLEPPHLANLTLEDAAECLKQH

SEQ ID NO: 6793 - protein, 394 aa, unidentified; identical to SEQ ID NO: 2178

SEQ ID NO: 6794 - protein, 159 aa, unidentified
MKNHLLFWGVLAVFIKAVHVKAQEDERIVLVDNKCKCARITSRIIRSSEDPNEDIVERNIRIIVPLNNRENISDPTSPLRTRFVYHLSDLCKKCDPTEVELDNQIVTATQSNICDEDSATETCYTYDRNKCYTAVVPLVYGGETKMVETALTPDACYPD

SEQ ID NO: 6795 - protein, 264 aa, unidentified
MAPASRLLALWALAAVALPGSGAEGDGGWRPGGPGAVAEEERCTVERRADLTYAEFVQQYAFVRPVILQGLTDNSRFRALCSRDRLLASFGDRVVRLSTANTYSYHKVDLPFQEYVEQLLHPQDPTSLGNDTLYFFGDNNFTEWASLFRHYSPPPFGLLGTAPAYSFGIAGAGSGVPFHWHGPGYSEVIYGRKRWFLYPPEKTPEFHPNKTTLAWLRDTYPALPPSARPLECTIRAGEVLYFPDRWWHATLNLDTSVFISTFLG

SEQ ID NO: 6796 - protein, 492 aa, unidentified
MNRIRIHVLPTNRGRITPVPRSQEPLSCAFTHRPCSHPRLEGQEFCIKHILEDKNAPFKQCSYISTKNGKRCPNAAPKPEKKDGVSFCAEHVRRNALALHAQMKKTNPGPVGETLLCQLSSYAKTELGSQTPESSRSEASRILDEDSWSDGEQEPITVDQTWRGDPDSEADSIDSDQEDPLKHAGVYTAEEVALIMREKLIRLQSLYIDQFKRLQHLLKEKKRRYLHNRKVEHEALGSSLLTGPEGLLAKERENLKRLKCLRRYRQRYGVEALLHRQLKERRMLATDGAAQQAHTTRSSQRCLAFVDDVRCSNQSLPMTRHCLTHICQDTNQVLFKCCQGSEEVPCNKPVPVSLSEDPCCPLHFQLPPQMYKPEQVLSVPDDLEAGPMDLYLSAAELQPTESLPLEFSDDLDVVGDGMQCPPSPLLFDPSLTLEDHLVKEIAEDPVDILGQMQMAGDGCRSQGSRNSEKASAPLSQSGLATANGKPEPTSIS

SEQ ID NO: 6797 - protein, 304 aa, unidentified
MLPPPRPAAALALPVLLLLLVVLTPPPTGARPSPGPDYLRRGWMRLLAEGEGCAPCRPEECAAPRGCLAGRVRDACGCCWECANLEGQLCDLDPSAHFYGHCGEQLECRLDTGGDLSRGEVPEPLCACRSQSPLCGSDGHTYSQICRLQEAARARPDANLTVAHPGPCESGPQIVSHPYDTWNVTGQDVIFGCEVFAYPMASIEWRKDGLDIQLPGDDPHISVQFRGGPQRFEVTGWLQIQAVRPSDEGTYRCLGRNALGQVEAPASLTVLTPDQLNSTGIPQLRSLNLVPEEEAESEENDDYY

SEQ ID NO: 6798 - protein, 256 aa, unidentified
MQPAKEVTKASDGSLLGDLGHTPLSKKEGIKWQRPRLSRQALMRCCLVKWILSSTAPQGSDSSDSELELSTVRHQPEGLDQLQAQTKFTKKELQSLYRGFKNECPTGLVDEDTFKLIYAQFFPQGDATTYAHFLFNAFDADGNGAIHFEDFVVGLSILLRGTVHEKLKWAFNLYDINKDGYITKEEMLAIMKSIYDMMGRHTYPILREDAPAEHVERFFEKMDRNQDGVVTIEEFLEACQKDENIMSSMQLFENVI

SEQ ID NO: 6799 - protein, 307 aa, unidentified; identical to SEQ ID NO: 2248

SEQ ID NO: 6800 - protein, 427 aa, unidentified; identical to SEQ ID NO: 2258

SEQ ID NO: 6801 - protein, 1149 aa, unidentified; identical to SEQ ID NO: 2269

SEQ ID NO: 6802 - protein, 502 aa, unidentified
MFGTLLLYCFFLATVPALAETGGERQLSPEKSEIWGPGLKADVVLPARYFYIQAVDTSGNKFTSSPGEKVFQVKVSAPEEQFTRVGVQVLDRKDGSFIVRYRMYASYKNLKVEIKFQGQHVAKSPYILKGPVYHENCDCPLQDSAAWLREMNCPETIAQIQRDLAHFPAVDPEKIAVEIPKRFGQRQSLCHYTLKDNKVYIKTHGEHVGFRIFMDAILLSLTRKVKMPDVELFVNLGDWPLEKKKSNSNIHPIFSWCGSTDSKDIVMPTYDLTDSVLETMGRVSLDMMSVQANTGPPWESKNSTAVWRGRDSRKERLELVKLSRKHPELIDAAFTNFFFFKHDENLYGPIVKHISFFDFFKHKYQINIDGTVAAYRLPYLLVGDSVVLKQDSIYYEHFYNELQPWKHYIPVKSNLSDLLEKLKWAKDHDEEAKKIAKAGQEFARNNLMGDDIFCYYFKLFQEYANLQVSEPQIREGMKRVEPQTEDDLFPCTCHRKKTKDEL

SEQ ID NO: 6803 - protein, 507 aa, unidentified
MRRLPRALLLQLRLALLVAAGAPEVLVSAPRSLVWGPGLQAAVVLPVRYFYLQAVNSEGQNLTRSPAGETPFKVVVKSLSPKELVRIHVPKPLDRNDGTFLMRYRMYETVDEGLKIEVLYGDEHVAQSPYILKGPVYHEYCECPEDPQAWQKTLSCPTKEPQIAKDFASFPSINLQQMLKEVPKRFGDERGAIVHYTILNNHVYRRSLGKYTDFKMFSDEILLSLTRKVLLPDLEFYVNLGDWPLEHRKVNGTPSPIPIISWCGSLDSRDVVLPTYDITHSMLEAMRGVTNDLLSIQGNTGPSWINKTERAFFRGRDSREERLQLVQLSKENPQLLDAGITGYFFFQEKEKELGKAKLMGFFDFFKYKYQVNVDGTVAAYRYPYLMLGDSLVLKQDSPYYEHFYMALEPWKHYVPIKRNLSDLLEKVKWAKENDEEAKKIAKEGQLMARDLLQPHRLYCYYYQVLQKYAERQSSKPEVRDGMELVPQPEDSTAICQCHRKKPSREEL

SEQ ID NO: 6804 - protein, 852 aa, unidentified
MLSGKKAAAAAAAAAAAATGTEAGPGTAGGSENGSEVAAQPAGLSGPAEVGPGAVGERTPRKKEPPRASPPGGLAEPPGSAGPQAGPTVVPGSATPMETGIAETPEGRRTSRRKRAKVEYREMDESLANLSEDEYYSEEERNAKAEKEKKLPPPPPQAPPEEENESEPEEPSGVEGAAFQSRLPHDRMTSQEAACFPDIISGPQQTQKVFLFIRNRTLQLWLDNPKIQLTFEATLQQLEAPYNSDTVLVHRVHSYLERHGLINFGIYKRIKPLPTKKTGKVIIIGSGVSGLAAARQLQSFGMDVTLLEARDRVGGRVATFRKGNYVADLGAMVVTGLGGNPMAVVSKQVNMELAKIKQKCPLYEANGQAVPKEKDEMVEQEFNRLLEATSYLSHQLDFNVLNNKPVSLGQALEVVIQLQEKHVKDEQIEHWKKIVKTQEELKELLNKMVNLKEKIKELHQQYKEASEVKPPRDITAEFLVKSKHRDLTALCKEYDELAETQGKLEEKLQELEANPPSDVYLSSRDRQILDWHFANLEFANATPLSTLSLKHWDQDDDFEFTGSHLTVRNGYSCVPVALAEGLDIKLNTAVRQVRYTASGCEVIAVNTRSTSQTFIYKCDAVLCTLPLGVLKQQPPAVQFVPPLPEWKTSAVQRMGFGNLNKVVLCFDRVFWDPSVNLFGHVGSTTASRGELFLFWNLYKAPILLALVAGEAAGIMENISDDVIVGRCLAILKGIFGSSAVPQPKETVVSRWRADPWARGSYSYVAAGSSGNDYDLMAQPITPGPSIPGAPQPIPRLFFAGEHTIRNYPATVHGALLSGLREAGRIADQFLGAMYTLPRQATPGVPAQQSPSM

SEQ ID NO: 6805 - protein, 1761 aa, unidentified
MADAAASPVGKRLLLLFADTAASASASAPAAAAASGDPGPALRTRAWRAGTVRAMSGAVPQDLAIFVEFDGCNWKQHSWVKVHAEEVIVLLLEGSLVWAPREDPVLLQGIRVSIAQWPALTFTPLVDKLGLGSVVPVEYLLDRELRFLSDANGLHLFQMGTDSQNQILLEHAALRETVNALISDQKLQEIFSRGPYSVQGHRVKIYQPEGEEGWLYGVVSHQDSITRLMEVSVTESGEIKSVDPRLIHVMLMDNSAPQSEGGTLKAVKSSKGKKKRESIEGKDGRRRKSASDSGCDPASKKLKGDRGEVDSNGSDGGEASRGPWKGGNASGEPGLDQRAKQPPSTFVPQINRNIRFATYTKENGRTLVVQDEPVGGDTPASFTPYSTATGQTPLAPEVGGAENKEAGKTLEQVGQGIVASAAVVTTASSTPNTVRISDTGLAAGTVPEKQKGSRSQASGENSRNSILASSGFGAPLPSSSQPLTFGSGRSQSNGVLATENKPLGFSFGCSSAQEAQKDTDLSKNLFFQCMSQTLPTSNYFTTVSESLADDSSSRDSFKQSLESLSSGLCKGRSVLGTDTKPGSKAGSSVDRKVPAESMPTLTPAFPRSLLNARTPENHENLFLQPPKLSREEPSNPFLAFVEKVEHSPFSSFASQASGSSSSATTVTSKVAPSWPESHSSADSASLAKKKPLFITTDSSKLVSGVLGSALTSGGPSLSAMGNGRSSSPTSSLTQPIEMPTLSSSPTEERPTVGPGQQDNPLLKTFSNVFGRHSGGFLSSPADFSQENKAPFEAVKRFSLDERSLACRQDSDSSTNSDLSDLSDSEEQLQAKTGLKGIPEHLMGKLGPNGERSAELLLGKSKGKQAPKGRPRTAPLKVGQSVLKDVSKVKKLKQSGEPFLQDGSCINVAPHLHKCRECRLERYRKFKEQEQDDSTVACRFFHFRRLIFTRKGVLRVEGFLSPQQSDPDAMNLWIPSSSLAEGIDLETSKYILANVGDQFCQLVMSEKEAMMMVEPHQKVAWKRAVRGVREMCDVCETTLFNIHWVCRKCGFGVCLDCYRLRKSRPRSETEEMGDEEVFSWLKCAKGQSHEPENLMPTQIIPGTALYNIGDMVHAARGKWGIKANCPCISRQNKSVLRPAVTNGMSQLPSINPSASSGNETTFSGGGGPAPVTTPEPDHVPKADSTDIRSEEPLKTDSSASNSNSELKAIRPPCPDTAPPSSALHWLADLATQKAKEETKEAGSLRSVLNKESHSPFGLDSFNSTAKVSPLTPKLFNSLLLGPTASNNKTEGSSLRDLLHSGPGKLPQTPLDTGIPFPPVFSTSSAGVKSKASLPNFLDHIIASVVENKKTSDASKRACNLTDTQKEVKEMVMGLNVLDPHTSHSWLCDGRLLCLHDPSNKNNWKIFRECWKQGQPVLVSGVHKKLKSELWKPEAFSQEFGDQDVDLVNCRNCAIISDVKVRDFWDGFEIICKRLRSEDGQPMVLKLKDWPPGEDFRDMMPTRFEDLMENLPLPEYTKRDGRLNLASRLPSYFVRPDLGPKMYNAYGLITAEDRRVGTTNLHLDVSDAVNVMVYVGIPIGEGAHDEEVLKTIDEGDADEVTKQRIHDGKEKPGALWHIYAAKDAEKIRELLRKVGEEQGQENPPDHDPIHDQSWYLDQTLRKRLYEEYGVQGWAIVQFLGDAVFIPAGAPHQVHNLYSCIKVAEDFVSPEHVKHCFRLTQEFRHLSNTHTNHEDKLQVKNIIYHAVKDAVGTLKAHESKLARS

SEQ ID NO: 6806 - protein, 1401 aa, unidentified
MKSCGVSLATAAAAAAAFGDEEKKMAAGKASGESEEASPSLTAEEREALGGLDSRLFGFVRFHEDGARTKALLGKAVRCYESLILKAEGKVESDFFCQLGHFNLLLEDYPKALSAYQRYYSLQSDYWKNAAFLYGLGLVYFHYNAFQWAIKAFQEVLYVDPSFCRAKEIHLRLGLMFKVNTDYESSLKHFQLALVDCNPCTLSNAEIQFHIAHLYETQRKYHSAKEAYEQLLQTENLSAQVKATVLQQLGWMHHTVDLLGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNATRSKSCSNTSALAARIKYLQAQLCNLPQGSLQNKTKLLPSIEEAWSLPIPAELTSRQGAMNTAQQNTSDNWSGGHAVSHPPVQQQAHSWCLTPQKLQHLEQLRANRNNLNPAQKLMLEQLESQFVLMQQHQMRPTGVAQVRSTGIPNGPTADSSLPTNSVSGQQPQLALTRVPSVSQPGVRPACPGQPLANGPFSAGHVPCSTSRTLGSTDTILIGNNHITGSGSNGNVPYLQRNALTLPHNRTNLTSSAEEPWKNQLSNSTQGLHKGQSSHSAGPNGERPLSSTGPSQHLQAAGSGIQNQNGHPTLPSNSVTQGAALNHLSSHTATSGGQQGITLTKESKPSGNILTVPETSRHTGETPNSTASVEGLPNHVHQMTADAVCSPSHGDSKSPGLLSSDNPQLSALLMGKANNNVGTGTCDKVNNIHPAVHTKTDNSVASSPSSAISTATPSPKSTEQTTTNSVTSLNSPHSGLHTINGEGMEESQSPMKTDLLLVNHKPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGRRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQSVKSIVPMVHLSWNMARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 6807 - protein, 941 aa, unidentified
MAGAAAAVAAGAAAGAAAAAVSVAAPGRASAPPPPPPVYCVCRQPYDVNRFMIECDICKDWFHGSCVGVEEHHAVDIDLYHCPNCAVLHGSSLMKKRRNWHRHDYTEIDDGSKPVQAGTRTFIKELRSRVFPSADEIIIKMHGSQLTQRYLEKHGFDVPIMVPKLDDLGLRLPSPTFSVMDVERYVGGDKVIDVIDVARQADSKMTLHNYVKYFMNPNRPKVLNVISLEFSDTKMSELVEVPDIAKKLSWVENYWPDDSVFPKPFVQKYCLMGVQDSYTDFHIDFGGTSVWYHVLWGEKIFYLIKPTDENLARYESWSSSVTQSEVFFGDKVDKCYKCVVKQGHTLFVPTGWIHAVLTSQDCMAFGGNFLHNLNIGMQLRCYEMEKRLKTPDLFKFPFFEAICWFVAKNLLETLKELREDGFQPQTYLVQGVKALHTALKLWMKKELVSEHAFEIPDNVRPGHLIKELSKVIRAIEEENGKPVKSQGIPIVCPVSRSSNEATSPYHSRRKMRKLRDHNVRTPSNLDILELHTREVLKRLEMCPWEEDILSSKLNGKFNKHLQPSSTVPEWRAKDNDLRLLLTNGRIIKDERQPFADQSLYTADSENEEDKRRTKKAKMKIEESSGVEGVEHEESQKPLNGFFTRVKSELRSRSSGYSDISESEDSGPECTALKSIFTTEESESSGDEKKQEITSNFKEESNVMRNFLQKSQKPSRSEIPIKRECPTSTSTEEEAIQGMLSMAGLHYSTCLQRQIQSTDCSGERNSLQDPSSCHGSNHEVRQLYRYDKPVECGYHVKTEDPDLRTSSWIKQFDTSRFHPQDLSRSQKCIRKEGSSEISQRVQSRNYVDSSGSSLQNGKYMQNSNLTSGACQISNGSLSPERPVGETSFSVPLHPTKRPASNPPPISNQATKGKRPKKGMATAKQRLGKILKLNRNGHARFFV

SEQ ID NO: 6808 - protein, 332 aa, unidentified; identical to SEQ ID NO: 2278

SEQ ID NO: 6809 - protein, 352 aa, unidentified
MAGTICFIMWVLFITDTVWSRSVRQVYEVHDSDDWTIHDFECPMECFCPPSFPTALYCENRGLKEIPAIPSRIWYLYLQNNLIETIPEKPFENATQLRWINLNKNKITNYGIEKGALSQLKKLLFLFLEDNELEEVPSPLPRSLEQLQLARNKVSRIPQGTFSNLENLTLLDLQNNKLVDNAFQRDTFKGLKNLMQLNMAKNALRNMPPRLPANTMQLFLDNNSIEGIPENYFNVIPKVAFLRLNHNKLSDEGLPSRGFDVSSILDLQLSHNQLTKVPRISAHLQHLHLDHNKIKSVNVSVICPSPSMLPAERDSFSYGPHLRYLRLDGNEIKPPIPMALMTCFRLLQAVII

SEQ ID NO: 6810 - protein, 2235 aa, unidentified
MPLFFSALLVLLLVALSALFLGRWLVVRLATKWCQRKLQAELKIGSFRFFWIQNVSLKFQQHQQTVEIDNLWISSKLLSHDLPHYVALCFGEVRIRTDLQKVSDLSAPFSQSAGVDQKELSFSPSLLKIFCQLFSIHVDAINIMVLKVDTSESLWHIQISRSRFLLDSDGKRLICEVSLCKINSKVLKSGQLEDTCLVELSLALDLCLKVGISSRHLTAITVDVWTLHAELHEGLFQSQLLCQGPSLASKPVPCSEVTENLVEPTLPGLFLLQQLPDQVKVKMENTSVVLSMNSQKRHLTWTLKLLQFLYHRDEDQLPLRSFTANSDMAQMSTELLLEDGLLLSQSRQRIVCLNSLKASVQVTTIDLSASLVLNTCIIHYRHQEFSHWLHLLALETQGSSSPVLKQRKKRTFPQILAPIIFSTSISNVNISIQLGDTPPFALGFNSISLDYQHLRPQSIHQRGVLTVDHLCWRVGSDSHIQRAPHPPNMHVWGEALVLDSFTLQGSYNQPLGLSSTQSDTLFLDCTIRGLQVEASDTCAQCLSRILSLMGPQSGKSAVSRHSSFGESVSLLWKVDLKVEDMNLFTLSALVGASEVRLDTLTILGSAETSTVGIQGLVLALVKSVTEKMQPCCKAPDIPTPVLSLSMLSITYHSSIRSLEVQCGAGLTLLWSPPDHMYLYQHVLATLQCRDLLRATVFPETVPSLALETSGTTSELEGRAPEPLPPKRLLNLTLEVSTAKLTAFVAEDKFITLAAESVSLSRHGGSLQAYCPELAAGFDGNSIFNFKEVEVQLLPELEEMILHRNPFPALQTLRNRVWLLSFGSVSVEFPYQYDFSRTLDEAVGVQKWLKGLHQGTRAWASPSPVPLPPDLLLKVEHFSWVFLDDVFEVKLHDNYELMKDESKESAKRLQLLDAKVAALRKQHGELLPARKIEELYASLERKNIEIYIQRSRRLYGNTPMRRALLTWSLAGLELVALADASFHGPEHVVEQVQELDPGSPFPPEGLDLVIQWCRMLKCNVKSFLVRIRDYPRYLFEIRDWRLMGRLVGTEQSGQPCSRRRQILHLGLPWGNVAVERNMPPLKFYHDFHSEIFQYTVVWGPCWDPAWTLIGQCVDLLTKPSADPSPPLPWWDKSRLLFHGDWHMDIEQANLHQLATEDPYNTTENMHWEWSHLSFHWKPGQFVFKGDLDINVRTASKYDDCCFLHLPDLCMTLDLQWLCHGNPHDHHSVTLRAPEFLPEVPLGQLHDSYRAFRSENLNLSIKMDLTRHSGTISQPRILLYSSTLRWMQNFWATWTSVTRPICRGKLFNNLKPSKKKLGQHYKQLSYTALFPQLQVHYWASFAQQRGIQIECSQGHVFTRGTQRLIPQAGTVMRRLISDWSVTQMVSDLSQVTVHLMASPTEENADHCLDPLVTKTHLLSLSSLTYQRHSNRTAEEELSARDGDPTFHTHQLHLVDLRISWTTTNRDIAFGLYDGYKKAAVLKRNLSTEALKGLKIDPQMPAKKPKRGVPTSASAPPRVNTPSFSGQPDKGSSGGAYMLQKLIEETDRFVVFTEEESGMSDQLCGIAACQTDDIYNRNCLIELVNCQMVLRGAETEGCVIVSAAKAQLLQCQHHPAWYGDTLKQKTSWTCLLDGMQYFATTESSPTEQDGRQLWLEVKNIEEHRQRSLDSVQELMESGQAVGGMVTTTTDWNQPAEAQQAQQVQRIISRCNCRMYYISYSHDIDPELATQIKPPEVLENQEKEDLLKKQEGAVDTFTLIHHELEISTNPAQYAMILDIVNNLLLHVEPKRKEHSEKKQRVRFQLEISSNPEEQRSSILHLQEAVRQHVAQIRQLEKQMYSIMKSLQDDSKNENLLDLNQKLQLQLNQEKANLQLESEELNILIRCFKDFQLQRANKMELRKQQEDVSVVRRTEFYFAQARWRLTEEDGQLGIAELELQRFLYSKVNKSDDTAEHLLELGWFTMNNLLPNAVYKVVLRPQSSCQSGRQLALRLFSKVRPPVGGISVKEHFEVNVVPLTIQLTHQFFHRMMGFFFPGRSVEDDEVGDEEDKSKLVTTGIPVVKPRQLIATDDAVPLGPGKGVAQGLTRSSGVRRSFRKSPEHPVDDIDKMKERAAMNNSFIYIKIPQVPLCVSYKGEKNSVDWGDLNLVLPCLEYHNNTWTWLDFAMAVKRDSRKALVAQVIKEKLRLKSATGSEVRGKLETKSDLNMQQQEEEEKARLLIGLSVGDKNPGKKSIFGRRK

SEQ ID NO: 6811 - protein, 1072 aa, unidentified; identical to SEQ ID NO: 2281

SEQ ID NO: 6812 - protein, 1013 aa, unidentified; identical to SEQ ID NO: 2288

SEQ ID NO: 6813 - protein, 838 aa, unidentified
MYAFYSLLIYIFYSLFRRDGGAAAAAEPGDPAQRARKPRGRRRPDLPAPELWTELTGLAASSEPEDGSEGAAEGRAAAVSLEEALLRLAEFLSVQLGAEESCGGPADLGQSGEVPSLLTVTSQLLALLAWLRSPRGRQALLQGTQPAPRVRPPSPDGSTSQEESPSHFTAVPGEPLGDETQGQQPLQLEEDQRAWQRLEQLILGQLEELKQQLEQQEEELGRLRLGVGATDSEKRVQHLTLENEALKQSLSLMRDLLLHWGPGPPIRAPQEEAEALLELQGRLQEAQDTTEALRAQLGVQEVQLQGLQGALQQLQQETEQNCRRELQQMHGQLAGLRARMASLRQGCGDLRGLVSTFTQSCQGSLSEARGQVSWALGALSSGGPGTQLPEGQQGPPAGCPGRLPELKGNIRVLCRLRPGTSSSLVSVEPGPGGTVTTCYRGRHRRFRLDWVFPPDASQEEVFRELEPAVLSCLRGYSVCIFTYGQTGTGKTYSMEGPPEDPGIVPRALQSLFREMGAGRQHRVTLSMVEIYNEAVRDLLAPGPPERLAVRQGPEGQGGIQVAGLTHWDVPNLETLHQMLKLGRSNRATAATAMNQRSSRSHALVTLTLRAASPPRAPGTAGTLHLVDLAGSERARKAGAAGPPRGDPDGARRLREAQTINRSLLALGGVMAALRAHRPHVPFRDSQLTRLLQPALGPGTTAVLLLQVGAGAGQVCACRSPPTRARPPAPLARRSPRGRRISGRQSAPSSSPTEWVKWSWGQPGAAGSRAPPGRLLPSAPTLRSPGPPAPLRRPLAVLHAPVPTTARARLSRPQRACPSSPGSRPCPWGLRPGLCWQRR

SEQ ID NO: 6814 - protein, 377 aa, unidentified; identical to SEQ ID NO: 2299

SEQ ID NO: 6815 - protein, 708 aa, unidentified; identical to SEQ ID NO: 2304

SEQ ID NO: 6816 - protein, 138 aa, unidentified
MNSLVSWQLLLFLCATHFGEPLEKVASVGNSRPTGQQLESLGLLAPGEQSLPCTERKPAATARLSRRGTSLSPPPESSGSPQQPGLSAPHSRQIPAPQGAVLVQREKDLPNYNWNSFGLRFGKREAAPGNHGRSAGRG

SEQ ID NO: 6817 - protein, 708 aa, unidentified
MAAAAVAAAAAAAAAASLQVLEMESMETAAAGSAGLAAEVRGSGTVDFGPGPGISAMEASGGDPGPEAEDFECSSHCSELSWRQNEQRRQGLFCDITLCFGGAGGREFRAHRSVLAAATEYFTPLLSGQFSESRSGRVEMRKWSSEPGPEPDTVEAVIEYMYTGRIRVSTGSVHEVLELADRFLLIRLKEFCGEFLKKKLHLSNCVAIHSLAHMYTLSQLALKAADMIRRNFHKVIQDEEFYTLPFHLIRDWLSDLEITVDSEEVLFETVLKWVQRNAEERERYFEELFKLLRLSQMKPTYLTRHVKPERLVANNEVCVKLVADAVERHALRAENIQSGTCQHPTSHVSLLPRYGQNMDVIMVIGGVSEGGDYLSECVGYFVDEDRWVNLPHIHNHLDGHAVAVTESYVYVAGSMEPGFAKTVERYNPNLNTWEHVCSLMTRKHSFGLTEVKGKLYSIGGHGNFSPGFKDVTVYNPELDKWHNLESAPKILRDVKALAIEDRFVYIAARTPVDRDTEDGLKAVITCYDTETRQWQDVESLPLIDNYCFFQMSVVNSNFYQTASCCPKSYCLENEEAVRKIASQVSDEILESLPPEVLSIEGAAICYYKDDVFIIGGWKNSDDIDKQYRKEAYRYCAERKRWMLLPPMPQPRCRATACHVRIPYRYLHGTQRYPMPQNLMWQKDRIRQMQEIHRHALNMRRVPSSQIEC

SEQ ID NO: 6818 - protein, 634 aa, unidentified
MAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQIPEIIHFCCDFLMSWVDEENILDVYRLAELFDLSRLTEQLDTYILKNFVAFSRTDKYRQLPLEKVYSLLSSNRLEVSCETEVYEGALLYHYSLEQVQADQISLHEPPKLLETVRFPLMEAEVLQRLHDKLDPSPLRDTVASALMYHRNESLQPSLQSPQTELRSDFQCVVGFGGIHSTPSTVLSDQAKYLNPLLGEWKHFTASLAPRMSNQGIAVLNNFVYLIGGDNNVQGFRAESRCWRYDPRHNRWFQIQSLQQEHADLSVCVVGRYIYAVAGRDYHNDLNAVERYDPATNSWAYVAPLKREVYAHAGATLEGKMYITCGRRGEDYLKETHCYDPGSNTWHTLADGPVRRAWHGMATLLNKLYVIGGSNNDAGYRRDVHQVACYSCTSGQWSSVCPLPAGHGEPGIAVLDNRIYVLGGRSHNRGSRTGYVHIYDVEKDCWEEGPQLDNSISGLAACVLTLPRSLLLEPPRGTPDRSQADPDFASEVMSVSDWEEFDNSSED

SEQ ID NO: 6819 - protein, 262 aa, unidentified
MWFLVLCLALSLGGTGAAPPIQSRIVGGWECEQHSQPWQAALYHFSTFQCGGILVHRQWVLTAAHCISDNYQLWLGRHNLFDDENTAQFVHVSESFPHPGFNMSLLENHTRQADEDYSHDLMLLRLTEPADTITDAVKVVELPTEEPEVGSTCLASGWGSIEPENFSFPDDLQCVDLKILPNDECKKAHVQKVTDFMLCVGHLEGGKDTCVGDSGGPLMCDGVLQGVTSWGYVPCGTPNKPSVAVRVLSYVKWIEDTIAENS

SEQ ID NO: 6820 - protein, 276 aa, unidentified
MRAPHLHLSAASGARALAKLLPLLMAQLWAAEAALLPQNDTRLDPEAYGSPCARGSQPWQVSLFNGLSFHCAGVLVDQSWVLTAAHCGNKPLWARVGDDHLLLLQGEQLRRTTRSVVHPKYHQGSGPILPRRTDEHDLMLLKLARPVVLGPRVRALQLPYRCAQPGDQCQVAGWGTTAARRVKYNKGLTCSSITILSPKECEVFYPGVVTNNMICAGLDRGQDPCQSDSGGPLVCDETLQGILSWGVYPCGSAQHPAVYTQICKYMSWINKVIRSN

SEQ ID NO: 6821 - protein, 282 aa, unidentified
MQRLRWLRDWKSSGRGLTAAKEPGARSSPLQAMRILQLILLALATGLVGGETRIIKGFECKPHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 6822 - protein, 248 aa, unidentified
MGLSIFLLLCVLGLSQAATPKIFNGTECGRNSQPWQVGLFEGTSLRCGGVLIDHRWVLTAAHCSGSRYWVRLGEHSLSQLDWTEQIRHSGFSVTHPGYLGASTSHEHDLRLLRLRLPVRVTSSVQPLPLPNDCATAGTECHVSGWGITNHPRNPFPDLLQCLNLSIVSHATCHGVYPGRITSNMVCAGGVPGQDACQGDSGGPLVCGGVLQGLVSWGSVGPCGQDGIPGVYTYICKYVDWIRMIMRNN

SEQ ID NO: 6823 - protein, 277 aa, unidentified
MWPLALVIASLTLALSGGVSQESSKVLNTNGTSGFLPGGYTCFPHSQPWQAALLVQGRLLCGGVLVHPKWVLTAAHCLKEGLKVYLGKHALGRVEAGEQVREVVHSIPHPEYRRSPTHLNHDHDIMLLELQSPVQLTGYIQTLPLSHNNRLTPGTTCRVSGWGTTTSPQVNYPKTLQCANIQLRSDEECRQVYPGKITDNMLCAGTKEGGKDSCEGDSGGPLVCNRTLYGIVSWGDFPCGQPDRPGVYTRVSRYVLWIRETIRKYETQQQKWLKGPQ

SEQ ID NO: 6824 - protein, 267 aa, unidentified
MSLRVLGSGTWPSAPKMFLLLTALQVLAIAMTQSQEDENKIIGGHTCTRSSQPWQAALLAGPRRRFLCGGALLSGQWVITAAHCGRPILQVALGKHNLRRWEATQQVLRVVRQVTHPNYNSRTHDNDLMLLQLQQPARIGRAVRPIEVTQACASPGTSCRVSGWGTISSPIARYPASLQCVNINISPDEVCQKAYPRTITPGMVCAGVPQGGKDSCQGDSGGPLVCRGQLQGLVSWGMERCALPGYPGVYTNLCKYRSWIEETMRDK

SEQ ID NO: 6825 - protein, 256 aa, unidentified
MWLLLTLSFLLASTAAQDGDKLLEGDECAPHSQPWQVALYERGRFNCGASLISPHWVLSAAHCQSRFMRVRLGEHNLRKRDGPEQLRTTSRVIPHPRYEARSHRNDIMLLRLVQPARLNPQVRPAVLPTRCPHPGEACVVSGWGLVSHNEPGTAGSPRSQVSLPDTLHCANISIISDTSCDKSYPGRLTNTMVCAGAEGRGAESCEGDSGGPLVCGGILQGIVSWGDVPCDNTTKPGVYTKVCHYLEWIRETMKRN

SEQ ID NO: 6826 - protein, 261 aa, unidentified
MWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGGDSGGPLVCNGVLQGITSWGPEPCALPEKPAVYTKVVHYRKWIKDTIAANP

SEQ ID NO: 6827 - protein, 261 aa, unidentified
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 6828 - protein, 254 aa, unidentified
MATAGNPWGWFLGYLILGVAGSLVSGSCSQIINGEDCSPHSQPWQAALVMENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANGRMPTVLQCVNVSVVSEEVCSKLYDPLYHPSMFCAGGGHDQKDSCNGDSGGPLICNGYLQGLVSFGKAPCGQVGVPGVYTNLCKFTEWIEKTVQAS

SEQ ID NO: 6829 - protein, 293 aa, unidentified
MATARPPWMWVLCALITALLLGVTEHVLANNDVSCDHPSNTVPSGSNQDLGAGAGEDARSDDSSSRIINGSDCDMHTQPWQAALLLRPNQLYCGAVLVHPQWLLTAAHCRKKVFRVRLGHYSLSPVYESGQQMFQGVKSIPHPGYSHPGHSNDLMLIKLNRRIRPTKDVRPINVSSHCPSAGTKCLVSGWGTTKSPQVHFPKVLQCLNISVLSQKRCEDAYPRQIDDTMFCAGDKAGRDSCQGDSGGPVVCNGSLQGLVSWGDYPCARPNRPGVYTNLCKFTKWIQETIQANS

SEQ ID NO: 6830 - protein, 244 aa, unidentified
MKKLMVVLSLIAAAWAEEQNKLVHGGPCDKTSHPYQAALYTSGHLLCGGVLIHPLWVLTAAHCKKPNLQVFLGKHNLRQRESSQEQSSVVRAVIHPDYDAASHDQDIMLLRLARPAKLSELIQPLPLERDCSANTTSCHILGWGKTADGDFPDTIQCAYIHLVSREECEHAYPGQITQNMLCAGDEKYGKDSCQGDSGGPLVCGDHLRGLVSWGNIPCGSKEKPGVYTNVCRYTNWIQKTIQAK

SEQ ID NO: 6831 - protein, 253 aa, unidentified
MARSLLLPLQILLLSLALETAGEEAQGDKIIDGAPCARGSHPWQVALLSGNQLHCGGVLVNERWVLTAAHCKMNEYTVHLGSDTLGDRRAQRIKASKSFRHPGYSTQTHVNDLMLVKLNSQARLSSMVKKVRLPSRCEPPGTTCTVSGWGTTTSPDVTFPSDLMCVDVKLISPQDCTKVYKDLLENSMLCAGIPDSKKNACNGDSGGPLVCRGTLQGLVSWGTFPCGQPNDPGVYTQVCKFTKWINDTMKKHR

SEQ ID NO: 6832 - protein, 260 aa, unidentified
MGRPRPRAAKTWMFLLLLGGAWAGHSRAQEDKVLGGHECQPHSQPWQAALFQGQQLLCGGVLVGGNWVLTAAHCKKPKYTVRLGDHSLQNKDGPEQEIPVVQSIPHPCYNSSDVEDHNHDLMLLQLRDQASLGSKVKPISLADHCTQPGQKCTVSGWGTVTSPRENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 6833 - protein, 250 aa, unidentified
MKLGLLCALLSLLAGHGWADTRAIGAEECRPNSQPWQAGLFHLTRLFCGATLISDRWLLTAAHCRKPYLWVRLGEHHLWKWEGPEQLFRVTDFFPHPGFNKDLSANDHNDDIMLIRLPRQARLSPAVQPLNLSQTCVSPGMQCLISGWGAVSSPKALFPVTLQCANISILENKLCHWAYPGHISDSMLCAGLWEGGRGSCQGDSGGPLVCNGTLAGVVSGGAEPCSRPRRPAVYTSVCHYLDWIQEIMEN

SEQ ID NO: 6834 - protein, 638 aa, unidentified
MILFKQATYFISLFATVSCGCLTQLYENAFFRGGDVASMYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTNNIRCQFFSYATQTFHKAEYRNNCLLKYSPGGTPTAIKVLSNVESGFSLKPCALSEIGCHMNIFQHLAFSDVDVARVLTPDAFVCRTICTYHPNCLFFTFYTNVWKIESQRNVCLLKTSESGTPSSSTPQENTISGYSLLTCKRTLPEPCHSKIYPGVDFGGEELNVTFVKGVNVCQETCTKMIRCQFFTYSLLPEDCKEEKCKCFLRLSMDGSPTRIAYGTQGSSGYSLRLCNTGDNSVCTTKTSTRIVGGTNSSWGEWPWQVSLQVKLTAQRHLCGGSLIGHQWVLTAAHCFDGLPLQDVWRIYSGILNLSDITKDTPFSQIKEIIIHQNYKVSEGNHDIALIKLQAPLNYTEFQKPICLPSKGDTSTIYTNCWVTGWGFSKEKGEIQNILQKVNIPLVTNEECQKRYQDYKITQRMVCAGYKEGGKDACKGDSGGPLVCKHNGMWRLVGITSWGEGCARREQPGVYTKVAEYMDWILEKTQSSDGKAQMQSPA

SEQ ID NO: 6835 - protein, 393 aa, unidentified
MGEGGAAAALVAAAAAAAAAAAAVVAGQRRRRLGRRARCHGPGRAAGGKMSKPCAVEAAAAAVAATAPGPEMVERRGPGRPRTDGENVFTGQSKIYSYMSPNKCSGMRFPLQEENSVTHHEVKCQGKPLAGIYRKREEKRNAGNAVRSAMKSEEQKIKDARKGPLVPFPNQKSEAAEPPKTPPSSCDSTNAAIAKQALKKPIKGKQAPRKKAQGKTQQNRKLTDFYPVRRSSRKSKAELQSEERKRIDELIESGKEEGMKIDLIDGKGRGVIATKQFSRGDFVVEYHGDLIEITDAKKREALYAQDPSTGCYMYYFQYLSKTYCVDATRETNRLGRLINHSKCGNCQTKLHDIDGVPHLILIASRDIAAGEELLYDYGDRSKASIEAHPWLKH

SEQ ID NO: 6836 - protein, 1749 aa, unidentified
MQAMDPAAADLYEEDGKDLDFYDFEPLPTLPEDEENVSLADILSLRDRGLSEQEAWAVCLECSLSMRSVAHAAIFQSLCITPDTLAFNTSGNVCFMEQLSDDPEGAFVPPEFDVTGNTFEAHIYSLGATLKAALEYVAEPTLEPRLSQDLEALLSRMQAEDPGDRPDLESIIALCEEKLQLTSSCRVCRSLSAVGRRVLSIESFGALQDVSESSWRERPAPGNAGPRRPPGDPSTDPEVLPTPEGPESETSRGPRASPTKALLSTPVRNGESHSREGLAGLVLDAERTLGELDRDALRRSRLRKVQTFPRLLSDSPEATLCLPLTRGKSQLPISELFSPDPRKAFLDRKNGLSSFQAQPKCRLWPEQEPEHQLGRVPCAGRSTDRGPGVPGSPGQPETSHPSQGPAEAPADPRDASGEAQTPRDDERIPEGARQLESAAAEQWVSLQDLLSQLGRPFREYELWALCLACLRALQTRPEHPAYLCLDSVLVAEDGAVLFQPPPANGSYDSFFLAPELAEERLVTEKASVYCVAAVLWTAAKFSVPRNHKLALPRRLKTLLLDMARRSAPERPSAAEAIKVCGSYLLQRGMDSRKILAHLRASICQVYQEEETISLQNAFSVVELKPSVAPAPEPSPGFLPVNSDTGLVAVPGPVPGQHPCGEEATQLPAAFTSEATHFKPIVLAQNASVARDQPALAQEESEERGGQREGEGEEKLSLEAHAGSPSLKTPDGPVPGPGPQGAAPEPLGASVQRDSAQGRPCPPPQAPANQPEGASSAAPGSPVPAPPTKASALPVEQGPAEPIPPGVASGGLRPDALGPTTAHHGPRHPPKPPRSKATERPGQEPEGPGATPAGERDDQSPDSVPERPRPADRRLCLPCVDASPLPGRTACPSLQEATRLIQEEFAFDGYLDNGLEALIMGEYIFALKDLTFATFCGAISEKFCDLYWDEKLLQNLFKVVNGQASPSPSTAEEAGSQLEGSQSPRSPSSKRPSLHRLGKEKPAMARTSSRAPCSPTSVSDVDSDALSRGNFEVGFRPQRSVKAERAQQPEAGEDRRPAGGASDVEAVTRLARSKGVGPALSPGPAGFQSCSPGWCSAFYEADCFGADVHNYVKDLGRQQADGALPDAQSPELEQQLMMEKRNYRKTLKFYQKLLQKEKRNKGSDVKTMLSKLKGQLEEMKSRVQFLSLVKKYLQVMYAERWGLEPCTLPVIVNIAAAPCDTLDFSPLDESSSLIFYNVNKHPGGRQKARILQAGTPLGLMAYLYSSDAFLEGYVQQFLYTFRYFCTPHDFLHFLLDRINSTLTRAHQDPTSTFTKIYRRSLCVLQAWVEDCYAVDFPRNSGLLGKLEDFISSKILPLDGSAKHLLGLLEVGMDRRAEGNPRGTDLENPREAEEDARPFNALCKRLSEDGISRKSFPWRLPRGNGLVLPPHKERPYTIAAALPKPCFLEDFYGPCAKTSEKGPYFLTEYSTHQLFSQLTLLQQELFQKCHPVHFLNSRALGVMDKSTAIPKASSSESLSAKTCSLFLPNYVQDKYLLQLLRNADDVSTWVAAEIVTSHTSKLQVNLLSKFLLIAKSCYEQRNFATAMQILSGLEHLAVRQSPAWRILPAKIAEVMEELKAVEVFLKSDSLCLMEGRRFRAQPTLPSAHLLAMHIQQLETGGFTMTNGAHRWSKLRNIAKVVSQVHAFQENPYTFSPDPKLQSYLKQRIARFSGADISTLAADSRANFHQVSSEKHSRKIQDKLRRMKATFQ

SEQ ID NO: 6837 - protein, 644 aa, unidentified
MKLITILFLCSRLLLSLTQESQSEEIDCNDKDLFKAVDAALKKYNSQNQSNNQFVLYRITEATKTVGSDTFYSFKYEIKEGDCPVQSGKTWQDCEYKDAAKAATGECTATVGKRSSTKFSVATQTCQITPAEGPVVTAQYDCLGCVHPISTQSPDLEPILRHGIQYFNNNTQHSSLFMLNEVKRAQRQVVAGLNFRITYSIVQTNCSKENFLFLTPDCKSLWNGDTGECTDNAYIDIQLRIASFSQNCDIYPGKDFVQPPTKICVGCPRDIPTNSPELEETLTHTITKLNAENNATFYFKIDNVKKARVQVVAGKKYFIDFVARETTCSKESNEELTESCETKKLGQSLDCNAEVYVVPWEKKIYPTVNCQPLGMISLMKRPPGFSPFRSSRIGEIKEETTVSPPHTSMAPAQDEERDSGKEQGHTRRHDWGHEKQRKHNLGHGHKHERDQGHGHQRGHGLGHGHEQQHGLGHGHKFKLDDDLEHQGGHVLDHGHKHKHGHGHGKHKNKGKKNGKHNGWKTEHLASSSEDSTTPSAQTQEKTEGPTPIPSLAKPGVTVTFSDFQDSDLIATMMPPISPAPIQSDDDWIPDIQIDPNGLSFNPISDFPDTTSPKCPGRPWKSVSEINPTTQMKESYYFDLTDGLS

SEQ ID NO: 6838 - protein, 492 aa, unidentified
MPSFLVPSLVSSPVLLKLLFSPGPKTIWSLWQQPMLFQEATAFENMTKDWNYLEGSQKDCYRDTMLDSYENTVPQGSFLQLSMMPQRAGNDPPGVSNASEMEMEISNMREKFLMSVTKLVESKSYNSKVFSKEKYFQTIKEVKEAKEKGKKSSRDYRRAAKYDVISVQGTEKLIEATHGERDRIRYYVHKEELFDILHDTHLSIGHGGRTRMLKELQGKYGNVTKEVIVLYLTLCKQCHQKNPVPKRGLAPKPMTFKDIDSTCQVEILDMQSSADGEFKFILYYQDHSTKFIILRPLRTKQAHEVVSVLLDIFTILGTPSVLDSDSGVEFTNQVVHELNELWPDLKIVSGKYHPGQSQGSLEGASRDVKNMISTWMQSNHSCHWAKGLRFMQMVRNQAFDVSLQQSPFEAMFGYKAKFGLYSSNLPRETVATLQTEEELEIAEEQLENSLWIRQEERAEIGADRSDMDDDMDPTPEASEPSTSQGTSGLLCW

SEQ ID NO: 6839 - protein, 462 aa, unidentified; identical to SEQ ID NO: 2327

SEQ ID NO: 6840 - protein, 99 aa, unidentified
MKIPVLPAVVLLSLLVLHSAQGATLGGPEEESTIENYASRPEAFNTPFLNIDKLRSAFKADEFLNWHALFESIKRKLPFLNWDAFPKLKGLRSATPDAQ

SEQ ID NO: 6841 - protein, 1257 aa, unidentified; identical to SEQ ID NO: 2331

SEQ ID NO: 6842 - protein, 705 aa, unidentified
MEKPRSIEETPSSEPMEEEEDDDLELFGGYDSFRSYNSSVGSESSSYLEESSEAENEDREAGELPTSPLHLLSPGTPRSLDGSGSEPAVCEMCGIVGTREAFFSKTKRFCSVSCSRSYSSNSKKASILARLQGKPPTKKAKVLHKAAWSAKIGAFLHSQGTGQLADGTPTGQDALVLGFDWGKFLKDHSYKAAPVSCFKHVPLYDQWEDVMKGMKVEVLNSDAVLPSRVYWIASVIQTAGYRVLLRYEGFENDASHDFWCNLGTVDVHPIGWCAINSKILVPPRTIHAKFTDWKGYLMKRLVGSRTLPVDFHIKMVESMKYPFRQGMRLEVVDKSQVSRTRMAVVDTVIGGRLRLLYEDGDSDDDFWCHMWSPLIHPVGWSRRVGHGIKMSERRSDMAHHPTFRKIYCDAVPYLFKKVRAVYTEGGWFEEGMKLEAIDPLNLGNICVATVCKVLLDGYLMICVDGGPSTDGLDWFCYHASSHAIFPATFCQKNDIELTPPKGYEAQTFNWENYLEKTKSKAAPSRLFNMDCPNHGFKVGMKLEAVDLMEPRLICVATVKRVVHRLLSIHFDGWDSEYDQWVDCESPDIYPVGWCELTGYQLQPPVAAEPATPLKAKEATKKKKKQFGKKRKRIPPTKTRPLRQGSKKPLLEDDPQGARKISSEPVPGEIIAVRVKEEHLDVASPDKASSPELPVSVENIKQETDD

SEQ ID NO: 6843 - protein, 481 aa, unidentified
MAASWSLLVTLRPLAQSPLRGRCVGCGAWAAALAPLATAPGKPFWKAYTVQTSESMTPTATSETYLKALAVCHGPLDHYDFLIKAHELKDDEHQRRVIQCLQKLHEDLKGYNIEAEGLFSKLFSRSKPPRGLYVYGDVGTGKTMVMDMFYAYVEMKRKKRVHFHGFMLDVHKRIHRLKQSLPKRKPGFMAKSYDPIAPIAEEISEEACLLCFDEFQVTDIADAMILKQLFENLFKNGVVVVATSNRPPEDLYKNGLQRANFVPFIAVLKEYCNTVQLDSGIDYRKRELPAAGKLYYLTSEADVEAVMDKLFDELAQKQNDLTRPRILKVQGRELRLNKACGTVADCTFEELCERPLGASDYLELSKNFDTIFLRNIPQFTLANRTQGRRFITLIDNFYDLKVRIICSASTPISSLFLHQHHDSELEQSRILMDDLGLSQDSAEGLSMFTGEEEIFAFQRTISRLTEMQTEQYWNEGDRTKK

SEQ ID NO: 6844 - protein, 138 aa, unidentified
MKFTTLLFLAAVAGALVYAEDASSDSTGADPAQEAGTSKPNEEISGPAEPASPPETTTTAQETSAAAVQGTAKVTSSRQELNPLKSIVEKSILLTEQALAKAGKGMHGGVPGGKQFIENGSEFAQKLLKKFSLLKPWA

SEQ ID NO: 6845 - protein, 547 aa, unidentified
MYRLMSAVTARAAAPGGLASSCGRRGVHQRAGLPPLGHGWVGGLGLGLGLALGVKLAGGLRGAAPAQSPAAPDPEASPLAEPPQEQSLAPWSPQTPAPPCSRCFARAIESSRDLLHRIKDEVGAPGIVVGVSVDGKEVWSEGLGYADVENRVPCKPETVMRIASISKSLTMVALAKLWEAGKLDLDIPVQHYVPEFPEKEYEGEKVSVTTRLLISHLSGIRHYEKDIKKVKEEKAYKALKMMKENVAFEQEKEGKSNEKNDFTKFKTEQENEAKCRNSKPGKKKNDFEQGELYLREKFENSIESLRLFKNDPLFFKPGSQFLYSTFGYTLLAAIVERASGCKYLDYMQKIFHDLDMLTTVQEENEPVIYNRARFYVYNKKKRLVNTPYVDNSYKWAGGGFLSTVGDLLKFGNAMLYGYQVGLFKNSNENLLPGYLKPETMVMMWTPVPNTEMSWDKEGKYAMAWGVVERKQTYGSCRKQRHYASHTGGAVGASSVLLVLPEELDTETINNKVPPRGIIVSIICNMQSVGLNSTALKIALEFDKDRSD

SEQ ID NO: 6846 - protein, 525 aa, unidentified; identical to SEQ ID NO: 2332

SEQ ID NO: 6847 - protein, 152 aa, unidentified
MSPHLTALLGLVLCLAQTIHTQEGALPRPSISAEPGTVISPGSHVTFMCRGPVGVQTFRLEREDRAKYKDSYNVFRLGPSESEARFHIDSVSEGNAGLYRCLYYKPPGWSEHSDFLELLVKESSGGPDSPDTEPGSSAGTVPGTEASGFDAP

SEQ ID NO: 6848 - protein, 142 aa, unidentified
MRFFVPLFLVGILFPAILAKQFTKCELSQLLKDIDGYGGIALPELICTMFHTSGYDTQAIVENNESTEYGLFQISNKLWCKSSQVPQSRNICDISCDKFLDDDITDDIMCAKKILDIKGIDYWLAHKALCTEKLEQWLCEKL

SEQ ID NO: 6849 - protein, 3075 aa, unidentified
MRGGVLLVLLLCVAAQCRQRGLFPAILNLASNAHISTNATCGEKGPEMFCKLVEHVPGRPVRNPQCRICDGNSANPRERHPISHAIDGTNNWWQSPSIQNGREYHWVTITLDLRQVFQVAYVIIKAANAPRPGNWILERSLDGTTFSPWQYYAVSDSECLSRYNITPRRGPPTYRADDEVICTSYYSRLVPLEHGEIHTSLINGRPSADDLSPKLLEFTSARYIRLRLQRIRTLNADLMTLSHREPKELDPIVTRRYYYSIKDISVGGMCICYGHASSCPWDETTKKLQCQCEHNTCGESCNRCCPGYHQQPWRPGTVSSGNTCEACNCHNKAKDCYYDESVAKQKKSLNTAGQFRGGGVCINCLQNTMGINCETCIDGYYRPHKVSPYEDEPCRPCNCDPVGSLSSVCIKDDLHSDLHNGKQPGQCPCKEGYTGEKCDRCQLGYKDYPTCVSCGCNPVGSASDEPCTGPCVCKENVEGKACDRCKPGFYNLKEKNPRGCSECFCFGVSDVCSSLSWPVGQVNSMSGWLVTDLISPRKIPSQQDALGGRHQVSINNTAVMQRLAPKYYWAAPEAYLGNKLTAFGGFLKYTVSYDIPVETVDSNLMSHADVIIKGNGLTLSTQAEGLSLQPYEEYLNVVRLVPENFQDFHSKRQIDRDQLMTVLANVTHLLIRANYNSAKMALYRLESVSLDIASSNAIDLVVAADVEHCECPQGYTGTSCESCLSGYYRVDGILFGGICQPCECHGHAAECNVHGVCIACAHNTTGVHCEQCLPGFYGEPSRGTPGDCQPCACPLTIASNNFSPTCHLNDGDEVVCDWCAPGYSGAWCERCADGYYGNPTVPGESCVPCDCSGNVDPSEAGHCDSVTGECLKCLGNTDGAHCERCADGFYGDAVTAKNCRACECHVKGSHSAVCHLETGLCDCKPNVTGQQCDQCLHGYYGLDSGHGCRPCNCSVAGSVSDGCTDEGQCHCVPGVAGKRCDRCAHGFYAYQDGSCTPCDCPHTQNTCDPETGECVCPPHTQGVKCEECEDGHWGYDAEVGCQACNCSLVGSTHHRCDVVTGHCQCKSKFGGRACDQCSLGYRDFPDCVPCDCDLRGTSGDACNLEQGLCGCVEETGACPCKENVFGPQCNECREGTFALRADNPLGCSPCFCSGLSHLCSELEDYVRTPVTLGSDQPLLRVVSQSNLRGTTEGVYYQAPDFLLDAATVRQHIRAEPFYWRLPQQFQGDQLMAYGGKLKYSVAFYSLDGVGTSNFEPQVLIKGGRIRKQVIYMDAPAPENGVRQEQEVAMRENFWKYFNSVSEKPVTREDFMSVLSDIEYILIKASYGQGLQQSRISDISMEVGRKAEKLHPEEEVASLLENCVCPPGTVGFSCQDCAPGYHRGKLPAGSDRGPRPLVAPCVPCSCNNHSDTCDPNTGKCLNCGDNTAGDHCDVCTSGYYGKVTGSASDCALCACPHSPPASFSPTCVLEGDHDFRCDACLLGYEGKHCERCSSSYYGNPQTPGGSCQKCDCNPHGSVHGDCDRTSGQCVCRLGASGLRCDECEPRHILMETDCVSCDDECVGVLLNDLDEIGDAVLSLNLTGIIPVPYGILSNLENTTKYLQESLLKENMQKDLGKIKLEGVAEETDNLQKKLTRMLASTQKVNRATERIFKESQDLAIAIERLQMSITEIMEKTTLNQTLDEDFLLPNSTLQNMQQNGTSLLEIMQIRDFTQLHQNATLELKAAEDLLSQIQENYQKPLEELEVLKEAASHVLSKHNNELKAAEALVREAEAKMQESNHLLLMVNANLREFSDKKLHVQEEQNLTSELIVQGRGLIDAAAAQTDAVQDALEHLEDHQDKLLLWSAKIRHHIDDLVMHMSQRNAVDLVYRAEDHAAEFQRLADVLYSGLENIRNVSLNATSAAYVHYNIQSLIEESEELARDAHRTVTETSLLSESLVSNGKAAVQRSSRFLKEGNNLSRKLPGIALELSELRNKTNRFQENAVEITRQTNESLLILRAIPKGIRDKGAKTKELATSASQSAVSTLRDVAGLSQELLNTSASLSRVNTTLRETHQLLQDSTMATLLAGRKVKDVEIQANLLFDRLKPLKMLEENLSRNLSEIKLLISQARKQAASIKVAVSADRDCIRAYQPQISSTNYNTLTLNVKTQEPDNLLFYLGSSTASDFLAVEMRRGRVAFLWDLGSGSTRLEFPDFPIDDNRWHSIHVARFGNIGSLSVKEMSSNQKSPTKTSKSPGTANVLDVNNSTLMFVGGLGGQIKKSPAVKVTHFKGCLGEAFLNGKSIGLWNYIEREGKCRGCFGSSQNEDPSFHFDGSGYSVVEKSLPATVTQIIMLFNTFSPNGLLLYLGSYGTKDFLSIELFRGRVKVMTDLGSGPITLLTDRRYNNGTWYKIAFQRNRKQGVLAVIDAYNTSNKETKQGETPGASSDLNRLDKDPIYVGGLPRSRVVRRGVTTKSFVGCIKNLEISRSTFDLLRNSYGVRKGCLLEPIRSVSFLKGGYIELPPKSLSPESEWLVTFATTNSSGIILAALGGDVEKRGDREEAHVPFFSVMLIGGNIEVHVNPGDGTGLRKALLHAPTGTCSDGQAHSISLVRNRRIITVQLDENNPVEMKLGTLVESRTINVSNLYVGGIPEGEGTSLLTMRRSFHGCIKNLIFNLELLDFNSAVGHEQVDLDTCWLSERPKLAPDAEDSKLLPEPRAFPEQCVVDAALEYVPGAHQFGLTQNSHFILPFNQSAVRKKLSVELSIRTFASSGLIYYMAHQNQADYAVLQLHGGRLHFMFDLGKGRTKVSHPALLSDGKWHTVKTDYVKRKGFITVDGRESPMVTVVGDGTMLDVEGLFYLGGLPSQYQARKIGNITHSIPACIGDVTVNSKQLDKDSPVSAFTVNRCYAVAQEGTYFDGSGYAALVKEGYKVQSDVNITLEFRTSSQNGVLLGISTAKVDAIGLELVDGKVLFHVNNGAGRITAAYEPKTATVLCDGKWHTLQANKSKHRITLIVDGNAVGAESPHTQSTSVDTNNPIYVGGYPAGVKQKCLRSQTSFRGCLRKLALIKSPQVQSFDFSRAFELHGVFLHSCPGTES

SEQ ID NO: 6850 - protein, 3122 aa, unidentified
MPGAAGVLLLLLLSGGLGGVQAQRPQQQRQSQAHQQRGLFPAVLNLASNALITTNATCGEKGPEMYCKLVEHVPGQPVRNPQCRICNQNSSNPNQRHPITNAIDGKNTWWQSPSIKNGIEYHYVTITLDLQQVFQIAYVIVKAANSPRPGNWILERSLDDVEYKPWQYHAVTDTECLTLYNIYPRTGPPSYAKDDEVICTSFYSKIHPLENGEIHISLINGRPSADDPSPELLEFTSARYIRLRFQRIRTLNADLMMFAHKDPREIDPIVTRRYYYSVKDISVGGMCICYGHARACPLDPATNKSRCECEHNTCGDSCDQCCPGFHQKPWRAGTFLTKTECEACNCHGKAEECYYDENVARRNLSLNIRGKYIGGGVCINCTQNTAGINCETCTDGFFRPKGVSPNYPRPCQPCHCDPIGSLNEVCVKDEKHARRGLAPGSCHCKTGFGGVSCDRCARGYTGYPDCKACNCSGLGSKNEDPCFGPCICKENVEGGDCSRCKSGFFNLQEDNWKGCDECFCSGVSNRCQSSYWTYGKIQDMSGWYLTDLPGRIRVAPQQDDLDSPQQISISNAEARQALPHSYYWSAPAPYLGNKLPAVGGQLTFTISYDLEEEEEDTERVLQLMIILEGNDLSISTAQDEVYLHPSEEHTNVLLLKEESFTIHGTHFPVRRKEFMTVLANLKRVLLQITYSFGMDAIFRLSSVNLESAVSYPTDGSIAAAVEVCQCPPGYTGSSCESCWPRHRRVNGTIFGGICEPCQCFGHAESCDDVTGECLNCKDHTGGPYCDKCLPGFYGEPTKGTSEDCQPCACPLNIPSNNFSPTCHLDRSLGLICDGCPVGYTGPRCERCAEGYFGQPSVPGGSCQPCQCNDNLDFSIPGSCDSLSGSCLICKPGTTGRYCELCADGYFGDAVDAKNCQPCRCNAGGSFSEVCHSQTGQCECRANVQGQRCDKCKAGTFGLQSARGCVPCNCNSFGSKSFDCEESGQCWCQPGVTGKKCDRCAHGYFNFQEGGCTACECSHLGNNCDPKTGRCICPPNTIGEKCSKCAPNTWGHSITTGCKACNCSTVGSLDFQCNVNTGQCNCHPKFSGAKCTECSRGHWNYPRCNLCDCFLPGTDATTCDSETKKCSCSDQTGQCTCKVNVEGIHCDRCRPGKFGLDAKNPLGCSSCYCFGTTTQCSEAKGLIRTWVTLKAEQTILPLVDEALQHTTTKGIVFQHPEIVAHMDLMREDLHLEPFYWKLPEQFEGKKLMAYGGKLKYAIYFEAREETGFSTYNPQVIIRGGTPTHARIIVRHMAAPLIGQLTRHEIEMTEKEWKYYGDDPRVHRTVTREDFLDILYDIHYILIKATYGNFMRQSRISEISMEVAEQGRGTTMTPPADLIEKCDCPLGYSGLSCEACLPGFYRLRSQPGGRTPGPTLGTCVPCQCNGHSSLCDPETSICQNCQHHTAGDFCERCALGYYGIVKGLPNDCQQCACPLISSSNNFSPSCVAEGLDDYRCTACPRGYEGQYCERCAPGYTGSPGNPGGSCQECECDPYGSLPVPCDPVTGFCTCRPGATGRKCDGCKHWHAREGWECVFCGDECTGLLLGDLARLEQMVMSINLTGPLPAPYKMLYGLENMTQELKHLLSPQRAPERLIQLAEGNLNTLVTEMNELLTRATKVTADGEQTGQDAERTNTRAKSLGEFIKELARDAEAVNEKAIKLNETLGTRDEAFERNLEGLQKEIDQMIKELRRKNLETQKEIAEDELVAAEALLKKVKKLFGESRGENEEMEKDLREKLADYKNKVDDAWDLLREATDKIREANRLFAVNQKNMTALEKKKEAVESGKRQIENTLKEGNDILDEANRLADEINSIIDYVEDIQTKLPPMSEELNDKIDDLSQEIKDRKLAEKVSQAESHAAQLNDSSAVLDGILDEAKNISFNATAAFKAYSNIKDYIDEAEKVAKEAKDLAHEATKLATGPRGLLKEDAKGCLQKSFRILNEAKKLANDVKENEDHLNGLKTRIENADARNGDLLRTLNDTLGKLSAIPNDTAAKLQAVKDKARQANDTAKDVLAQITELHQNLDGLKKNYNKLADSVAKTNAVVKDPSKNKIIADADATVKNLEQEADRLIDKLKPIKELEDNLKKNISEIKELINQARKQANSIKVSVSSGGDCIRTYKPEIKKGSYNNIVVNVKTAVADNLLFYLGSAKFIDFLAIEMRKGKVSFLWDVGSGVGRVEYPDLTIDDSYWYRIVASRTGRNGTISVRALDGPKASIVPSTHHSTSPPGYTILDVDANAMLFVGGLTGKLKKADAVRVITFTGCMGETYFDNKPIGLWNFREKEGDCKGCTVSPQVEDSEGTIQFDGEGYALVSRPIRWYPNISTVMFKFRTFSSSALLMYLATRDLRDFMSVELTDGHIKVSYDLGSGMASVVSNQNHNDGKWKSFTLSRIQKQANISIVDIDTNQEENIATSSSGNNFGLDLKADDKIYFGGLPTLRNLSMKARPEVNLKKYSGCLKDIEISRTPYNILSSPDYVGVTKGCSLENVYTVSFPKPGFVELSPVPIDVGTEINLSFSTKNESGIILLGSGGTPAPPRRKRRQTGQAYYAILLNRGRLEVHLSTGARTMRKIVIRPEPNLFHDGREHSVHVERTRGIFTVQVDENRRYMQNLTVEQPIEVKKLFVGGAPPEFQPSPLRNIPPFEGCIWNLVINSVPMDFARPVSFKNADIGRCAHQKLREDEDGAAPAEIVIQPEPVPTPAFPTPTPVLTHGPCAAESEPALLIGSKQFGLSRNSHIAIAFDDTKVKNRLTIELEVRTEAESGLLFYMARINHADFATVQLRNGLPYFSYDLGSGDTHTMIPTKINDGQWHKIKIMRSKQEGILYVDGASNRTISPKKADILDVVGMLYVGGLPINYTTRRIGPVTYSIDGCVRNLHMAEAPADLEQPTSSFHVGTCFANAQRGTYFDGTGFAKAVGGFKVGLDLLVEFEFRTTTTTGVLLGISSQKMDGMGIEMIDEKLMFHVDNGAGRFTAVYDAGVPGHLCDGQWHKVTANKIKHRIELTVDGNQVEAQSPNPASTSADTNDPVFVGGFPDDLKQFGLTTSIPFRGCIRSLKLTKGTGKPLEVNFAKALELRGVQPVSCPAN

SEQ ID NO: 6851 - protein, 3333 aa, unidentified
MAAAARPRGRALGPVLPPTPLLLLVLRVLPACGATARDPGAAAGLSLHPTYFNLAEAARIWATATCGERGPGEGRPQPELYCKLVGGPTAPGSGHTIQGQFCDYCNSEDPRKAHPVTNAIDGSERWWQSPPLSSGTQYNRVNLTLDLGQLFHVAYILIKFANSPRPDLWVLERSVDFGSTYSPWQYFAHSKVDCLKEFGREANMAVTRDDDVLCVTEYSRIVPLENGEVVVSLINGRPGAKNFTFSHTLREFTKATNIRLRFLRTNTLLGHLISKAQRDPTVTRRYYYSIKDISIGGQCVCNGHAEVCNINNPEKLFRCECQHHTCGETCDRCCTGYNQRRWRPAAWEQSHECEACNCHGHASNCYYDPDVERQQASLNTQGIYAGGGVCINCQHNTAGVNCEQCAKGYYRPYGVPVDAPDGCIPCSCDPEHADGCEQGSGRCHCKPNFHGDNCEKCAIGYYNFPFCLRIPIFPVSTPSSEDPVAGDIKGCDCNLEGVLPEICDAHGRCLCRPGVEGPRCDTCRSGFYSFPICQACWCSALGSYQMPCSSVTGQCECRPGVTGQRCDRCLSGAYDFPHCQGSSSACDPAGTINSNLGYCQCKLHVEGPTCSRCKLLYWNLDKENPSGCSECKCHKAGTVSGTGECRQGDGDCHCKSHVGGDSCDTCEDGYFALEKSNYFGCQGCQCDIGGALSSMCSGPSGVCQCREHVVGKVCQRPENNYYFPDLHHMKYEIEDGSTPNGRDLRFGFDPLAFPEFSWRGYAQMTSVQNDVRITLNVGKSSGSLFRVILRYVNPGTEAVSGHITIYPSWGAAQSKEIIFLPSKEPAFVTVPGNGFADPFSITPGIWVACIKAEGVLLDYLVLLPRDYYEASVLQLPVTEPCAYAGPPQENCLLYQHLPVTRFPCTLACEARHFLLDGEPRPVAVRQPTPAHPVMVDLSGREVELHLRLRIPQVGHYVVVVEYSTEAAQLFVVDVNVKSSGSVLAGQVNIYSCNYSVLCRSAVIDHMSRIAMYELLADADIQLKGHMARFLLHQVCIIPIEEFSAEYVRPQVHCIASYGRFVNQSATCVSLAHETPPTALILDVLSGRPFPHLPQQSSPSVDVLPGVTLKAPQNQVTLRGRVPHLGRYVFVIHFYQAAHPTFPAQVSVDGGWPRAGSFHASFCPHVLGCRDQVIAEGQIEFDISEPEVAATVKVPEGKSLVLVRVLVVPAENYDYQILHKKSMDKSLEFITNCGKNSFYLDPQTASRFCKNSARSLVAFYHKGALPCECHPTGATGPHCSPEGGQCPCQPNVIGRQCTRCATGHYGFPRCKPCSCGRRLCEEMTGQCRCPPRTVRPQCEVCETHSFSFHPMAGCEGCNCSRRGTIEAAMPECDRDSGQCRCKPRITGRQCDRCASGFYRFPECVPCNCNRDGTEPGVCDPGTGACLCKENVEGTECNVCREGSFHLDPANLKGCTSCFCFGVNNQCHSSHKRRTKFVDMLGWHLETADRVDIPVSFNPGSNSMVADLQELPATIHSASWVAPTSYLGDKVSSYGGYLTYQAKSFGLPGDMVLLEKKPDVQLTGQHMSIIYEETNTPRPDRLHHGRVHVVEGNFRHASSRAPVSREELMTVLSRLADVRIQGLYFTETQRLTLSEVGLEEASDTGSGRIALAVEICACPPAYAGDSCQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGSPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 6852 - protein, 1823 aa, unidentified
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGMDCPTISCDKCVWDLTDALRLAALSIEEGKSGVLSVSSGAAAHRHVNEINATIYLLKTKLSERENQYALRKIQINNAENTMKSLLSDVEELVEKENQASRKGQLVQKESMDTINHASQLVEQAHDMRDKIQEINNKMLYYGEEHELSPKEISEKLVLAQKMLEEIRSRQPFFTQRELVDEEADEAYELLSQAESWQRLHNETRTLFPVVLEQLDDYNAKLSDLQEALDQALNYVRDAEDMNRATAARQRDHEKQQERVREQMEVVNMSLSTSADSLTTPRLTLSELDDIIKNASGIYAEIDGAKSELQVKLSNLSNLSHDLVQEAIDHAQDLQQEANELSRKLHSSDMNGLVQKALDASNVYENIVNYVSEANETAEFALNTTDRIYDAVSGIDTQIIYHKDESENLLNQARELQAKAESSSDEAVADTSRRVGGALARKSALKTRLSDAVKQLQAAERGDAQQRLGQSRLITEEANRTTMEVQQATAPMANNLTNWSQNLQHFDSSAYNTAVNSARDAVRNLTEVVPQLLDQLRTVEQKRPASNVSASIQRIRELIAQTRSVASKIQVSMMFDGQSAVEVHSRTSMDDLKAFTSLSLYMKPPVKRPELTETADQFILYLGSKNAKKEYMGLAIKNDNLVYVYNLGTKDVEIPLDSKPVSSWPAYFSIVKIERVGKHGKVFLTVPSLSSTAEEKFIKKGEFSGDDSLLDLDPEDTVFYVGGVPSNFKLPTSLNLPGFVGCLELATLNNDVISLYNFKHIYNMDPSTSVPCARDKLAFTQSRAASYFFDGSGYAVVRDITRRGKFGQVTRFDIEVRTPADNGLILLMVNGSMFFRLEMRNGYLHVFYDFGFSGGPVHLEDTLKKAQINDAKYHEISIIYHNDKKMILVVDRRHVKSMDNEKMKIPFTDIYIGGAPPEILQSRALRAHLPLDINFRGCMKGFQFQKKDFNLLEQTETLGVGYGCPEDSLISRRAYFNGQSFIASIQKISFFDGFEGGFNFRTLQPNGLLFYYASGSDVFSISLDNGTVIMDVKGIKVQSVDKQYNDGLSHFVISSVSPTRYELIVDKSRVGSKNPTKGKIEQTQASEKKFYFGGSPISAQYANFTGCISNAYFTRVDRDVEVEDFQRYTEKVHTSLYECPIESSPLFLLHKKGKNLSKPKASQNKKGGKSKDAPSWDPVALKLPERNTPRNSHCHLSNSPRAIEHAYQYGGTANSRQEFEHLKGDFGAKSQFSIRLRTRSSHGMIFYVSDQEENDFMTLFLAHGRLVYMFNVGHKKLKIRSQEKYNDGLWHDVIFIRERSSGRLVIDGLRVLEESLPPTEATWKIKGPIYLGGVAPGKAVKNVQINSIYSFSGCLSNLQLNGASITSASQTFSVTPCFEGPMETGTYFSTEGGYVVLDESFNIGLKFEIAFEVRPRSSSGTLVHGHSVNGEYLNVHMKNGQVIVKVNNGIRDFSTSVTPKQSLCDGRWHRITVIRDSNVVQLDVDSEVNHVVGPLNPKPIDHREPVFVGGVPESLLTPRLAPSKPFTGCIRHFVIDGHPVSFSKAALVSGAVSINSCPAA

SEQ ID NO: 6853 - protein, 3695 aa, unidentified
MAKRLCAGSALCVRGPRGPAPLLLVGLALLGAARAREEAGGGFSLHPPYFNLAEGARIAASATCGEEAPARGSPRPTEDLYCKLVGGPVAGGDPNQTIRGQYCDICTAANSNKAHPASNAIDGTERWWQSPPLSRGLEYNEVNVTLDLGQVFHVAYVLIKFANSPRPDLWVLERSMDFGRTYQPWQFFASSKRDCLERFGPQTLERITRDDAAICTTEYSRIVPLENGEIVVSLVNGRPGAMNFSYSPLLREFTKATNVRLRFLRTNTLLGHLMGKALRDPTVTRRYYYSIKDISIGGRCVCHGHADACDAKDPTDPFRLQCTCQHNTCGGTCDRCCPGFNQQPWKPATANSANECQSCNCYGHATDCYYDPEVDRRRASQSLDGTYQGGGVCIDCQHHTTGVNCERCLPGFYRSPNHPLDSPHVCRRCNCESDFTDGTCEDLTGRCYCRPNFSGERCDVCAEGFTGFPSCYPTPSSSNDTREQVLPAGQIVNCDCSAAGTQGNACRKDPRVGRCLCKPNFQGTHCELCAPGFYGPGCQPCQCSSPGVADDRCDPDTGQCRCRVGFEGATCDRCAPGYFHFPLCQLCGCSPAGTLPEGCDEAGRCLCQPEFAGPHCDRCRPGYHGFPNCQACTCDPRGALDQLCGAGGLCRCRPGYTGTACQECSPGFHGFPSCVPCHCSAEGSLHAACDPRSGQCSCRPRVTGLRCDTCVPGAYNFPYCEAGSCHPAGLAPVDPALPEAQVPCMCRAHVEGPSCDRCKPGFWGLSPSNPEGCTRCSCDLRGTLGGVAECQPGTGQCFCKPHVCGQACASCKDGFFGLDQADYFGCRSCRCDIGGALGQSCEPRTGVCRCRPNTQGPTCSEPARDHYLPDLHHLRLELEEAATPEGHAVRFGFNPLEFENFSWRGYAQMAPVQPRIVARLNLTSPDLFWLVFRYVNRGAMSVSGRVSVREEGRSATCANCTAQSQPVAFPPSTEPAFITVPQRGFGEPFVLNPGTWALRVEAEGVLLDYVVLLPSAYYEAALLQLRVTEACTYRPSAQQSGDNCLLYTHLPLDGFPSAAGLEALCRQDNSLPRPCPTEQLSPSHPPLITCTGSDVDVQLQVAVPQPGRYALVVEYANEDARQEVGVAVHTPQRAPQQGLLSLHPCLYSTLCRGTARDTQDHLAVFHLDSEASVRLTAEQARFFLHGVTLVPIEEFSPEFVEPRVSCISSHGAFGPNSAACLPSRFPKPPQPIILRDCQVIPLPPGLPLTHAQDLTPAMSPAGPRPRPPTAVDPDAEPTLLREPQATVVFTTHVPTLGRYAFLLHGYQPAHPTFPVEVLINAGRVWQGHANASFCPHGYGCRTLVVCEGQALLDVTHSELTVTVRVPKGRWLWLDYVLVVPENVYSFGYLREEPLDKSYDFISHCAAQGYHISPSSSSLFCRNAAASLSLFYNNGARPCGCHEVGATGPTCEPFGGQCPCHAHVIGRDCSRCATGYWGFPNCRPCDCGARLCDELTGQCICPPRTIPPDCLLCQPQTFGCHPLVGCEECNCSGPGIQELTDPTCDTDSGQCKCRPNVTGRRCDTCSPGFHGYPRCRPCDCHEAGTAPGVCDPLTGQCYCKENVQGPKCDQCSLGTFSLDAANPKGCTRCFCFGATERCRSSSYTRQEFVDMEGWVLLSTDRQVVPHERQPGTEMLRADLRHVPEAVPEAFPELYWQAPPSYLGDRVSSYGGTLRYELHSETQRGDVFVPMESRPDVVLQGNQMSITFLEPAYPTPGHVHRGQLQLVEGNFRHTETRNTVSREELMMVLASLEQLQIRALFSQISSAVFLRRVALEVASPAGQGALASNVELCLCPASYRGDSCQECAPGFYRDVKGLFLGRCVPCQCHGHSDRCLPGSGVCVDCQHNTEGAHCERCQAGFVSSRDDPSAPCVSCPCPLSVPSNNFAEGCVLRGGRTQCLCKPGYAGASCERCAPGFFGNPLVLGSSCQPCDCSGNGDPNLLFSDCDPLTGACRGCLRHTTGPRCEICAPGFYGNALLPGNCTRCDCTPCGTEACDPHSGHCLCKAGVTGRRCDRCQEGHFGFDGCGGCRPCACGPAAEGSECHPQSGQCHCRPGTMGPQCRECAPGYWGLPEQGCRRCQCPGGRCDPHTGRCNCPPGLSGERCDTCSQQHQVPVPGGPVGHSIHCEVCDHCVVLLLDDLERAGALLPAIHEQLRGINASSMAWARLHRLNASIADLQSQLRSPLGPRHETAQQLEVLEQQSTSLGQDARRLGGQAVGTRDQASQLLAGTEATLGHAKTLLAAIRAVDRTLSELMSQTGHLGLANASAPSGEQLLRTLAEVERLLWEMRARDLGAPQAAAEAELAAAQRLLARVQEQLSSLWEENQALATQTRDRLAQHEAGLMDLREALNRAVDATREAQELNSRNQERLEEALQRKQELSRDNATLQATLHAARDTLASVFRLLHSLDQAKEELERLAASLDGARTPLLQRMQTFSPAGSKLRLVEAAEAHAQQLGQLALNLSSIILDVNQDRLTQRAIEASNAYSRILQAVQAAEDAAGQALQQADHTWATVVRQGLVDRAQQLLANSTALEEAMLQEQQRLGLVWAALQGARTQLRDVRAKKDQLEAHIQAAQAMLAMDTDETSKKIAHAKAVAAEAQDTATRVQSQLQAMQENVERWQGQYEGLRGQDLGQAVLDAGHSVSTLEKTLPQLLAKLSILENRGVHNASLALSASIGRVRELIAQARGAASKVKVPMKFNGRSGVQLRTPRDLADLAAYTALKFYLQGPEPEPGQGTEDRFVMYMGSRQATGDYMGVSLRDKKVHWVYQLGEAGPAVLSIDEDIGEQFAAVSLDRTLQFGHMSVTVERQMIQETKGDTVAPGAEGLLNLRPDDFVFYVGGYPSTFTPPPLLRFPGYRGCIEMDTLNEEVVSLYNFERTFQLDTAVDRPCARSKSTGDPWLTDGSYLDGTGFARISFDSQISTTKRFEQELRLVSYSGVLFFLKQQSQFLCLAVQEGSLVLLYDFGAGLKKAVPLQPPPPLTSASKAIQVFLLGGSRKRVLVRVERATVYSVEQDNDLELADAYYLGGVPPDQLPPSLRRLFPTGGSVRGCVKGIKALGKYVDLKRLNTTGVSAGCTADLLVGRAMTFHGHGFLRLALSNVAPLTGNVYSGFGFHSAQDSALLYYRASPDGLCQVSLQQGRVSLQLLRTEVKTQAGFADGAPHYVAFYSNATGVWLYVDDQLQQMKPHRGPPPELQPQPEGPPRLLLGGLPESGTIYNFSGCISNVFVQRLLGPQRVFDLQQNLGSVNVSTGCAPALQAQTPGLGPRGLQATARKASRRSRQPARHPACMLPPHLRTTRDSYQFGGSLSSHLEFVGILARHRNWPSLSMHVLPRSSRGLLLFTARLRPGSPSLALFLSNGHFVAQMEGLGTRLRAQSRQRSRPGRWHKVSVRWEKNRILLVTDGARAWSQEGPHRQHQGAEHPQPHTLFVGGLPASSHSSKLPVTVGFSGCVKRLRLHGRPLGAPTRMAGVTPCILGPLEAGLFFPGSGGVITLDLPGATLPDVGLELEVRPLAVTGLIFHLGQARTPPYLQLQVTEKQVLLRADDGAGEFSTSVTRPSVLCDGQWHRLAVMKSGNVLRLEVDAQSNHTVGPLLAAAAGAPAPLYLGGLPEPMAVQPWPPAYCGCMRRLAVNRSPVAMTRSVEVHGAVGASGCPAA

SEQ ID NO: 6854 - protein, 1786 aa, unidentified
MGLLQLLAFSFLALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRACDCDPRGIETPQCDQSTGQCVCVEGVEGPRCDKCTRGYSGVFPDCTPCHQCFALWDVIIAELTNRTHRFLEKAKALKISGVIGPYRETVDSVERKVSEIKDILAQSPAAEPLKNIGNLFEEAEKLIKDVTEMMAQVEVKLSDTTSQSNSTAKELDSLQTEAESLDNTVKELAEQLEFIKNSDIRGALDSITKYFQMSLEAEERVNASTTEPNSTVEQSALMRDRVEDVMMERESQFKEKQEEQARLLDELAGKLQSLDLSAAAEMTCGTPPGASCSETECGGPNCRTDEGERKCGGPGCGGLVTVAHNAWQKAMDLDQDVLSALAEVEQLSKMVSEAKLRADEAKQSAEDILLKTNATKEKMDKSNEELRNLIKQIRNFLTQDSADLDSIEAVANEVLKMEMPSTPQQLQNLTEDIRERVESLSQVEVILQHSAADIARAEMLLEEAKRASKSATDVKVTADMVKEALEEAEKAQVAAEKAIKQADEDIQGTQNLLTSIESETAASEETLFNASQRISELERNVEELKRKAAQNSGEAEYIEKVVYTVKQSAEDVKKTLDGELDEKYKKVENLIAKKTEESADARRKAEMLQNEAKTLLAQANSKLQLLKDLERKYEDNQRYLEDKAQELARLEGEVRSLLKDISQKVAVYSTCL

SEQ ID NO: 6855 - protein, 1798 aa, unidentified
MELTSRERGRGQPLPWELRLGLLLSVLAATLAQAPAPDVPGCSRGSCYPATGDLLVGRADRLTASSTCGLNGPQPYCIVSHLQDEKKCFLCDSRRPFSARDNPHSHRIQNVVTSFAPQRRAAWWQSENGIPAVTIQLDLEAEFHFTHLIMTFKTFRPAAMLVERSADFGRTWHVYRYFSYDCGADFPGVPLAPPRHWDDVVCESRYSEIEPSTEGEVIYRVLDPAIPIPDPYSSRIQNLLKITNLRVNLTRLHTLGDNLLDPRREIREKYYYALYELVVRGNCFCYGHASECAPAPGAPAHAEGMVHGACICKHNTRGLNCEQCQDFYRDLPWRPAEDGHSHACRKCECHGHTHSCHFDMAVYLASGNVSGGVCDGCQHNTAGRHCELCRPFFYRDPTKDLRDPAVCRSCDCDPMGSQDGGRCDSHDDPALGLVSGQCRCKEHVVGTRCQQCRDGFFGLSISDRLGCRRCQCNARGTVPGSTPCDPNSGSCYCKRLVTGRGCDRCLPGHWGLSHDLLGCRPCDCDVGGALDPQCDEGTGQCHCRQHMVGRRCEQVQPGYFRPFLDHLIWEAEDTRGQVLDVVERLVTPGETPSWTGSGFVRLQEGQTLEFLVASVPKAMDYDLLLRLEPQVPEQWAELELIVQRPGPVPAHSLCGHLVPKDDRIQGTLQPHARYLIFPNPVCLEPGISYKLHLKLVRTGGSAQPETPYSGPGLLIDSLVLLPRVLVLEMFSGGDAAALERQATFERYQCHEEGLVPSKTSPSEACAPLLISLSTLIYNGALPCQCNPQGSLSSECNPHGGQCLCKPGVVGRRCDLCAPGYYGFGPTGCQACQCSHEGALSSLCEKTSGQCLCRTGAFGLRCDRCQRGQWGFPSCRPCVCNGHADECNTHTGACLGCRDHTGGEHCERCIAGFHGDPRLPYGGQCRPCPCPEGPGSQRHFATSCHQDEYSQQIVCHCRAGYTGLRCEACAPGHFGDPSRPGGRCQLCECSGNIDPMDPDACDPHTGQCLRCLHHTEGPHCAHCKPGFHGQAARQSCHRCTCNLLGTNPQQCPSPDQCHCDPSSGQCPCLPNVQGPSCDRCAPNFWNLTSGHGCQPCACHPSRARGPTCNEFTGQCHCRAGFGGRTCSECQELHWGDPGLQCHACDCDSRGIDTPQCHRFTGHCSCRPGVSGVRCDQCARGFSGIFPACHPCHACFGDWDRVVQDLAARTQRLEQRAQELQQTGVLGAFESSFWHMQEKLGIVQGIVGARNTSAASTAQLVEATEELRREIGEATEHLTQLEADLTDVQDENFNANHALSGLERDRLALNLTLRQLDQHLDLLKHSNFLGAYDSIRHAHSQSAEAERRANTSALAVPSPVSNSASARHRTEALMDAQKEDFNSKHMANQRALGKLSAHTHTLSLTDINELVCGAPGDAPCATSPCGGAGCRDEDGQPRCGGLSCNGAAATADLALGRARHTQAELQRALAEGGSILSRVAETRRQASEAQQRAQAALDKANASRGQVEQANQELQELIQSVKDFLNQEGADPDSIEMVATRVLELSIPASAEQIQHLAGAIAERVRSLADVDAILARTVGDVRRAEQLLQDARRARSWAEDEKQKAETVQAALEEAQRAQGIAQGAIRGAVADTRDTEQTLYQVQERMAGAERALSSAGERARQLDALLEALKLKRAGNSLAASTAEETAGSAQGRAQEAEQLLRGPLGDQYQTVKALAERKAQGVLAAQARAEQLRDEARDLLQAAQDKLQRLQELEGTYEENERALESKAAQLDGLEARMRSVLQAINLQVQIYNTCQ

SEQ ID NO: 6856 - protein, 1172 aa, unidentified [sequence omitted]

SEQ ID NO: 6857 - protein, 1761 aa, unidentified
MQFQLTLFLHLGWLSYSKAQDDCNRGACHPTTGDLLVGRNTQLMASSTCGLSRAQKYCILSYLEGEQKCFICDSRFPYDPYDQPNSHTIENVIVSFEPDREKKWWQSENGLDHVSIRLDLEALFRFSHLILTFKTFRPAAMLVERSTDYGHNWKVFKYFAKDCATSFPNITSGQAQGVGDIVCDSKYSDIEPSTGGEVVLKVLDPSFEIENPYSPYIQDLVTLTNLRINFTKLHTLGDALLGRRQNDSLDKYYYALYEMIVRGSCFCNGHASECRPMQKMRGDVFSPPGMVHGQCVCQHNTDGPNCERCKDFFQDAPWRPAADLQDNACRSCSCNSHSSRCHFDMTTYLASGGLSGGVCEDCQHNTEGQHCDRCRPLFYRDPLKTISDPYACIPCECDPDGTISGGICVSHSDPALGSVAGQCLCKENVEGAKCDQCKPNHYGLSATDPLGCQPCDCNPLGSLPFLTCDVDTGQCLCLSYVTGAHCEECTVGYWGLGNHLHGCSPCDCDIGGAYSNVCSPKNGQCECRPHVTGRSCSEPAPGYFFAPLNFYLYEAEEATTLQGLAPLGSETFGQSPAVHVVLGEPVPGNPVTWTGPGFARVLPGAGLRFAVNNIPFPVDFTIAIHYETQSAADWTVQIVVNPPGGSEHCIPKTLQSKPQSFALPAATRIMLLPTPICLEPDVQYSIDVYFSQPLQGESHAHSHVLVDSLGLIPQINSLENFCSKQDLDEYQLHNCVEIASAMGPQVLPGACERLIISMSAKLHDGAVACKCHPQGSVGSSCSRLGGQCQCKPLVVGRCCDRCSTGSYDLGHHGCHPCHCHPQGSKDTVCDQVTGQCPCHGEVSGRRCDRCLAGYFGFPSCHPCPCNRFAELCDPETGSCFNCGGFTTGRNCERCIDGYYGNPSSGQPCRPCLCPDDPSSNQYFAHSCYQNLWSSDVICNCLQGYTGTQCGECSTGFYGNPRISGAPCQPCACNNNIDVTDPESCSRVTGECLRCLHNTQGANCQLCKPGHYGSALNQTCRRCSCHASGVSPMECPPGGGACLCDPVTGACPCLPNVTGLACDRCADGYWNLVPGRGCQSCDCDPRTSQSSHCDQLTGQCPCKLGYGGKRCSECQENYYGDPPGRCIPCDCNRAGTQKPICDPDTGMCRCREGVSGQRCDRCARGHSQEFPTCLQCHLCFDQWDHTISSLSKAVQGLMRLAANMEDKRETLPVCEADFKDLRGNVSEIERILKHPVFPSGKFLKVKDYHDSVRRQIMQLNEQLKAVYEFQDLKDTIERAKNEADLLLEDLQEEIDLQSSVLNASIADSSENIKKYYHISSSAEKKINETSSTINTSANTRNDLLTILDTLTSKGNLSLERLKQIKIPDIQILNEKVCGDPGNVPCVPLPCGGALCTGRKGHRKCRGPGCHGSLTLSTNALQKAQEAKSIIRNLDKQVRGLKNQIESISEQAEVSKNNALQLREKLGNIRNQSDSEEENINLFIKKVKNFLLEENVPPEDIEKVANGVLDIHLPIPSQNLTDELVKIQKHMQLCEDYRTDENRLNEEADGAQKLLVKAKAAEKAANILLNLDKTLNQLQQAQITQGRANSTITQLTANITKIKKNVLQAENQTREMKSELELAKQRSGLEDGLSLLQTKLQRHQDHAVNAKVQAESAQHQAGSLEKEFVELKKQYAILQRKTSTTGLTKETLGKVKQLKDAAEKLAGDTEAKIRRITDLERKIQDLNLSRQAKADQLRILEDQVVAIKNEIVEQEKKYARCYS

SEQ ID NO: 6858 - protein, 1609 aa, unidentified
MRGSHRAAPALRPRGRLWPVLAVLAAAAAAGCAQAAMDECTDEGGRPQRCMPEFVNAAFNVTVVATNTCGTPPEEYCVQTGVTGVTKSCHLCDAGQPHLQHGAAFLTDYNNQADTTWWQSQTMLAGVQYPSSINLTLHLGKAFDITYVRLKFHTSRPESFAIYKRTREDGPWIPYQYYSGSCENTYSKANRGFIRTGGDEQQALCTDEFSDISPLTGGNVAFSTLEGRPSAYNFDNSPVLQEWVTATDIRVTLNRLNTFGDEVFNDPKVLKSYYYAISDFAVGGRCKCNGHASECMKNEFDKLVCNCKHNTYGVDCEKCLPFFNDRPWRRATAESASECLPCDCNGRSQECYFDPELYRSTGHGGHCTNCQDNTDGAHCERCRENFFRLGNNEACSSCHCSPVGSLSTQCDSYGRCSCKPGVMGDKCDRCQPGFHSLTEAGCRPCSCDPSGSIDECNIETGRCVCKDNVEGFNCERCKPGFFNLESSNPRGCTPCFCFGHSSVCTNAVGYSVYSISSTFQIDEDGWRAEQRDGSEASLEWSSERQDIAVISDSYFPRYFIAPAKFLGKQVLSYGQNLSFSFRVDRRDTRLSAEDLVLEGAGLRVSVPLIAQGNSYPSETTVKYVFRLHEATDYPWRPALTPFEFQKLLNNLTSIKIRGTYSERSAGYLDDVTLASARPGPGVPATWVESCTCPVGYGGQFCEMCLSGYRRETPNLGPYSPCVLCACNGHSETCDPETGVCNCRDNTAGPHCEKCSDGYYGDSTAGTSSDCQPCPCPGGSSCAVVPKTKEVVCTNCPTGTTGKRCELCDDGYFGDPLGRNGPVRLCRLCQCSDNIDPNAVGNCNRLTGECLKCIYNTAGFYCDRCKDGFFGNPLAPNPADKCKACNCNLYGTMKQQSSCNPVTGQCECLPHVTGQDCGACDPGFYNLQSGQGCERCDCHALGSTNGQCDIRTGQCECQPGITGQHCERCEVNHFGFGPEGCKPCDCHPEGSLSLQCKDDGRCECREGFVGNRCDQCEENYFYNRSWPGCQECPACYRLVKDKVADHRVKLQELESLIANLGTGDEMVTDQAFEDRLKEAEREVMDLLREAQDVKDVDQNLMDRLQRVNNTLSSQISRLQNIRNTIEETGNLAEQARAHVENTERLIEIASRELEKAKVAAANVSVTQPESTGDPNNMTLLAEEARKLAERHKQEADDIVRVAKTANDTSTEAYNLLLRTLAGENQTAFEIEELNRKYEQAKNISQDLEKQAARVHEEAKRAGDKAVEIYASVAQLSPLDSETLENEANNIKMEAENLEQLIDQKLKDYEDLREDMRGKELEVKNLLEKGKTEQQTADQLLARADAAKALAEEAAKKGRDTLQEANDILNNLKDFDRRVNDNKTAAEEALRKIPAINQTITEANEKTREAQQALGSAAADATEAKNKAHEAERIASAVQKNATSTKAEAERTFAEVTDLDNEVNNMLKQLQEAEKELKRKQDDADQDMMMAGMASQAAQEAEINARKAKNSVTSLLSIINDLLEQLGQLDTVDLNKLNEIEGTLNKAKDEMKVSDLDRKVSDLENEAKKQEAAIMDYNRDIEEIMKDIRNLEDIRKTLPSGCFNTPSIEKP

SEQ ID NO: 6859 - protein, 1193 aa, unidentified
MPALWLGCCLCFSLLLPAARATSRREVCDCNGKSRQCIFDRELHRQTGNGFRCLNCNDNTDGIHCEKCKNGFYRHRERDRCLPCNCNSKGSLSARCDNSGRCSCKPGVTGARCDRCLPGFHMLTDAGCTQDQRLLDSKCDCDPAGIAGPCDAGRCVCKPAVTGERCDRCRSGYYNLDGGNPEGCTQCFCYGHSASCRSSAEYSVHKITSTFHQDVDGWKAVQRNGSPAKLQWSQRHQDVFSSAQRLDPVYFVAPAKFLGNQQVSYGQSLSFDYRVDRGGRHPSAHDVILEGAGLRITAPLMPLGKTLPCGLTKTYTFRLNEHPSNNWSPQLSYFEYRRLLRNLTALRIRATYGEYSTGYIDNVTLISARPVSGAPAPWVEQCICPVGYKGQFCQDCASGYKRDSARLGPFGTCIPCNCQGGGACDPDTGDCYSGDENPDIECADCPIGFYNDPHDPRSCKPCPCHNGFSCSVMPETEEVVCNNCPPGVTGARCELCADGYFGDPFGEHGPVRPCQPCQCNNNVDPSASGNCDRLTGRCLKCIHNTAGIYCDQCKAGYFGDPLAPNPADKCRACNCNPMGSEPVGCRSDGTCVCKPGFGGPNCEHGAFSCPACYNQVKIQMDQFMQQLQRMEALISKAQGGDGVVPDTELEGRMQQAEQALQDILRDAQISEGASRSLGLQLAKVRSQENSYQSRLDDLKMTVERVRALGSQYQNRVRDTHRLITQMQLSLAESEASLGNTNIPASDHYVGPNGFKSLAQEATRLAESHVESASNMEQLTRETEDYSKQALSLVRKALHEGVGSGSGSPDGAVVQGLVEKLEKTKSLAQQLTREATQAEIEADRSYQHSLRLLDSVSRLQGVSDQSFQVEEAKRIKQKADSLSSLVTRHMDEFKRTQKNLGNWKEEAQQLLQNGKSGREKSDQLLSRANLAKSRAQEALSMGNATFYEVESILKNLREFDLQVDNRKAEAEEAMKRLSYISQKVSDASDKTQQAERALGSAAADAQRAKNGAGEALEISSEIEQEIGSLNLEANVTADGALAMEKGLASLKSEMREVEGELERKELEFDTNMDAVQMVITEAQKVDTRAKNAGVTIQDTLNTLDGLLHLMDQPLSVDEEGLVLLEQKLSRAKTQINSQLRPMMSELEERARQQRGHLHLLETSIDGILADVKNLENIRDNLPPGCYNTQALEQQ

SEQ ID NO: 6860 - protein, 1575 aa, unidentified
MAAAALLLGLALLAPRAAGAGMGACYDGAGRPQRCLPVFENAAFGRLAQASHTCGSPPEDFCPHVGAAGAGAHCQRCDAADPQRHHNASYLTDFHSQDESTWWQSPSMAFGVQYPTSVNITLRLGKAYEITYVRLKFHTSRPESFAIYKRSRADGPWEPYQFYSASCQKTYGRPEGQYLRPGEDERVAFCTSEFSDISPLSGGNVAFSTLEGRPSAYNFEESPGLQEWVTSTELLISLDRLNTFGDDIFKDPKVLQSYYYAVSDFSVGGRCKCNGHASECGPDVAGQLACRCQHNTTGTDCERCLPFFQDRPWARGTAEAAHECLPCNCSGRSEECTFDRELFRSTGHGGRCHHCRDHTAGPHCERCQENFYHWDPRMPCQPCDCQSAGSLHLQCDDTGTCACKPTVTGWKCDRCLPGFHSLSEGGCRPCTCNPAGSLDTCDPRSGRCPCKENVEGNLCDRCRPGTFNLQPHNPAGCSSCFCYGHSKVCASTAQFQVHHILSDFHQGAEGWWARSVGGSEHPPQWSPNGVLLSPEDEEELTAPEKFLGDQRFSYGQPLILTFRVPPGDSPLPVQLRLEGTGLALSLRHSSLSGPQDAGHPREVELRFHLQETSEDVAPPLPPFHFQRLLANLTSLRLRVSPGPSPAGPVFLTEVRLTSARPGLSPPASWVEICSCPTGYTGQFCESCAPGYKREMPQGGPYASCVPCTCNQHGTCDPNTGICVCSHHTEGPSCERCLPGFYGNPFAGQADDCQPCPCPGQSACTTIPESREVVCTHCPPGQRGRRCEVCDDGFFGDPLGLFGHPQPCHQCQCSGNVDPNAVGNCDPLSGHCLRCLHNTTGDHCEHCQEGFYGSALAPRPADKCMPCSCHPQGSVSEQMPCDPVTGQCSCLPHVTARDCSRCYPGFFDLQPGRGCRSCKCHPLGSQEDQCHPKTGQCTCRPGVTGQACDRCQLGFFGFSIKGCRACRCSPLGAASAQCHENGTCVCRPGFEGYKCDRCHDNFFLTADGTHCQQCPSCYALVKEEAAKLKARLTLTEGWLQGSDCGSPWGPLDILLGEAPRGDVYQGHHLLPGAREAFLEQMMSLEGAVKAAREQLQRLNKGARCAQAGSQKTCTQLADLEAVLESSEEEILHAAAILASLEIPQEGPSQPTKWSHLATEARALARSHRDTATKIAATAWRALLASNTSYALLWNLLEGRVALETQRDLEDRYQEVQAAQKALRTAVAEVLPEAESVLATVQQVGADTAPYLALLASPGALPQKSRAEDLGLKAKALEKTVASWQHMATEAARTLQTAAQATLRQTEPLTKLHQEARAALTQASSSVQAATVTVMGARTLLADLEGMKLQFPRPKDQAALQRKADSVSDRLLADTRKKTKQAERMLGNAAPLSSSAKKKGREAEVLAKDSAKLAKALLRERKQAHRRASRLTSQTQATLQQASQQVLASEARRQELEEAERVGAGLSEMEQQIRESRISLEKDIETLSELLARLGSLDTHQAPAQALNETQWALERLRLQLGSPGSLQRKLSLLEQESQQQELQIQGFESDLAEIRADKQNLEAILHSLPENCASWQ

SEQ ID NO: 6861 - protein, 416 aa, unidentified; identical to SEQ ID NO: 2336

SEQ ID NO: 6862 - protein, 721 aa, unidentified
MLPRGRPRALGAAALLLLLLLLGFLLFGGDLGCERREPGGRAGAPGCFPGPLMPRVPPDGRLRRAAALDGDPGAGPGDHNRSDCGPQPPPPPKCELLHVAIVCAGHNSSRDVITLVKSMLFYRKNPLHLHLVTDAVARNILETLFHTWMVPAVRVSFYHADQLKPQVSWIPNKHYSGLYGLMKLVLPSALPAELARVIVLDTDVTFASDISELWALFAHFSDTQAIGLVENQSDWYLGNLWKNHRPWPALGRGFNTGVILLRLDRLRQAGWEQMWRLTARRELLSLPATSLADQDIFNAVIKEHPGLVQRLPCVWNVQLSDHTLAERCYSEASDLKVIHWNSPKKLRVKNKHVEFFRNFYLTFLEYDGNLLRRELFVCPSQPPPGAEQLQQALAQLDEEDPCFEFRQQQLTVHRVHVTFLPHEPPPPRPHDVTLVAQLSMDRLQMLEALCRHWPGPMSLALYLTDAEAQQFLHFVEASPVLAARQDVAYHVVYREGPLYPVNQLRNVALAQALTPYVFLSDIDFLPAYSLYDYLRASIEQLGLGSRRKAALVVPAFETLRYRFSFPHSKVELLALLDAGTLYTFRYHEWPRGHAPTDYARWREAQAPYRVQWAANYEPYVVVPRDCPRYDPRFVGFGWNKVAHIVELDAQEYELLVLPEAFTIHLPHAPSLDISRFRSSPTYRDCLQALKDEFHQDLSRHHGAAALKYLPALQQPQSPARG

SEQ ID NO: 6863 - protein, 243 aa, unidentified
MSSGTELLWPGAALLVLLGVAASLCVRCSRPGAKRSEKIYQQRSLREDQQSFTGSRTYSLVGQAWPGPLADMAPTRKDKLLQFYPSLEDPASSRYQNFSKGSRHGSEEAYIDPIAMEYYNWGRFSKPPEDDDANSYENVLICKQKTTETGAQQEGIGGLCRGDLSLSLALKTGPTSGLCPSASPEEDEESEDYQNSASIHQWRESRKVMGQLQREASPGPVGSPDEEDGEPDYVNGEVAATEA

SEQ ID NO: 6864 - protein, 481 aa, unidentified
MGALARALPSILLALLLTSTPEALGANPGLVARITDKGLQYAAQEGLLALQSELLRITLPDFTGDLRIPHVGRGRYEFHSLNIHSCELLHSALRPVPGQGLSLSISDSSIRVQGRWKVRKSFFKLQGSFDVSVKGISISVNLLLGSESSGRPTVTASSCSSDIADVEVDMSGDLGWLLNLFHNQIESKFQKVLESRICEMIQKSVSSDLQPYLQTLPVTTEIDSFADIDYSLVEAPRATAQMLEVMFKGEIFHRNHRSPVTLLAAVMSLPEEHNKMVYFAISDYVFNTASLVYHEEGYLNFSITDDMIPPDSNIRLTTKSFRPFVPRLARLYPNMNLELQGSVPSAPLLNFSPGNLSVDPYMEIDAFVLLPSSSKEPVFRLSVATNVSATLTFNTSKITGFLKPGKVKVELKESKVGLFNAELLEALLNYYILNTFYPKFNDKLAEGFPLPLLKRVQLYDLGLQIHKDFLFLGANVQYMRV

SEQ ID NO: 6865 - protein, 440 aa, unidentified
MGPPGSPWQWVTLLLGLLLPPAAPFWLLNVLFPPHTTPKAELSNHTRPVILVPGCLGNQLEAKLDKPDVVNWMCYRKTEDFFTIWLDLNMFLPLGVDCWIDNTRVVYNRSSGLVSNAPGVQIRVPGFGKTYSVEYLDSSKLAGYLHTLVQNLVNNGYVRDETVRAAPYDWRLEPGQQEEYYRKLAGLVEEMHAAYGKPVFLIGHSLGCLHLLYFLLRQPQAWKDRFIDGFISLGAPWGGSIKPMLVLASGDNQGIPIMSSIKLKEEQRITTTSPWMFPSRMAWPEDHVFISTPSFNYTGRDFQRFFADLHFEEGWYMWLQSRDLLAGLPAPGVEVYCLYGVGLPTPRTYIYDHGFPYTDPVGVLYEDGDDTVATRSTELCGLWQGRQPQPVHLLPLHGIQHLNMVFSNLTLEHINAILLGAYRQGPPASPTASPEPPPPE

SEQ ID NO: 6866 - protein, 176 aa, unidentified
MKPLLLAVSLGLIAALQAHHLLASDEEIQDVSGTWYLKAMTVDREFPEMNLESVTPMTLTTLEGGNLEAKVTMLISGRCQEVKAVLEKTDEPGKYTADGGKHVAYIIRSHVKDHYIFYCEGELHGKPVRGVKLVGRDPKNNLEALEDFEKAAGARGLSTESILIPRQSETCSPGSD

SEQ ID NO: 6867 - protein, 187 aa, unidentified
MRQGLLVLALVLVLVLVLAAGSQVQEWYPRESHALNWNKFSGFWYILATATDAQGFLPARDKRKLGASVVKVNKVGQLRVLLAFRRGQGCGRAQPRHPGTSGHLWASLSVKGVKAFHVLSTDYSYGLVYLRLGRATQNYKNLLLFHRQNVSSFQSLKEFMDACDILGLSKAAVILPKDASRTHTILP

SEQ ID NO: 6868 - protein, 192 aa, unidentified
MRLLCGLWLWLSLLKVLQAQTPTPLPLPPPMQSFQGNQFQGEWFVLGLAGNSFRPEHRALLNAFTATFELSDDGRFEVWNAMTRGQHCDTWSYVLIPAAQPGQFTVDHGVEPGADREETRVVDSDYTQFALMLSRRHTSRLAVLRISLLGRSWLLPPGTLDQFICLGRAQGLSDDNIVFPDVTGWSPQASVC

SEQ ID NO: 6869 - protein, 184 aa, unidentified
MMSFLLGAILTLLWAPTAQAEVLLQPDFNAEKFSGLWYVVSMASDCRVFLGKKDHLSMSTRAIRPTEEGGLHVHMEFPGADGCNQVDAEYLKVGSEGHFRVPALGYLDVRIVDTDYSSFAVLYIYKELEGALSTMVQLYSRTQDVSPQALKSFQDFYPTLGLPKDMMVMLPQSDACNPESKEAP

SEQ ID NO: 6870 - protein, 198 aa, unidentified
MPLGLLWLGLALLGALHAQAQDSTSDLIPAPPLSKVPLQQNFQDNQFQGKWYVVGLAGNAILREDKDPQKMYATIYELKEDKSYNVTSVLFRKKKCDYWIRTFVPGCQPGEFTLGNIKSYPGLTSYLVRVVSTNYNQHAMVFFKKVSQNREYFKITLYGRTKELTSELKENFIRFSKSLGLPENHIVFPVPIDQCIDG

SEQ ID NO: 6871 - protein, 163 aa, unidentified
MGGLLLAAFLALVSVPRAQAVWLGRLDPEQLLGPWYVLAVASREKGFAMEKDMKNVVGVVVTLTPENNLRTLSSQHGLGGCDQSVMDLIKRNSGWVFENPSIGVLELWVLATNFRDYAIIFTQLEFGDEPFNTVELYSLTETASQEAMGLFTKWSRSLGFLSQ

SEQ ID NO: 6872 - protein, 175 aa, unidentified
MPGAAEALPTVTVTLVAGAVPPASGALTAHCIGGFWREVGVASDQSLVLTAPKRVEGLFLTLSGSNLTVKVAYNSSGSCEIEKIVGSEIDSTGKFAFPGHREIHVLDTDYEGYAILRVSLMWRGRNFRVLKYFTRSLEDKDRLGFWKFRELTADTGLYLAARPGRCAELLKEELI

SEQ ID NO: 6873 - protein, 176 aa, unidentified
MALLLLSLGLSLIAAQEFDPHTVMQRNYNVARVSGVWYSIFMASDDLNRIKENGDLRVFVRNIEHLKNGSLIFDFEYMVQGECVAVVVVCEKTEKNGEYSINYEGQNTVAVSETDYRLFITFHLQNFRNGTETHTLALYETCEKYGLGSQNIIDLTNKDPCYSKHYRSPPRPPMRW

SEQ ID NO: 6874 - protein, 518 aa, unidentified
MDEKCSFCNLQREAVSDCIPSLDSSQSTPTEELSSQGQSNTDKIECQAENYLNALFRKKDLPQNCDPNIPLVAQELMKKMIRQFAIEYISKSGKTQENRNGSIGPSIVCKSIQMNQAENSLQEEQEGPLDLTVNRMQEQNTQQGDGVLDLSTKKTSIKSEESSICDPSSENSVAGRLHRNREDYVERSAEFADGLLSKALKDIQSGALDINKAGILYGIPQKTLLLHLEALPAGKPASFKNKTRDFHDSYSYKDSKETCAVLQKVALWARAQAERTEKSKLNLLETSEIKFPTASTYLHQLTLQKMVTQFKEKNESLQYETSNPTVQLKIPQLRVSSVSKSQPDGSGLLDVMYQVSKTSSVLEGSALQKLKNILPKQNKIECSGPVTHSSVDSYFLHGDLSPLCLNSKNGTVDGTSENTEDGLDRKDSKQPRKKRGRYRQYDHEIMEEAIAMVMSGKMSVSKAQGIYGVPHSTLEYKVKERSGTLKTPPKKKLRLPDTGLYNMTDSGTGSCKNSSKPV

SEQ ID NO: 6875 - protein, 860 aa, unidentified [sequence omitted]

SEQ ID NO: 6876 - protein, 272 aa, unidentified
MEACCLLQLPQRLLLLGAAALTATALETADLAELCGQTWQGDGLLLRSHAASRRFYFVAPDTDCGLWVQAAAPGDRIRFQFRFFLVYSLTPAPPALNTSSPAPADPCAPGSYLQFYEGPPGAPRPLGSPLCGLNIPVPVASSGPFLGLRLVTRGRQPRVDFVGEVTSFRLGPCGAYFRCQNGRCIPSSLVCDPWGMDNCGDGSDQGSWSPADCRGPSPVPSQTGSTDAHTSRSLTPSPALGSAGSLWIAAERSSPAGRDPTRQDAALEGSTE

SEQ ID NO: 6877 - protein, 77 aa, unidentified
MWHLKLCAVLMIFLLLLGQIDGSPIPEVSSAKRRPRRMTPFWRGVSLRPIGASCRDDSECITRLCRKRRCSLSVAQE

SEQ ID NO: 6878 - protein, 151 aa, unidentified
MFSTKALLLAGLISTALAGPWANICAGKSSNEIRTCDRHGCGQYSAQRSQRPHQGVDILCSAGSTVYAPFTGMIVGQEKPYQNKNAINNGVRISGRGFCVKMFYIKPIKYKGPIKKGEKLGTLLPLQKVYPGIQSHVHIENCDSSDPTAYL

SEQ ID NO: 6879 - protein, 366 aa, unidentified
MQPLWLCWALWVLPLASPGAALTGEQLLGSLLRQLQLKEVPTLDRADMEELVIPTHVRAQYVALLQRSHGDRSRGKRFSQSFREVAGRFLALEASTHLLVFGMEQRLPPNSELVQAVLRLFQEPVPKAALHRHGRLSPRSARARVTVEWLRVRDDGSNRTSLIDSRLVSVHESGWKAFDVTEAVNFWQQLSRPRQPLLLQVSVQREHLGPLASGAHKLVRFASQGAPAGLGEPQLELHTLDLGDYGAQGDCDPEAPMTEGTRCCRQEMYIDLQGMKWAENWVLEPPGFLAYECVGTCRQPPEALAFKWPFLGPRQCIASETDSLPMIVSIKEGGRTRPQVVSLPNMRVQKCSCASDGALVPRRLQP

SEQ ID NO: 6880 - protein, 366 aa, unidentified
MWPLWLCWALWVLPLAGPGAALTEEQLLGSLLRQLQLSEVPVLDRADMEKLVIPAHVRAQYVVLLRRSHGDRSRGKRFSQSFREVAGRFLASEASTHLLVFGMEQRLPPNSELVQAVLRLFQEPVPKAALHRHGRLSPRSAQARVTVEWLRVRDDGSNRTSLIDSRLVSVHESGWKAFDVTEAVNFWQQLSRPRQPLLLQVSVQREHLGPLASGAHKLVRFASQGAPAGLGEPQLELHTLDLRDYGAQGDCDPEAPMTEGTRCCRQEMYIDLQGMKWAKNWVLEPPGFLAYECVGTCQQPPEALAFNWPFLGPRQCIASETASLPMIVSIKEGGRTRPQVVSLPNMRVQKCSCASDGALVPRRLQP

SEQ ID NO: 6881 - protein, 167 aa, unidentified
MHWGTLCGFLWLWPYLFYVQAVPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 6882 - protein, 379 aa, unidentified
MLKRCGRRLLLALAGALLACLLVLTADPPPPPLPAERGRRALRSLAGPAGAAPAPGLGAAAAAPGALVRDVHSLSEYFSLLTRARRDAGPPPGAAPRPADGHPRPLAEPLAPRDVFIAVKTTKKFHRARLDLLLETWISRHKEMTFIFTDGEDEALARHTGNVVITNCSAAHSRQALSCKMAVEYDRFIESGRKWFCHVDDDNYVNLRALLRLLASYPHTRDVYVGKPSLDRPIQAMERVSENKVRPVHFWFATGGAGFCISRGLALKMSPWASGGHFMNTAERIRLPDDCTIGYIVEALLGVPLIRSGLFHSHLENLQQVPTSELHEQVTLSYGMFENKRNAVHVKGPFSVEADPSRFRSIHCHLYPDTPWCPRTAIF

SEQ ID NO: 6883 - protein, 585 aa, unidentified
MTPPRLFWVWLLVAGTQGVNDGDMRLADGGATNQGRVEIFYRGQWGTVCDNLWDLTDASVVCRALGFENATQALGRAAFGQGSGPIMLDEVQCTGTEASLADCKSLGWLKSNCRHERDAGVVCTNETRSTHTLDLSRELSEALGQIFDSQRGCDLSISVNVQGEDALGFCGHTVILTANLEAQALWKEPGSNVTMSVDAECVPMVRDLLRYFYSRRIDITLSSVKCFHKLASAYGARQLQGYCASLFAILLPQDPSFQMPLDLYAYAVATGDALLEKLCLQFLAWNFEALTQAEAWPSVPTDLLQLLLPRSDLAVPSELALLKAVDTWSWGERASHEEVEGLVEKIRFPMMLPEELFELQFNLSLYWSHEALFQKKTLQALEFHTVPFQLLARYKGLNLTEDTYKPRIYTSPTWSAFVTDSSWSARKSQLVYQSRRGPLVKYSSDYFQAPSDYRYYPYQSFQTPQHPSFLFQDKRVSWSLVYLPTIQSCWNYGFSCSSDELPVLGLTKSGGSDRTIAYENKALMLCEGLFVADVTDFEGWKAAIPSALDTNSSKSTSSFPCPAGHFNGFRTVIRPFYLTNSSGVD

SEQ ID NO: 6884 - protein, 557 aa, unidentified
MESERSKRMGNACIPLKRIAYFLCLLSALLLTEGKKPAKPKCPAVCTCTKDNALCENARSIPRTVPPDVISLSFVRSGFTEISEGSFLFTPSLQLLLFTSNSFDVISDDAFIGLPHLEYLFIENNNIKSISRHTFRGLKSLIHLSLANNNLQTLPKDIFKGLDSLTNVDLRGNSFNCDCKLKWLVEWLGHTNATVEDIYCEGPPEYKKRKINSLSSKDFDCIITEFAKSQDLPYQSLSIDTFSYLNDEYVVIAQPFTGKCIFLEWDHVEKTFRNYDNITGTSTVVCKPIVIETQLYVIVAQLFGGSHIYKRDSFANKFIKIQDIEILKIRKPNDIETFKIENNWYFVVADSSKAGFTTIYKWNGNGFYSHQSLHAWYRDTDVEYLEIVRTPQTLRTPHLILSSSSQRPVIYQWNKATQLFTNQTDIPNMEDVYAVKHFSVKGDVYICLTRFIGDSKVMKWGGSSFQDIQRMPSRGSMVFQPLQINNYQYAILGSDYSFTQVYNWDAEKAKFVKFQELNVQAPRSFTHVSINKRNFLFASSFKGNTQIYKHVIVDLSA

SEQ ID NO: 6885 - protein, 545 aa, unidentified
MALRRGGCGALGLLLLLLGAACLIPRSAQVRRLARCPATCSCTKESIICVGSSWVPRIVPGDISSLSLVNGTFSEIKDRMFSHLPSLQLLLLNSNSFTIIRDDAFAGLFHLEYLFIEGNKIETISRNAFRGLRDLTHLSLANNHIKALPRDVFSDLDSLIELDLRGNKFECDCKAKWLYLWLKMTNSTVSDVLCIGPPEYQEKKLNDVTSFDYECTTTDFVVHQTLPYQSVSVDTFNSKNDVYVAIAQPSMENCMVLEWDHIEMNFRSYDNITGQSIVGCKAILIDDQVFVVVAQLFGGSHIYKYDESWTKFVKFQDIEVSRISKPNDIELFQIDDETFFVIADSSKAGLSTVYKWNSKGFYSYQSLHEWFRDTDAEFVDIDGKSHLILSSRSQVPIILQWNKSSKKFVPHGDIPNMEDVLAVKSFRMQNTLYLSLTRFIGDSRVMRWNSKQFVEIQALPSRGAMTLQPFSFKDNHYLALGSDYTFSQIYQWDKEKQLFKKFKEIYVQAPRSFTAVSTDRRDFFFASSFKGKTKIFEHIIVDLSL

SEQ ID NO: 6886 - protein, 548 aa, unidentified
MAGLRARGGPGPGLLALSALGFCLMLQVSAKRPPKTPPCPPSCSCTRDTAFCVDSKAVPRNLPSEVISLTLVNAAFSEIQDGAFSHLPLLQFLLLNSNKFTLIGDNAFTGLSHLQYLFIENNDIWALSKFTFRGLKSLTHLSLANNNLQTLPRDIFRPLDILNDLDLRGNSLNCDCKVKWLVEWLAHTNTTVAPIYCASPPRFQEHKVQDLPLREFDCITTDFVLYQTLAFPAVSAEPFLYSSDLYLALAQPGVSACTILKWDYVERQLRDYDRIPAPSAVHCKPMVVDSQLYVVVAQLFGGSYIYHWDPNTTRFTRLQDIDPQRVRKPNDLEAFRIDGDWYFAVADSSKAGATSLYRWHQNGFYSHQALHPWHRDTDLEFVDGEGKPRLIVSSSSQAPVIYQWSRTQKQFVAQGEVTQVPDAQAVKHFRAGRDSYLCLSRYIGDSKILRWEGTRFSEVQALPSRGSLALQPFLVGGRRYLALGSDFSFTQIYQWDEGRQKFVRFQELAVQAPRAFCYMPAGDAQLLLAPSFKGQTLVYRHIVVDLSA

SEQ ID NO: 6887 - protein, 537 aa, unidentified
MGGAGILLLLLAGAGVVVAWRPPKGKCPLRCSCSKDSALCEGSPDLPVSFSPTLLSLSLVRTGVTQLKAGSFLRIPSLHLLLFTSNSFSVIEDDAFAGLSHLQYLFIEDNEIGSISKNALRGLRSLTHLSLANNHLETLPRFLFRGLDTLTHVDLRGNPFQCDCRVLWLLQWMPTVNASVGTGACAGPASLSHMQLHHLDPKTFKCRAIELSWFQTVGESALSVEPFSYQGEPHIVLAQPFAGRCLILSWDYSLQRFRPEEELPAASVVSCKPLVLGPSLFVLAARLWGGSQLWARPSPGLRLAPTQTLAPRRLLRPNDAELLWLEGQPCFVVADASKAGSTTLLCRDGPGFYPHQSLHAWHRDTDAEALELDGRPHLLLASASQRPVLFHWTGGRFERRTDIPEAEDVYATRHFQAGGDVFLCLTRYIGDSMVMRWDGSMFRLLQQLPSRGAHVFQPLLIARDQLAILGSDFAFSQVLRLEPDKGLLEPLQELGPPALVAPRAFAHITMAGRRFLFAACFKGPTQIYQHHEIDLSA

SEQ ID NO: 6888 - protein, 433 aa, unidentified
MVWKVAVFLSVALGIGAVPIDDPEDGGKHWVVIVAGSNGWYNYRHQADACHAYQIIHRNGIPDEQIVVMMYDDIAYSEDNPTPGIVINRPNGTDVYQGVPKDYTGEDVTPQNFLAVLRGDAEAVKGIGSGKVLKSGPQDHVFIYFTDHGSTGILVFPNEDLHVKDLNETIHYMYKHKMYRKMVFYIEACESGSMMNHLPDNINVYATTAANPRESSYACYYDEKRSTYLGDWYSVNWMEDSDVEDLTKETLHKQYHLVKSHTNTSHVMQYGNKTISTMKVMQFQGMKRKASSPVPLPPVTHLDLTPSPDVPLTIMKRKLMNTNDLEESRQLTEEIQRHLDARHLIEKSVRKIVSLLAASEAEVEQLLSERAPLTGHSCYPEALLHFRTHCFNWHSPTYEYALRHLYVLVNLCEKPYPLHRIKLSMDHVCLGHY

SEQ ID NO: 6889 - protein, 951 aa, unidentified; identical to SEQ ID NO: 2363

SEQ ID NO: 6890 - protein, 141 aa, unidentified
MEMLQGLLLLLLLSMGGAWASREPLRPWCHPINAILAVEKEGCPVCITVNTTICAGYCPTMMRVLQAVLPPLPQVVCTYRDVRFESIRLPGCPRGVDPVVSFPVALSCRCGPCRRSTSDCGGPKDHPLTCDHPQLSGLLFL

SEQ ID NO: 6891 - protein, 699 aa, unidentified; identical to SEQ ID NO: 2366

SEQ ID NO: 6892 - protein, 202 aa, unidentified
MKVLAAGVVPLLLVLHWKHGAGSPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKYHVGHVDVTYGPDTSGKDVFQKKKLGCQLLGKYKQIIAVLAQAF

SEQ ID NO: 6893 - protein, 1097 aa, unidentified; identical to SEQ ID NO: 2373

SEQ ID NO: 6894 - protein, 483 aa, unidentified; identical to SEQ ID NO: 2375

SEQ ID NO: 6895 - protein, 631 aa, unidentified; identical to SEQ ID NO: 2380

SEQ ID NO: 6896 - protein, 295 aa, unidentified
MGLPVSWAPPALWVLGCCALLLSLWALCTACRRPEDAVAPRKRARRQRARLQGSATAAEASLLRRTHLCSLSKSDTRLHELHRGPRSSRALRPASMDLLRPHWLEVSRDITGPQAAPSAFPHQELPRALPAAAATAGCAGLEATYSNVGLAALPGVSLAASPVVAEYARVQKRKGTHRSPQEPQQGKTEVTPAAQVDVLYSRVCKPKRRDPGPTTDPLDPKGQGAILALAGDLAYQTLPLRALDVDSGPLENVYESIRELGDPAGRSSTCGAGTPPASSCPSLGRGWRPLPASLP

SEQ ID NO: 6897 - protein, 620 aa, unidentified; identical to SEQ ID NO: 2384

SEQ ID NO: 6898 - protein, 399 aa, unidentified
MKMRFLGLVVCLVLWTLHSEGSGGKLTAVDPETNMNVSEIISYWGFPSEEYLVETEDGYILCLNRIPHGRKNHSDKGPKPVVFLQHGLLADSSNWVTNLANSSLGFILADAGFDVWMGNSRGNTWSRKHKTLSVSQDEFWAFSYDEMAKYDLPASINFILNKTGQEQVYYVGHSQGTTIGFIAFSQIPELAKRIKMFFALGPVASVAFCTSPMAKLGRLPDHLIKDLFGDKEFLPQSAFLKWLGTHVCTHVILKELCGNLCFLLCGFNERNLNMSRVDVYTTHSPAGTSVQNMLHWSQAVKFQKFQAFDWGSSAKNYFHYNQSYPPTYNVKDMLVPTAVWSGGHDWLADVYDVNILLTQITNLVFHESIPEWEHLDFIWGLDAPWRLYNKIINLMRKYQ

SEQ ID NO: 6899 - protein, 499 aa, unidentified
MDTSPLCFSILLVLCIFIQSSALGQSLKPEPFGRRAQAVETNKTLHEMKTRFLLFGETNQGCQIRINHPDTLQECGFNSSLPLVMIIHGWSVDGVLENWIWQMVAALKSQPAQPVNVGLVDWITLAHDHYTIAVRNTRLVGKEVAALLRWLEESVQLSRSHVHLIGYSLGAHVSGFAGSSIGGTHKIGRITGLDAAGPLFEGSAPSNRLSPDDANFVDAIHTFTREHMGLSVGIKQPIGHYDFYPNGGSFQPGCHFLELYRHIAQHGFNAITQTIKCSHERSVHLFIDSLLHAGTQSMAYPCGDMNSFSQGLCLSCKKGRCNTLGYHVRQEPRSKSKRLFLVTRAQSPFKVYHYQFKIQFINQTETPIQTTFTMSLLGTKEKMQKIPITLGKGIASNKTYSFLITLDVDIGELIMIKFKWENSAVWANVWDTVQTIIPWSTGPRHSGLVLKTIRVKAGETQQRMTFCSENTDDLLLRPTQEKIFVKCEIKSKTSKRKIR

SEQ ID NO: 6900 - protein, 398 aa, unidentified
MWLLLTMASLISVLGTTHGLFGKLHPGSPEVTMNISQMITYWGYPNEEYEVVTEDGYILEVNRIPYGKKNSGNTGQRPVVFLQHGLLASATNWISNLPNNSLAFILADAGYDVWLGNSRGNTWARRNLYYSPDSVEFWAFSFDEMAKYDLPATIDFIVKKTGQKQLHYVGHSQGTTIGFIAFSTNPSLAKRIKTFYALAPVATVKYTKSLINKLRFVPQSLFKFIFGDKIFYPHNFFDQFLATEVCSREMLNLLCSNALFIICGFDSKNFNTSRLDVYLSHNPAGTSVQNMFHWTQAVKSGKFQAYDWGSPVQNRMHYDQSQPPYYNVTAMNVPIAVWNGGKDLLADPQDVGLLLPKLPNLIYHKEIPFYNHLDFIWAMDAPQEVYNDIVSMISEDKK

SEQ ID NO: 6901 - protein, 500 aa, unidentified
MSNSVPLLCFWSLCYCFAAGSPVPFGPEGRLEDKLHKPKATQTEVKPSVRFNLRTSKDPEHEGCYLSVGHSQPLEDCSFNMTAKTFFIIHGWTMSGIFENWLHKLVSALHTREKDANVVVVDWLPLAHQLYTDAVNNTRVVGHSIARMLDWLQEKDDFSLGNVHLIGYSLGAHVAGYAGNFVKGTVGRITGLDPAGPMFEGADIHKRLSPDDADFVDVLHTYTRSFGLSIGIQMPVGHIDIYPNGGDFQPGCGLNDVLGSIAYGTITEVVKCEHERAVHLFVDSLVNQDKPSFAFQCTDSNRFKKGICLSCRKNRCNSIGYNAKKMRNKRNSKMYLKTRAGMPFRVYHYQMKIHVFSYKNMGEIEPTFYVTLYGTNADSQTLPLEIVERIEQNATNTFLVYTEEDLGDLLKIQLTWEGASQSWYNLWKEFRSYLSQPRNPGRELNIRRIRVKSGETQRKLTFCTEDPENTSISPGRELWFRKCRDGWRMKNETSPTVELP

SEQ ID NO: 6902 - protein, 451 aa, unidentified
MLRFYLFISLLCLSRSDAEETCPSFTRLSFHSAVVGTGLNVRLMLYTRKNLTCAQTINSSAFGNLNVTKKTTFIVHGFRPTGSPPVWMDDLVKGLLSVEDMNVVVVDWNRGATTLIYTHASSKTRKVAMVLKEFIDQMLAEGASLDDIYMIGVSLGAHISGFVGEMYDGWLGRITGLDPAGPLFNGKPHQDRLDPSDAQFVDVIHSDTDALGYKEPLGNIDFYPNGGLDQPGCPKTILGGFQYFKCDHQRSVYLYLSSLRESCTITAYPCDSYQDYRNGKCVSCGTSQKESCPLLGYYADNWKDHLRGKDPPMTKAFFDTAEESPFCMYHYFVDIITWNKNVRRGDITIKLRDKAGNTTESKINHEPTTFQKYHQVSLLARFNQDLDKVAAISLMFSTGSLIGPRYKLRILRMKLRSLAHPERPQLCRYDLVLMENVETVFQPILCPELQL

SEQ ID NO: 6903 - protein, 399 aa, unidentified
MWQLLAAACWMLLLGSMYGYDKKGNNANPEANMNISQIISYWGYPYEEYDVTTKDGYILGIYRIPHGRGCPGRTAPKPAVYLQHGLIASASNWICNLPNNSLAFLLADSGYDVWLGNSRGNTWSRKHLKLSPKSPEYWAFSLDEMAKYDLPATINFIIEKTGQKRLYYVGHSQGTTIAFIAFSTNPELAKKIKIFFALAPVVTVKYTQSPMKKLTTLSRRVVKVLFGDKMFHPHTLFDQFIATKVCNRKLFRRICSNFLFTLSGFDPQNLNMSRLDVYLSHNPAGTSVQNMLHWAQAVNSGQLQAFDWGNSDQNMMHFHQLTPPLYNITKMEVPTAIWNGGQDIVADPKDVENLLPQIANLIYYKLIPHYNHVDFYLGEDAPQEIYQDLIILMEEYLQN

SEQ ID NO: 6904 - protein, 423 aa, unidentified
MLETLSRQWIVSHRMEMWLLILVAYMFQRNVNSVHMPTKAVDPEAFMNISEIIQHQGYPCEEYEVATEDGYILSVNRIPRGLVQPKKTGSRPVVLLQHGLVGGASNWISNLPNNSLGFILADAGFDVWMGNSRGNAWSRKHKTLSIDQDEFWAFSYDEMARFDLPAVINFILQKTGQEKIYYVGYSQGTTMGFIAFSTMPELAQKIKMYFALAPIATVKHAKSPGTKFLLLPDMMIKGLFGKKEFLYQTRFLRQLVIYLCGQVILDQICSNIMLLLGGFNTNNMNMSRASVYAAHTLAGTSVQNILHWSQAVNSGELRAFDWGSETKNLEKCNQPTPVRYRVRDMTVPTAMWTGGQDWLSNPEDVKMLLSEVTNLIYHKNIPEWAHVDFIWGLDAPHRMYNEIIHLMQQEETNLSQGRCEAVL

SEQ ID NO: 6905 - protein, 398 aa, unidentified
MMWLLLTTTCLICGTLNAGGFLDLENEVNPEVWMNTSEIIIYNGYPSEEYEVTTEDGYILLVNRIPYGRTHARSTGPRPVVYMQHALFADNAYWLENYANGSLGFLLADAGYDVWMGNSRGNTWSRRHKTLSETDEKFWAFSFDEMAKYDLPGVIDFIVNKTGQEKLYFIGHSLGTTIGFVAFSTMPELAQRIKMNFALGPTISFKYPTGIFTRFFLLPNSIIKAVFGTKGFFLEDKKTKIASTKICNNKILWLICSEFMSLWAGSNKKNMNQSRMDVYMSHAPTGSSVHNILHIKQLYHSDEFRAYDWGNDADNMKHYNQSHPPIYDLTAMKVPTAIWAGGHDVLVTPQDVARILPQIKSLHYFKLLPDWNHFDFVWGLDAPQRMYSEIIALMKAYS

SEQ ID NO: 6906 - protein, 356 aa, unidentified; identical to SEQ ID NO: 2391

SEQ ID NO: 6907 - protein, 388 aa, unidentified
MLEGSWINRREDKLGVYSLVHFSPKMLGSVATTLPLSSSNSSGMPLGYYLSSPQISRVTISTTGQLTSKATVGSCSRVENSLDASPFSVPKKQDESPMIGDGEDYFLSLFGDSKKLTAHSNYTQKTLKYFSMILEEVGQFTSSSLGDVEIAEVNVKGLFVKLINSSLDKEMAIGDHILQQNVNGQTISLYRFLPNIVMQANSTVTVWAAASEAKHQPPSDFLWKEQDKFRASPDCITILCKPNGQAIAWYTPIHWKQAWEKLDADVEFNRCSVVSPTFRKRVFQWTASTATITKEKQDQPKKDISNYQVEQAQVLLKREKEIPPTVFPNRSPWCQNPYVSAHPYCPLIEPHNTSTAGGRLDRQPRTRSTRPNRASGSKKKKTSESQKQ

SEQ ID NO: 6908 - protein, 728 aa, unidentified
MNQPESANDPEPLCAVCGQAHSLEENHFYSYPEEVDDDLICHICLQALLDPLDTPCGHTYCTLCLTNFLVEKDFCPMDRKPLVLQHCKKSSILVNKLLNKLLVTCPFREHCTQVLQRCDLEHHFQTSCKGASHYGLTKDRKRRSQDGCPDGCASLTATAPSPEVSAAATISLMTDEPGLDNPAYVSSAEDGQPAISPVDSGRSNRTRARPFERSTIRSRSFKKINRALSVLRRTKSGSAVANHADQGRENSENTTAPEVFPRLYHLIPDGEITSIKINRVDPSESLSIRLVGGSETPLVHIIIQHIYRDGVIARDGRLLPGDIILKVNGMDISNVPHNYAVRLLRQPCQVLWLTVMREQKFRSRNNGQAPDAYRPRDDSFHVILNKSSPEEQLGIKLVRKVDEPGVFIFNVLDGGVAYRHGQLEENDRVLAINGHDLRYGSPESAAHLIQASERRVHLVVSRQVRQRSPDIFQEAGWNSNGSWSPGPGERSNTPKPLHPTITCHEKVVNIQKDPGESLGMTVAGGASHREWDLPIYVISVEPGGVISRDGRIKTGDILLNVDGVELTEVSRSEAVALLKRTSSSIVLKALEVKEYEPQEDCSSPAALDSNHNMAPPSDWSPSWVMWLELPRCLYNCKDIVLRRNTAGSLGFCIVGGYEEYNGNKPFFIKSIVEGTPAYNDGRIRCGDILLAVNGRSTSGMIHACLARLLKELKGRITLTIVSWPGTFL

SEQ ID NO: 6909 - protein, 417 aa, unidentified
MRFAWTVLLLGPLQLCALVHCAPPAAGQQQPPREPPAAPGAWRQQIQWENNGQVFSLLSLGSQYQPQRRRDPGAAVPGAANASAQQPRTPILLIRDNRTAAARTRTAGSSGVTAGRPRPTARHWFQAGYSTSRAREAGASRAENQTAPGEVPALSNLRPPSRVDGMVGDDPYNPYKYSDDNPYYNYYDTYERPRPGGRYRPGYGTGYFQYGLPDLVADPYYIQASTYVQKMSMYNLRCAAEENCLASTAYRADVRDYDHRVLLRFPQRVKNQGTSDFLPSRPRYSWEWHSCHQHYHSMDEFSHYDLLDANTQRRVAEGHKASFCLEDTSCDYGYHRRFACTAHTQGLSPGCYDTYGADIDCQWIDITDVKPGNYILKVSVNPSYLVPESDYTNNVVRCDIRYTGHHAYASGCTISPY

SEQ ID NO: 6910 - protein, 574 aa, unidentified
MALARGSRQLGALVWGACLCVLVHGQQAQPGQGSDPARWRQLIQWENNGQVYSLLNSGSEYVPAGPQRSESSSRVLLAGAPQAQQRRSHGSPRRRQAPSLPLPGRVGSDTVRGQARHPFGFGQVPDNWREVAVGDSTGMARARTSVSQQRHGGSASSVSASAFASTYRQQPSYPQQFPYPQAPFVSQYENYDPASRTYDQGFVYYRPAGGGVGAGAAAVASAGVIYPYQPRARYEEYGGGEELPEYPPQGFYPAPERPYVPPPPPPPDGLDRRYSHSLYSEGTPGFEQAYPDPGPEAAQAHGGDPRLGWYPPYANPPPEAYGPPRALEPPYLPVRSSDTPPPGGERNGAQQGRLSVGSVYRPNQNGRGLPDLVPDPNYVQASTYVQRAHLYSLRCAAEEKCLASTAYAPEATDYDVRVLLRFPQRVKNQGTADFLPNRPRHTWEWHSCHQHYHSMDEFSHYDLLDAATGKKVAEGHKASFCLEDSTCDFGNLKRYACTSHTQGLSPGCYDTYNADIDCQWIDITDVQPGNYILKVHVNPKYIVLESDFTNNVVRCNIHYTGRYVSATNCKIVQS

SEQ ID NO: 6911 - protein, 774 aa, unidentified
MERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIENLNIQVEDIRIRAILSTYRKRTPVMEGYVEVKEGKTWKQICDKHWTAKNSRVVCGMFGFPGERTYNTKVYKMFASRRKQRYWPFSMDCTGTEAHISSCKLGPQVSLDPMKNVTCENGLPAVVSCVPGQVFSPDGPSRFRKAYKPEQPLVRLRGGAYIGEGRVEVLKNGEWGTVCDDKWDLVSASVVCRELGFGSAKEAVTGSRLGQGIGPIHLNEIQCTGNEKSIIDCKFNAESQGCNHEEDAGVRCNTPAMGLQKKLRLNGGRNPYEGRVEVLVERNGSLVWGMVCGQNWGIVEAMVVCRQLGLGFASNAFQETWYWHGDVNSNKVVMSGVKCSGTELSLAHCRHDGEDVACPQGGVQYGAGVACSETAPDLVLNAEMVQQTTYLEDRPMFMLQCAMEENCLSASAAQTDPTTGYRRLLRFSSQIHNNGQSDFRPKNGRHAWIWHDCHRHYHSMEVFTHYDLLNLNGTKVAEGHKASFCLEDTECEGDIQKNYECANFGDQGITMGCWDMYRHDIDCQWVDITDVPPGDYLFQVVINPNFEVAESDYSNNIMKCRSRYDGHRIWMYNCHIGGSFSEETEKKFEHFSGLLNNQLSPQ

SEQ ID NO: 6912 - protein, 753 aa, unidentified
MRPVSVWQWSPWGLLLCLLCSSCLGSPSPSTGPEKKAGSQGLRFRLAGFPRKPYEGRVEIQRAGEWGTICDDDFTLQAAHILCRELGFTEATGWTHSAKYGPGTGRIWLDNLSCSGTEQSVTECASRGWGNSDCTHDEDAGVICKDQRLPGFSDSNVIEVEHHLQVEEVRIRPAVGWGRRPLPVTEGLVEVRLPDGWSQVCDKGWSAHNSHVVCGMLGFPSEKRVNAAFYRLLAQRQQHSFGLHGVACVGTEAHLSLCSLEFYRANDTARCPGGGPAVVSCVPGPVYAASSGQKKQQQSKPQGEARVRLKGGAHPGEGRVEVLKASTWGTVCDRKWDLHAASVVCRELGFGSAREALSGARMGQGMGAIHLSEVRCSGQELSLWKCPHKNITAEDCSHSQDAGVRCNLPYTGAETRIRLSGGRSQHEGRVEVQIGGPGPLRWGLICGDDWGTLEAMVACRQLGLGYANHGLQETWYWDSGNITEVVMSGVRCTGTELSLDQCAHHGTHITCKRTGTRFTAGVICSETASDLLLHSALVQETAYIEDRPLHMLYCAAEENCLASSARSANWPYGHRRLLRFSSQIHNLGRADFRPKAGRHSWVWHECHGHYHSMDIFTHYDILTPNGTKVAEGHKASFCLEDTECQEDVSKRYECANFGEQGITVGCWDLYRHDIDCQWIDITDVKPGNYILQVVINPNFEVAESDFTNNAMKCNCKYDGHRIWVHNCHIGDAFSEEANRRFERYPGQTSNQII

SEQ ID NO: 6913 - protein, 756 aa, unidentified
MAWSPPATLFLFLLLLGQPPPSRPQSLGTTKLRLVGPESKPEEGRLEVLHQGQWGTVCDDNFAIQEATVACRQLGFEAALTWAHSAKYGQGEGPIWLDNVRCVGTESSLDQCGSNGWGVSDCSHSEDVGVICHPRRHRGYLSETVSNALGPQGRRLEEVRLKPILASAKQHSPVTEGAVEVKYEGHWRQVCDQGWTMNNSRVVCGMLGFPSEVPVDSHYYRKVWDLKMRDPKSRLKSLTNKNSFWIHQVTCLGTEPHMANCQVQVAPARGKLRPACPGGMHAVVSCVAGPHFRPPKTKPQRKGSWAEEPRVRLRSGAQVGEGRVEVLMNRQWGTVCDHRWNLISASVVCRQLGFGSAREALFGARLGQGLGPIHLSEVRCRGYERTLSDCPALEGSQNGCQHENDAAVRCNVPNMGFQNQVRLAGGRIPEEGLLEVQVEVNGVPRWGSVCSENWGLTEAMVACRQLGLGFAIHAYKETWFWSGTPRAQEVVMSGVRCSGTELALQQCQRHGPVHCSHGGGRFLAGVSCMDSAPDLVMNAQLVQETAYLEDRPLSQLYCAHEENCLSKSADHMDWPYGYRRLLRFSTQIYNLGRTDFRPKTGRDSWVWHQCHRHYHSIEVFTHYDLLTLNGSKVAEGHKASFCLEDTNCPTGLQRRYACANFGEQGVTVGCWDTYRHDIDCQWVDITDVGPGNYIFQVIVNPHYEVAESDFSNNMLQCRCKYDGHRVWLHNCHTGNSYPANAELSLEQEQRLRNNLI

SEQ ID NO: 6914 - protein, 475 aa, unidentified
MESKALLVLTLAVWLQSLTASRGGVAAADQRRDFIDIESKFALRTPEDTAEDTCHLIPGVAESVATCHFNHSSKTFMVIHGWTVTGMYESWVPKLVAALYKREPDSNVIVVDWLSRAQEHYPVSAGYTKLVGQDVARFINWMEEEFNYPLDNVHLLGYSLGAHAAGIAGSLTNKKVNRITGLDPAGPNFEYAEAPSRLSPDDADFVDVLHTFTRGSPGRSIGIQKPVGHVDIYPNGGTFQPGCNIGEAIRVIAERGLGDVDQLVKCSHERSIHLFIDSLLNEENPSKAYRCSSKEAFEKGLCLSCRKNRCNNLGYEINKVRAKRSSKMYLKTRSQMPYKVFHYQVKIHFSGTESETHTNQAFEISLYGTVAESENIPFTLPEVSTNKTYSFLIYTEVDIGELLMLKLKWKSDSYFSWSDWWSSPGFAIQKIRVKAGETQKKVIFCSREKVSHLQKGKAPAVFVKCHDKSLNKKSG

SEQ ID NO: 6915 - protein, 712 aa, unidentified
MRVLLHLPALLASLILLQAAASTTRAQTTRTSAISDTVSQAKVQVNKAFLDSRTRLKTAMSSETPTSRQLSEYLKHAKGRTRTAIRNGQVWEESLKRLRQKASLTNVTDPSLDLTSLSLEVGCGAPAPVVRCDPCSPYRTITGDCNNRRKPALGAANRALARWLPAEYEDGLSLPFGWTPGKTRNGFPLPLAREVSNKIVGYLNEEGVLDQNRSLLFMQWGQIVDHDLDFAPDTELGSSEYSKAQCDEYCIQGDNCFPIMFPPNDPKAGTQGKCMPFFRAGFVCPTPPYKSLAREQINALTSFLDASFVYSSEPSLASRLRNLSSPLGLMAVNQEVSDHGLPYLPYDSKKPSPCEFINTTARVPCFLAGDSRASEHILLATSHTLFLREHNRLARELKRLNPQWDGEKLYQEARKILGAFVQIITFRDYLPILLGDHMQKWIPPYQGYSESVDPRISNVFTFAFRFGHLEVPSSMFRLDENYQPWGPEPELPLHTLFFNTWRMVKDGGIDPLVRGLLAKKSKLMKQNKMMTGELRNKLFQPTHRIHGFDLAAINTQRCRDHGQPGYNSWRAFCDLSQPQTLEELNTVLKSKMLAKKLLGLYGTPDNIDIWIGAIAEPLVERGRVGPLLACLLGKQFQQIRDGDRFWWENPGVFTNEQKDSLQKMSFSRLVCDNTRITKVPRDPFWANSYPYDFVDCSAIDKLDLSPWASVKN

SEQ ID NO: 6916 - protein, 230 aa, unidentified; identical to SEQ ID NO: 2415

SEQ ID NO: 6917 - protein, 777 aa, unidentified; identical to SEQ ID NO: 2418

SEQ ID NO: 6918 - protein, 635 aa, unidentified; identical to SEQ ID NO: 2423

SEQ ID NO: 6919 - protein, 719 aa, unidentified; identical to SEQ ID NO: 2424

SEQ ID NO: 6920 - protein, 347 aa, unidentified
MSSWSRQRPKSPGGIQPHVSRTLFLLLLLAASAWGVTLSPKDCQVFRSDHGSSISCQPPAEIPGYLPADTVHLAVEFFNLTHLPANLLQGASKLQELHLSSNGLESLSPEFLRPVPQLRVLDLTRNALTGLPPGLFQASATLDTLVLKENQLEVLEVSWLHGLKALGHLDLSGNRLRKLPPGLLANFTLLRTLDLGENQLETLPPDLLRGPLQLERLHLEGNKLQVLGKDLLLPQPDLRYLFLNGNKLARVAAGAFQGLRQLDMLDLSNNSLASVPEGLWASLGQPNWDMRDGFDISGNPWICDQNLSDLYRWLQAQKDKMFSQNDTRCAGPEAVKGQTLLAVAKSQ

SEQ ID NO: 6921 - protein, 4544 aa, unidentified; identical to SEQ ID NO: 2432

SEQ ID NO: 6922 - protein, 500 aa, unidentified; identical to SEQ ID NO: 2434

SEQ ID NO: 6923 - protein, 4599 aa, unidentified; identical to SEQ ID NO: 2436

SEQ ID NO: 6924 - protein, 4655 aa, unidentified; identical to SEQ ID NO: 2437

SEQ ID NO: 6925 - protein, 1905 aa, unidentified; identical to SEQ ID NO: 2439

SEQ ID NO: 6926 - protein, 357 aa, unidentified
MAPRRVRSFLRGLPALLLLLLFLGPWPAASHGGKYSREKNQPKPSPKRESGEEFRMEKLNQLWEKAQRLHLPPVRLAELHADLKIQERDELAWKKLKLDGLDEDGEKEARLIRNLNVILAKYGLDGKKDARQVTSNSLSGTQEDGLDDPRLEKLWHKAKTSGKFSGEELDKLWREFLHHKEKVHEYNVLLETLSRTEEIHENVISPSDLSDIKGSVLHSRHTELKEKLRSINQGLDRLRRVSHQGYSTEAEFEEPRVIDLWDLAQSANLTDKELEAFREELKHFEAKIEKHNHYQKQLEIAHEKLRHAESVGDGERVSRSREKHALLEGRTKELGYTVKKHLQDLSGRISRARHNEL

SEQ ID NO: 6927 - protein, 441 aa, unidentified
MRVVTIVILLCFCKAAELRKASPGSVRSRVNHGRAGGGRRGSNPVKRYAPGLPCDVYTYLHEKYLDCQERKLVYVLPGWPQDLLHMLLARNKIRTLKNNMFSKFKKLKSLDLQQNEISKIESEAFFGLNKLTTLLLQHNQIKVLTEEVFIYTPLLSYLRLYDNPWHCTCEIETLISMLQIPRNRNLGNYAKCESPQEQKNKKLRQIKSEQLCNEEEKEQLDPKPQVSGRPPVIKPEVDSTFCHNYVFPIQTLDCKRKELKKVPNNIPPDIVKLDLSYNKINQLRPKEFEDVHELKKLNLSSNGIEFIDPAAFLGLTHLEELDLSNNSLQNFDYGVLEDLYFLKLLWLRDNPWRCDYNIHYLYYWLKHHYNVHFNGLECKTPEEYKGWSVGKYIRSYYEECPKDKLPAYPESFDQDTEDDEWEKKHRDHTAKKQSVIITIVG

SEQ ID NO: 6928 - protein, 662 aa, unidentified; identical to SEQ ID NO: 2449

SEQ ID NO: 6929 - protein, 259 aa, unidentified; identical to SEQ ID NO: 2455

SEQ ID NO: 6930 - protein, 713 aa, unidentified; identical to SEQ ID NO: 2458

SEQ ID NO: 6931 - protein, 622 aa, unidentified; identical to SEQ ID NO: 2464

SEQ ID NO: 6932 - protein, 708 aa, unidentified; identical to SEQ ID NO: 2472

SEQ ID NO: 6933 - protein, 522 aa, unidentified; identical to SEQ ID NO: 2475

SEQ ID NO: 6934 - protein, 516 aa, unidentified; identical to SEQ ID NO: 2476

SEQ ID NO: 6935 - protein, 590 aa, unidentified; identical to SEQ ID NO: 2478

SEQ ID NO: 6936 - protein, 370 aa, unidentified; identical to SEQ ID NO: 2480

SEQ ID NO: 6937 - protein, 649 aa, unidentified; identical to SEQ ID NO: 2485

SEQ ID NO: 6938 - protein, 97 aa, unidentified; identical to SEQ ID NO: 2486

SEQ ID NO: 6939 - protein, 205 aa, unidentified
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 6940 - protein, 1721 aa, unidentified
MAGAWLRWGLLLWAGLLASSAHGRLRRITYVVHPGPGLAAGALPLSGPPRSRTFNVALNARYSRSSAAAGAPSRASPGVPSERTRRTSKPGGAALQGLRPPPPPPPEPARPAVPGGQLHPNPGGHPAAAPFTKQGRQVVRSKVPQETQSGGGSRLQVHQKQQLQGVNVCGGRCCHGWSKAPGSQRCTKPSCVPPCQNGGMCLRPQLCVCKPGTKGKACETIAAQDTSSPVFGGQSPGAASSWGPPEQAAKHTSSKKADTLPRVSPVAQMTLTLKPKPSVGLPQQIHSQVTPLSSQSVVIHHGQTQEYVLKPKYFPAQKGISGEQSTEGSFPLRYVQDQVAAPFQLSNHTGRIKVVFTPSICKVTCTKGSCQNSCEKGNTTTLISENGHAADTLTATNFRVVICHLPCMNGGQCSSRDKCQCPPNFTGKLCQIPVHGASVPKLYQHSQQPGKALGTHVIHSTHTLPLTVTSQQGVKVKFPPNIVNIHVKHPPEASVQIHQVSRIDGPTGQKTKEAQPGQSQVSYQGLPVQKTQTIHSTYSHQQVIPHVYPVAAKTQLGRCFQETIGSQCGKALPGLSKQEDCCGTVGTSWGFNKCQKCPKKPSYHGYNQMMECLPGYKRVNNTFCQDINECQLQGVCPNGECLNTMGSYRCTCKIGFGPDPTFSSCVPDPPVISEEKGPCYRLVSSGRQCMHPLSVHLTKQLCCCSVGKAWGPHCEKCPLPGTAAFKEICPGGMGYTVSGVHRRRPIHHHVGKGPVFVKPKNTQPVAKSTHPPPLPAKEEPVEALTFSREHGPGVAEPEVATAPPEKEIPSLDQEKTKLEPGQPQLSPGISTIHLHPQFPVVIEKTSPPVPVEVAPEASTSSASQVIAPTQVTEINECTVNPDICGAGHCINLPVRYTCICYEGYRFSEQQRKCVDIDECTQVQHLCSQGRCENTEGSFLCICPAGFMASEEGTNCIDVDECLRPDVCGEGHCVNTVGAFRCEYCDSGYRMTQRGRCEDIDECLNPSTCPDEQCVNSPGSYQCVPCTEGFRGWNGQCLDVDECLEPNVCANGDCSNLEGSYMCSCHKGYTRTPDHKHCRDIDECQQGNLCVNGQCKNTEGSFRCTCGQGYQLSAAKDQCEDIDECQHRHLCAHGQCRNTEGSFQCVCDQGYRASGLGDHCEDINECLEDKSVCQRGDCINTAGSYDCTCPDGFQLDDNKTCQDINECEHPGLCGPQGECLNTEGSFHCVCQQGFSISADGRTCEDIDECVNNTVCDSHGFCDNTAGSFRCLCYQGFQAPQDGQGCVDVNECELLSGVCGEAFCENVEGSFLCVCADENQEYSPMTGQCRSRTSTDLDVDVDQPKEEKKECYYNLNDASLCDNVLAPNVTKQECCCTSGVGWGDNCEIFPCPVLGTAEFTEMCPKGKGFVPAGESSSEAGGENYKDADECLLFGQEICKNGFCLNTRPGYECYCKQGTYYDPVKLQCFDMDECQDPSSCIDGQCVNTEGSYNCFCTHPMVLDASEKRCIRPAESNEQIEETDVYQDLCWEHLSDEYVCSRPLVGKQTTYTECCCLYGEAWGMQCALCPLKDSDDYAQLCNIPVTGRRQPYGRDALVDFSEQYTPEADPYFIQDRFLNSFEELQAEECGILNGCENGRCVRVQEGYTCDCFDGYHLDTAKMTCVDVNECDELNNRMSLCKNAKCINTDGSYKCLCLPGYVPSDKPNYCTPLNTALNLEKDSDLE

SEQ ID NO: 6941 - protein, 1821 aa, unidentified
MRPRTKARSPGRALRNPWRGFLPLTLALFVGAGHAQRDPVGRYEPAGGDANRLRRPGGSYPAAAAAKVYSLFREQDAPVAGLQPVERAQPGWGSPRRPTEAEARRPSRAQQSRRVQPPAQTRRSTPLGQQQPAPRTRAAPALPRLGTPQRSGAAPPTPPRGRLTGRNVCGGQCCPGWTTANSTNHCIKPVCEPPCQNRGSCSRPQLCVCRSGFRGARCEEVIPDEEFDPQNSRLAPRRWAERSPNLRRSSAAGEGTLARAQPPAPQSPPAPQSPPAGTLSGLSQTHPSQQHVGLSRTVRLHPTATASSQLSSNALPPGPGLEQRDGTQQAVPLEHPSSPWGLNLTEKIKKIKIVFTPTICKQTCARGHCANSCERGDTTTLYSQGGHGHDPKSGFRIYFCQIPCLNGGRCIGRDECWCPANSTGKFCHLPIPQPDREPPGRGSRPRALLEAPLKQSTFTLPLSNQLASVNPSLVKVHIHHPPEASVQIHQVAQVRGGVEEALVENSVETRPPPWLPASPGHSLWDSNNIPARSGEPPRPLPPAAPRPRGLLGRCYLNTVNGQCANPLLELTTQEDCCGSVGAFWGVTLCAPCPPRPASPVIENGQLECPQGYKRLNLTHCQDINECLTLGLCKDAECVNTRGSYLCTCRPGLMLDPSRSRCVSDKAISMLQGLCYRSLGPGTCTLPLAQRITKQICCCSRVGKAWGSECEKCPLPGTEAFREICPAGHGYTYASSDIRLSMRKAEEEELARPPREQGQRSSGALPGPAERQPLRVVTDTWLEAGTIPDKGDSQAGQVTTSVTHAPAWVTGNATTPPMPEQGIAEIQEEQVTPSTDVLVTLSTPGIDRCAAGATNVCGPGTCVNLPDGYRCVCSPGYQLHPSQAYCTDDNECLRDPCKGKGRCINRVGSYSCFCYPGYTLATSGATQECQDINECEQPGVCSGGQCTNTEGSYHCECDQGYIMVRKGHCQDINECRHPGTCPDGRCVNSPGSYTCLACEEGYRGQSGSCVDVNECLTPGVCAHGKCTNLEGSFRCSCEQGYEVTSDEKGCQDVDECASRASCPTGLCLNTEGSFACSACENGYWVNEDGTACEDLDECAFPGVCPSGVCTNTAGSFSCKDCDGGYRPSPLGDSCEDVDECEDPQSSCLGGECKNTVGSYQCLCPQGFQLANGTVCEDVNECMGEEHCAPHGECLNSHGSFFCLCAPGFVSAEGGTSCQDVDECATTDPCVGGHCVNTEGSFNCLCETGFQPSPESGECVDIDECEDYGDPVCGTWKCENSPGSYRCVLGCQPGFHMAPNGDCIDIDECANDTMCGSHGFCDNTDGSFRCLCDQGFEISPSGWDCVDVNECELMLAVCGAALCENVEGSFLCLCASDLEEYDAQEGHCRPRGAGGQSMSEAPTGDHAPAPTRMDCYSGQKGHAPCSSVLGRNTTQAECCCTQGASWGDACDLCPSEDSAEFSEICPSGKGYIPVEGAWTFGQTMYTDADECVIFGPGLCPNGRCLNTVPGYVCLCNPGFHYDASHKKCEDHDECQDLACENGECVNTEGSFHCFCSPPLTLDLSQQRCMNSTSSTEDLPDHDIHMDICWKKVTNDVCSEPLRGHRTTYTECCCQDGEAWSQQCALCPPRSSEVYAQLCNVARIEAEREAGVHFRPGYEYGPGPDDLHYSIYGPDGAPFYNYLGPEDTVPEPAFPNTAGHSADRTPILESPLQPSELQPHYVASHPEPPAGFEGLQAEECGILNGCENGRCVRVREGYTCDCFEGFQLDAAHMACVDVNECDDLNGPAVLCVHGYCENTEGSYRCHCSPGYVAEAGPPHCTAKE

SEQ ID NO: 6942 - protein, 1303 aa, unidentified
MPGPRGAAGGLAPEMRGAGAAGLLALLLLLLLLLLGLGGRVEGGPAGERGAGGGGALARERFKVVFAPVICKRTCLKGQCRDSCQQGSNMTLIGENGHSTDTLTGSGFRVVVCPLPCMNGGQCSSRNQCLCPPDFTGRFCQVPAGGAGGGTGGSGPGLSRTGALSTGALPPLAPEGDSVASKHAIYAVQVIADPPGPGEGPPAQHAAFLVPLGPGQISAEVQAPPPVVNVRVHHPPEASVQVHRIESSNAESAAPSQHLLPHPKPSHPRPPTQKPLGRCFQDTLPKQPCGSNPLPGLTKQEDCCGSIGTAWGQSKCHKCPQLQYTGVQKPGPVRGEVGADCPQGYKRLNSTHCQDINECAMPGVCRHGDCLNNPGSYRCVCPPGHSLGPSRTQCIADKPEEKSLCFRLVSPEHQCQHPLTTRLTRQLCCCSVGKAWGARCQRCPTDGTAAFKEICPAGKGYHILTSHQTLTIQGESDFSLFLHPDGPPKPQQLPESPSQAPPPEDTEEERGVTTDSPVSEERSVQQSHPTATTTPARPYPELISRPSPPTMRWFLPDLPPSRSAVEIAPTQVTETDECRLNQNICGHGECVPGPPDYSCHCNPGYRSHPQHRYCVDVNECEAEPCGPGRGICMNTGGSYNCHCNRGYRLHVGAGGRSCVDLNECAKPHLCGDGGFCINFPGHYKCNCYPGYRLKASRPPVCEDIDECRDPSSCPDGKCENKPGSFKCIACQPGYRSQGGGACRDVNECAEGSPCSPGWCENLPGSFRCTCAQGYAPAPDGRSCLDVDECEAGDVCDNGICSNTPGSFQCQCLSGYHLSRDRSHCEDIDECDFPAACIGGDCINTNGSYRCLCPQGHRLVGGRKCQDIDECSQDPSLCLPHGACKNLQGSYVCVCDEGFTPTQDQHGCEEVEQPHHKKECYLNFDDTVFCDSVLATNVTQQECCCSLGAGWGDHCEIYPCPVYSSAEFHSLCPDGKGYTQDNNIVNYGIPAHRDIDECMLFGSEICKEGKCVNTQPGYECYCKQGFYYDGNLLECVDVDECLDESNCRNGVCENTRGGYRCACTPPAEYSPAQRQCLSPEEMDVDECQDPAACRPGRCVNLPGSYRCECRPPWVPGPSGRDCQLPESPAERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSGRCVPRPGGAVCECPGGFQLDASRARCVDIDECRELNQRGLLCKSERCVNTSGSFRCVCKAGFARSRPHGACVPQRRR

SEQ ID NO: 6943 - protein, 1624 aa, unidentified
MPRPGTSGRRPLLLVLLLPLFAAATSAASPSPSPSQVVEVPGVPSRPASVAVCRCCPGQTSRRSRCIRAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVDECRNRSFCGAHAVCQNLPGSFQCLCDQGYEGARDGRHCVDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 6944 - protein, 435 aa, unidentified; identical to SEQ ID NO: 2489

SEQ ID NO: 6945 - protein, 710 aa, unidentified
MKLVFLVLLFLGALGLCLAGRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 6946 - protein, 864 aa, unidentified; identical to SEQ ID NO: 2491

SEQ ID NO: 6947 - protein, 338 aa, unidentified
MSLSAFTLFLALIGGTSGQYYDYDFPLSIYGQSSPNCAPECNCPESYPSAMYCDELKLKSVPMVPPGIKYLYLRNNQIDHIDEKAFENVTDLQWLILDHNLLENSKIKGRVFSKLKQLKKLHINHNNLTESVGPLPKSLEDLQLTHNKITKLGSFEGLVNLTFIHLQHNRLKEDAVSAAFKGLKSLEYLDLSFNQIARLPSGLPVSLLTLYLDNNKISNIPDEYFKRFNALQYLRLSHNELADSGIPGNSFNVSSLVELDLSYNKLKNIPTVNENLENYYLEVNQLEKFDIKSFCKILGPLSYSKIKHLRLDGNRISETSLPPDMYECLRVANEVTLN

SEQ ID NO: 6948 - protein, 346 aa, unidentified
MKFSPAHYLLPLLPALVLSTRQDYEELEKQLKEVFKERSTILRQLTKTSRELDGIKVNLQSLKNDEQSAKTDVQKLLELGQKQREEMKSLQEALQNQLKETSEKAEKHQATINFLKTEVERKSKMIRDLQNENKSLKNKLLSGNKLCGIHAEESKKIQAQLKELRYGKKDLLFKAQQLTDLEQKLAVAKNELEKAALDRESQMKAMKETVQLCLTSVFRDQPPPPLSLITSNPTRMLLPPRNIASKLPDAAAKSKPQQSASGNNESSQVESTKEGNPSTTACDSQDEGRPCSMKHKESPPSNATAETEPIPQKLQMPPCSECEVKKAPEKPLTSFEGMAAREEKIL

SEQ ID NO: 6949 - protein, 131 aa, unidentified; identical to SEQ ID NO: 2494

SEQ ID NO: 6950 - protein, 201 aa, unidentified
MKVHMLVGVLVMVGFTVGKVPVPDIRTCHFCLVEDPSVGCISGSEKCTISSSSLCMVITIYYDVKVRFIVRGCGQYISYRCQEKRNTYFAEYWYQAQCCQYDYCNSWSSPQLQSSLPEPHDRPLALPLSDSQIQWFYQALNLSLPLPNFHAGTEPDGLDPMVTLSLNLGLSFAELRRMYLFLNSSGLLVLPQAGLLTPHPS

SEQ ID NO: 6951 - protein, 133 aa, unidentified; identical to SEQ ID NO: 2497

SEQ ID NO: 6952 - protein, 140 aa, unidentified
MLPAAMKGLGLALLAVLLCSAPAHGLWCQDCTLTTNSSHCTPKQCQPSDTVCASVRITDPSSSRKDHSVNKMCASSCDFVKRHFFSDYLMGFINSGILKVDVDCCEKDLCNGAAGAGHSPWALAGGLLLSLGPALLWAGP

SEQ ID NO: 6953 - protein, 165 aa, unidentified; identical to SEQ ID NO: 2499

SEQ ID NO: 6954 - protein, 138 aa, unidentified
MERLVLTLCTLPLAVASAGCATTPARNLSCYQCFKVSSWTECPPTWCSPLDQVCISNEVVVSFKWSVRVLLSKRCAPRCPNDNMKFEWSPAPMVQGVITRRCCSWALCNRALTPQEGRWALRGGLLLQVGLSLLRALL

SEQ ID NO: 6955 - protein, 162 aa, unidentified
MKGFTATLFLWTLIFPSCSGGGGGKAWPTHVVCSDSGLEVLYQSCDPLQDFGFSVEKCSKQLKSNINIRFGIILREDIKELFLDLALMSQGSSVLNFSYPICEAALPKFSFCGRRKGEQIYYAGPVNNPEFTIPQGEYQVLLELYTEKRSTVACANATIMCS

SEQ ID NO: 6956 - protein, 160 aa, unidentified [sequence omitted]

SEQ ID NO: 6957 - protein, 194 aa, unidentified
MSALWLLLGLLALMDLSESSNWGCYGNIQSLDTPGASCGIGRRHGLNYCGVRASERLAEIDMPYLLKYQPMMQTIGQKYCMDPAVIAGVLSRKSPGDKILVNMGDRTSMVQDPGSQAPTSWISESQVSQTTEVLTTRIKEIQRRFPTWTPDQYLRGGLCAYSGGAGYVRSSQDLSCDFCNDVLARAKYLKRHGF

SEQ ID NO: 6958 - protein, 212 aa, unidentified
MLSSVVFWGLIALIGTSRGSYPFSHSMKPHLHPRLYHGCYGDIMTMKTSGATCDANSVMNCGIRGSEMFAEMDLRAIKPYQTLIKEVGQRHCVDPAVIAAIISRESHGGSVLQDGWDHRGLKFGLMQLDKQTYHPVGAWDSKEHLSQATGILTERIKAIQKKFPTWSVAQHLKGGLSAFKSGIEAIATPSDIDNDFVNDIIARAKFYKRQSF

SEQ ID NO: 6959 - protein, 141 aa, unidentified
MWVLGIAATFCGLFLLPGFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLALFSAHC

SEQ ID NO: 6960 - protein, 125 aa, unidentified
MRGTRLALLALVLAACGELAPALRCYVCPEPTGVSDCVTIATCTTNETMCKTTLYSREIVYPFQGDSTVTKSCASKCKPSDVDGIGQTLPVSCCNTELCNVDGAPALNSLHCGALTLLPLLSLRL

SEQ ID NO: 6961 - protein, 171 aa, unidentified
MEPGPALAWLLLLSLLADCLKAAQSRDFTVKDIIYLHPSTTPYPGGFKCFTCEKAADNYECNRWAPDIYCPRETRYCYTQHTMEVTGNSISVTKRCVPLEECLSTGCRDSEHEGHKVCTSCCEGNICNLPLPRNETDATFATTSPINQTNGHPRCMSVIVSCLWLWLGLML

SEQ ID NO: 6962 - protein, 183 aa, unidentified
MLYKSSDRPAHKVSMLLLCHALAIAVVQIVIFSESWAFAKNINFYNVRPPLDPTPFPNSFKCFTCENAGDNYNCNRWAEDKWCPQNTQYCLTVHHFTSHGRSTSITKKCASRSECHFVGCHHSRDSEHTECRSCCEGMICNVELPTNHTNAVFAVMHAQRTSGSSAPTLYLPVLAWVFVLPLL

SEQ ID NO: 6963 - protein, 148 aa, unidentified
MKALIVLGLVLLSVTVQGKVFERCELARTLKRLGMDGYRGISLANWMCLAKWESGYNTRATNYNAGDRSTDYGIFQINSRYWCNDGKTPGAVNACHLSCSALLQDNIADAVACAKRVVRDPQGIRAWVAWRNRCQNRDVRQYVQGCGV

SEQ ID NO: 6964 - protein, 146 aa, unidentified
MKASVVLSLLGYLVVPSGAYILGRCTVAKKLHDGGLDYFEGYSLENWVCLAYFESKFNPMAIYENTREGYTGFGLFQMRGSDWCGDHGRNRCHMSCSALLNPNLEKTIKCAKTIVKGKEGMGAWPTWSRYCQYSDTLARWLDGCKL

SEQ ID NO: 6965 - protein, 277 aa, unidentified; identical to SEQ ID NO: 2510

SEQ ID NO: 6966 - protein, 718 aa, unidentified
MEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKDLEQKLSLQEQDAAIVKNMKSELVRLPRLERELKQLREESAHLREMRETNGLLQEELEGLQRKLGRQEKMQETLVGLELENERLLAKLQSWERLDQTMGLSIRTPEDLSRFVVELQQRELALKDKNSAVTSSARGLEKARQQLQEELRQVSGQLLEERKKRETHEALARRLQKRVLLLTKERDGMRAILGSYDSELTPAEYSPQLTRRMREAEDMVQKVHSHSAEMEAQLSQALEELGGQKQRADMLEMELKMLKSQSSSAEQSFLFSREEADTLRLKVEELEGERSRLEEEKRMLEAQLERRALQGDYDQSRTKVLHMSLNPTSVARQRLREDHSQLQAECERLRGLLRAMERGGTVPADLEAAAASLPSSKEVAELKKQVESAELKNQRLKEVFQTKIQEFRKACYTLTGYQIDITTENQYRLTSLYAEHPGDCLIFKATSPSGSKMQLLETEFSHTVGELIEVHLRRQDSIPAFLSSLTLELFSRQTVA

SEQ ID NO: 6967 - protein, 626 aa, unidentified; identical to SEQ ID NO: 2514

SEQ ID NO: 6968 - protein, 335 aa, unidentified; identical to SEQ ID NO: 2519

SEQ ID NO: 6969 - protein, 234 aa, unidentified
MGPGGRVARLLAPLMWRRAVSSVAGSAVGAEPGLRLLAVQRLPVGAAFCRACQTPNFVRGLHSEPGLEERAEGTVNEGRPESDAADHTGPKFDIDMMVSLLRQENARDICVIQVPPEMRYTDYFVIVSGTSTRHLHAMAFYVVKMYKHLKCKRDPHVKIEGKDTDDWLCVDFGSMVIHLMLPETREIYELEKLWTLRSYDDQLAQIAPETVPEDFILGIEDDTSSVTPVELKCE

SEQ ID NO: 6970 - protein, 686 aa, unidentified
MLLRGVLLALQALQLAGALDLPAGSCAFEESTCGFDSVLASLPWILNEEGHYIYVDTSFGKQGEKAVLLSPDLQAEEWSCLRLVYQITTSSESLSDPSQLNLYMRFEDESFDRLLWSAKEPSDSWLIASLDLQNSSKKFKILIEGVLGQGNTASIALFEIKMTTGYCIECDFEENHLCGFVNRWNPNVNWFVGGGSIRNVHSILPQDHTFKSELGHYMYVDSVYVKHFQEVAQLISPLTTAPMAGCLSFYYQIQQGNDNVFSLYTRDVAGLYEEIWKADRPGNAAWNLAEVEFSAPYPMEVIFEVAFNGPKGGYVALDDISFSPVHCQNQTELLFSAVEASCNFEQDLCNFYQDKEGPGWTRVKVKPNMYRAGDHTTGLGYYLLANTKFTSQPGYIGRLYGPSLPGNLQYCLRFHYAIYGFLKMSDTLAVYIFEENHVVQEKIWSVLESPRGVWMQAEITFKKPMPTKVVFMSLCKSFWDCGLVALDDITIQLGSCSSSEKLPPPPGECTFEQDECTFTQEKRNRSSWHRRRGETPTSYTGPKGDHTTGVGYYMYIEASHMVYGQKARLLSRPLRGVSGKHCLTFFYHMYGGGTGLLSVYLKKEEDSEESLLWRRRGEQSISWLRALIEYSCERQHQIIFEAIRGVSIRSDIAIDDVKFQAGPCGEMEDTTQQSSGYSEDLNEIEY

SEQ ID NO: 6971 - protein, 1011 aa, unidentified
MGAYARASGVCARGCLDSAGPWTMSRALRPPLPPLCFFLLLLAAAGARAGGYETCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRASTSLKPPTADLFTGVLPNGYNPPRNLCWDVLCVDQPLVEDPRSPEYNAKELVDYFLNVATAQGRYYRTNHTVMTMGSDFQYENANMWFKNLDKLIRLVNAQQAKGSSVHVLYSTPACYLWELNKANLTWSVKHDDFFPYADGPHQFWTGYFSSRPALKRYERLSYNFLQVCNQLEALVGLAANVGPYGSGDSAPLNEAMAVLQHHDAVSGTSRQHVANDYARQLAAGWGPCEVLLSNALARLRGFKDHFTFCQQLNISICPLSQTAARFQVIVYNPLGRKVNWMVRLPVSEGVFVVKDPNGRTVPSDVVIFPSSDSQAHPPELLFSASLPALGFSTYSVAQVPRWKPQARAPQPIPRRSWSPALTIENEHIRATFDPDTGLLMEIMNMNQQLLLPVRQTFFWYNASIGDNESDQASGAYIFRPNQQKPLPVSRWAQIHLVKTPLVQEVHQNFSAWCSQVVRLYPGQRHLELEWSVGPIPVGDTWGKEVISRFDTPLETKGRFYTDSNGREILERRRDYRPTWKLNQTEPVAGNYYPVNTRIYITDGNMQLTVLTDRSQGGSSLRDGSLELMVHRRLLKDDGRGVSEPLMENGSGAWVRGRHLVLLDTAQAAAAGHRLLAEQEVLAPQVVLAPGGGAAYNLGAPPRTQFSGLRRDLPPSVHLLTLASWGPEMVLLRLEHQFAVGEDSGRNLSAPVTLNLRDLFSTFTITRLQETTLVANQLREAASRLKWTTNTGPTPHQTPYQLDPANITLEPMEIRTFLASVQWKEVDG

SEQ ID NO: 6972 - protein, 1009 aa, unidentified
MGQLCWLPLLAPLLLLRPPGVQSAGPIRAFVVPHSHMDVGWVYTVQESMRAYAANVYTSVVEELARGQQRRFIAVEQEFFRLWWDGVASDQQKYQVRQLLEEGRLEFVIGGQVMHDEAVTHLDDQILQLTEGHGFLYETFGIRPQFSWHVDPFGASATTPTLFALAGFNAHLGSRIDYDLKAAMQEARGLQFVWRGSPSLSERQEIFTHIMDQYSYCTPSHIPFSNRSGFYWNGVAVFPKPPQDGVYPNMSEPVTPANINLYAEALVANVKQRAAWFRTPHVLWPWGCDKQFFNASVQFANMDPLLDHINSHAAELGVSVQYATLGDYFRALHALNVTWRVRDHHDFLPYSTEPFQAWTGFYTSRSSLKGLARRASALLYAGESMFTRYLWPAPRGHLDPTWALQQLQQLRWAVSEVQHHDAITGTESPKVRDMYATHLASGMLGMRKLMASIVLDELQPQAPMAASSDAGPAGHFASVYNPLAWTVTTIVTLTVGFPGVRVTDEAGHPVPSQIQNSTETPSAYDLLILTTIPGLSYRHYNIRPTAGAQEGTQEPAATVASTLQFGRRLRRRTSHAGRYLVPVANDCYIVLLDQDTNLMHSIWERQSNRTVRVTQEFLEYHVNGDVKQGPISDNYLFTPGKAAVPAWEAVEMEIVAGQLVTEIRQYFYRNMTAQNYTYAIRSRLTHVPQGHDGELLCHRIEQEYQAGPLELNREAVLRTSTNLNSQQVIYSDNNGYQMQRRPYVSYVNNSIARNYYPMVQSAFMEDGKSRLVLLSERAHGISSQGNGQVEVMLHRRLWNNFDWDLGYNLTLNDTSVVHPVLWLLLGSWSLTTALRQRSALALQHRPVVLFGDLAGTAPKLPGPQQQEAVTLPPNLHLQILSIPGWRYSSNHTEHSQNLRKGHRGEAQADLRRVLLRLYHLYEVGEDPVLSQPVTVNLEAVLQALGSVVAVEERSLTGTWDLSMLHRWSWRTGPGRHRGDTTSPSRPPGGPIITVHPKEIRTFFIHFQQQ

SEQ ID NO: 6973 - protein, 879 aa, unidentified
MRLHLLLLLALCGAGTTAAELSYSLRGNWSICNGNGSLELPGAVPGCVHSALFQQGLIQDSYYRFNDLNYRWVSLDNWTYSKEFKIPFEISKWQKVNLILEGVDTVSKILFNEVTIGETDNMFNRYSFDITNVVRDVNSIELRFQSAVLYAAQQSKAHTRYQVPPDCPPLVQKGECHVNFVRKEQCSFSWDWGPSFPTQGIWKDVRIEAYNICHLNYFTFSPIYDKSAQEWNLEIESTFDVVSSKPVGGQVIVAIPKLQTQQTYSIELQPGKRIVELFVNISKNITVETWWPHGHGNQTGYNMTVLFELDGGLNIEKSAKVYFRTVELIEEPIKGSPGLSFYFKINGFPIFLKGSNWIPADSFQDRVTSELLRLLLQSVVDANMNTLRVWGGGIYEQDEFYELCDELGIMVWQDFMFACALYPTDQGFLDSVTAEVAYQIKRLKSHPSIIIWSGNNENEEALMMNWYHISFTDRPIYIKDYVTLYVKNIRELVLAGDKSRPFITSSPTNGAETVAEAWVSQNPNSNYFGDVHFYDYISDCWNWKVFPKARFASEYGYQSWPSFSTLEKVSSTEDWSFNSKFSLHRQHHEGGNKQMLYQAGLHFKLPQSTDPLRTFKDTIYLTQVMQAQCVKTETEFYRRSRSEIVDQQGHTMGALYWQLNDIWQAPSWASLEYGGKWKMLHYFAQNFFAPLLPVGFENENTFYIYGVSDLHSDYSMTLSVRVHTWSSLEPVCSRVTERFVMKGGEAVCLYEEPVSELLRRCGNCTRESCVVSFYLSADHELLSPTNYHFLSSPKEAVGLCKAQITAIISQQGDIFVFDLETSAVAPFVWLDVGSIPGRFSDNGFLMTEKTRTILFYPWEPTSKNELEQSFHVTSLTDIY

SEQ ID NO: 6974 - protein, 457 aa, unidentified
MARRRRRACIALFLVLLFAFGTLMGLRTLKAPDGLPALGPGLELAPFERRPEGAPAPAARAPAAPAAPPPPPPPPRTADPGGSPGPAPAEAEPAPVQSLRVYSDLHAFYYSWYGSPRREGHYIHWDHVMVPHWDPKISASYPRGRHSPPDDLGSSFYPELGPYSSRDPEVLREHMTQLKEAAIGVLVLSWYPPGMADDNGEPSDDLVPAILDTAHQYSIQVAFHIQPYKGRDDITVHDNIKYIIDTYGSHGAFYRYKNSMGKSLPLFYIYDSYLTSPEAWAHLLTPNGPHSIRNTPYDGVFIALLVEEGHTHDILAAGFDGMYTYFASNGFSFGSSHQNWKAVKNFCDANNLMFIPSVGPGYIDTSIRPWNNHNTRNRVNGKYYETALQAALTVRPEIVSITSFNEWHEGTQIEKAIPKKTPTRLYLDYLPHQPSLYLELTRRWAEHFIKEKEQWLM

SEQ ID NO: 6975 - protein, 182 aa, unidentified
MRRMWATQGLAVALALSVLPGSRALRPGDCEVCISYLGRFYQDLKDRDVTFSPATIENELIKFCREARGKENRLCYYIGATDDAATKIINEVSKPLAHHIPVEKICEKLKKKDSQICELKYDKQIDLSTVDLKKLRVKELKKILDDWGETCKGCAEKSDYIRKINELMPKYAPKAASARTDL

SEQ ID NO: 6976 - protein, 431 aa, unidentified; identical to SEQ ID NO: 2532

SEQ ID NO: 6977 - protein, 1104 aa, unidentified
MEPSRALLGCLASAAAAAPPGEDGAGAGAEEEEEEEEEAAAAVGPGELGCDAPLPYWTAVFEYEAAGEDELTLRLGDVVEVLSKDSQVSGDEGWWTGQLNQRVGIFPSNYVTPRSAFSSRCQPGGEDPSCYPPIQLLEIDFAELTLEEIIGIGGFGKVYRAFWIGDEVAVKAARHDPDEDISQTIENVRQEAKLFAMLKHPNIIALRGVCLKEPNLCLVMEFARGGPLNRVLSGKRIPPDILVNWAVQIARGMNYLHDEAIVPIIHRDLKSSNILILQKVENGDLSNKILKITDFGLAREWHRTTKMSAAGTYAWMAPEVIRASMFSKGSDVWSYGVLLWELLTGEVPFRGIDGLAVAYGVAMNKLALPIPSTCPEPFAKLMEDCWNPDPHSRPSFTNILDQLTTIEESGFFEMPKDSFHCLQDNWKHEIQEMFDQLRAKEKELRTWEEELTRAALQQKNQEELLRRREQELAEREIDILERELNIIIHQLCQEKPRVKKRKGKFRKSRLKLKDGNRISLPSDFQHKFTVQASPTMDKRKSLINSRSSPPASPTIIPRLRAIQLTPGESSKTWGRSSVVPKEEGEEEEKRAPKKKGRTWGPGTLGQKELASGDEGSPQRREKANGLSTPSESPHFHLGLKSLVDGYKQWSSSAPNLVKGPRSSPALPGFTSLMEMEDEDSEGPGSGESRLQHSPSQSYLCIPFPRGEDGDGPSSDGIHEEPTPVNSATSTPQLTPTNSLKRGGAHHRRCEVALLGCGAVLAATGLGFDLLEAGKCQLLPLEEPEPPAREEKKRREGLFQRSSRPRRSTSPPSRKLFKKEEPMLLLGDPSASLTLLSLSSISECNSTRSLLRSDSDEIVVYEMPVSPVEAPPLSPCTHNPLVNVRVERFKRDPNQSLTPTHVTLTTPSQPSSHRRTPSDGALKPETLLASRSPSSNGLSPSPGAGMLKTPSPSRDPGEFPRLPDPNVVFPPTPRRWNTQQDSTLERPKTLEFLPRPRPSANRQRLDPWWFVSPSHARSTSPANSSSTETPSNLDSCFASSSSTVEERPGLPALLPFQAGPLPPTERTLLDLDAEGQSQDSTVPLCRAELNTHRPAPYEIQQEFWS

SEQ ID NO: 6978 - protein, 699 aa, unidentified
MRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKIVDCRAPGELEHGLITFSTRNNLTTYKSEIKYSCQEPYYKMLNNNTGIYTCSAQGVWMNKVLGRSLPTCLPVCGLPKFSRKLMARIFNGRPAQKGTTPWIAMLSHLNGQPFCGGSLLGSSWIVTAAHCLHQSLDPEDPTLRDSDLLSPSDFKIILGKHWRLRSDENEQHLGVKHTTLHPQYDPNTFENDVALVELLESPVLNAFVMPICLPEGPQQEGAMVIVSGWGKQFLQRFPETLMEIEIPIVDHSTCQKAYAPLKKKVTRDMICAGEKEGGKDACAGDSGGPMVTLNRERGQWYLVGTVSWGDDCGKKDRYGVYSYIHHNKDWIQRVTGVRN

SEQ ID NO: 6979 - protein, 686 aa, unidentified
MRLLTLLGLLCGSVATPLGPKWPEPVFGRLASPGFPGEYANDQERRWTLTAPPGYRLRLYFTHFDLELSHLCEYDFVKLSSGAKVLATLCGQESTDTERAPGKDTFYSLGSSLDITFRSDYSNEKPFTGFEAFYAAEDIDECQVAPGEAPTCDHHCHNHLGGFYCSCRAGYVLHRNKRTCSALCSGQVFTQRSGELSSPEYPRPYPKLSSCTYSISLEEGFSVILDFVESFDVETHPETLCPYDFLKIQTDREEHGPFCGKTLPHRIETKSNTVTITFVTDESGDHTGWKIHYTSTAQPCPYPMAPPNGHVSPVQAKYILKDSFSIFCETGYELLQGHLPLKSFTAVCQKDGSWDRPMPACSIVDCGPPDDLPSGRVEYITGPGVTTYKAVIQYSCEETFYTMKVNDGKYVCEADGFWTSSKGEKSLPVCEPVCGLSARTTGGRIYGGQKAKPGDFPWQVLILGGTTAAGALLYDNWVLTAAHAVYEQKHDASALDIRMGTLKRLSPHYTQAWSEAVFIHEGYTHDAGFDNDIALIKLNNKVVINSNITPICLPRKEAESFMRTDDIGTASGWGLTQRGFLARNLMYVDIPIVDHQKCTAAYEKPPYPRGSVTANMLCAGLESGGKDSCRGDSGGALVFLDSETERWFVGGIVSWGSMNCGEAGQYGVYTKVINYIPWIENIISDF

SEQ ID NO: 6980 - protein, 496 aa, unidentified
MRVLSGTSLMLCSLLLLLQALCSPGLAPQSRGHLCRTRPTDLVFVVDSSRSVRPVEFEKVKVFLSQVIESLDVGPNATRVGMVNYASTVKQEFSLRAHVSKAALLQAVRRIQPLSTGTMTGLAIQFAITKAFGDAEGGRSRSPDISKVVIVVTDGRPQDSVQDVSARARASGVELFAIGVGSVDKATLRQIASEPQDEHVDYVESYSVIEKLSRKFQEAFCVVSDLCATGDHDCEQVCISSPGSYTCACHEGFTLNSDGKTCNVCSGGGGSSATDLVFLIDGSKSVRPENFELVKKFISQIVDTLDVSDKLAQVGLVQYSSSVRQEFPLGRFHTKKDIKAAVRNMSYMEKGTMTGAALKYLIDNSFTVSSGARPGAQKVGIVFTDGRSQDYINDAAKKAKDLGFKMFAVGVGNAVEDELREIASEPVAEHYFYTADFKTINQIGKKLQKKICVEEDPCACESLVKFQAKVEGLLQALTRKLEAVSKRLAILENTVV

SEQ ID NO: 6981 - protein, 956 aa, unidentified
MEKMLAGCFLLILGQIVLLPAEARERSRGRSISRGRHARTHPQTALLESSCENKRADLVFIIDSSRSVNTHDYAKVKEFIVDILQFLDIGPDVTRVGLLQYGSTVKNEFSLKTFKRKSEVERAVKRMRHLSTGTMTGLAIQYALNIAFSEAEGARPLRENVPRVIMIVTDGRPQDSVAEVAAKARDTGILIFAIGVGQVDFNTLKSIGSEPHEDHVFLVANFSQIETLTSVFQKKLCTAHMCSTLEHNCAHFCINIPGSYVCRCKQGYILNSDQTTCRIQDLCAMEDHNCEQLCVNVPGSFVCQCYSGYALAEDGKRCVAVDYCASENHGCEHECVNADGSYLCQCHEGFALNPDKKTCTKIDYCASSNHGCQHECVNTDDSYSCHCLKGFTLNPDKKTCRRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTESEPVTINIQDLLSCSNFAVQHRYLFEEDNLLRSTQKLSHSTKPSGSPLEEKHDQCKCENLIMFQNLANEEVRKLTQRLEEMTQRMEALENRLRYR

SEQ ID NO: 6982 - protein, 486 aa, unidentified
MPRPAPARRLPGLLLLLWPLLLLPSAAPDPVARPGFRRLETRGPGGSPGRRPSPAAPDGAPASGTSEPGRARGAGVCKSRPLDLVFIIDSSRSVRPLEFTKVKTFVSRIIDTLDIGPADTRVAVVNYASTVKIEFQLQAYTDKQSLKQAVGRITPLSTGTMSGLAIQTAMDEAFTVEAGAREPSSNIPKVAIIVTDGRPQDQVNEVAARAQASGIELYAVGVDRADMASLKMMASEPLEEHVFYVETYGVIEKLSSRFQETFCALDPCVLGTHQCQHVCISDGEGKHHCECSQGYTLNADKKTCSALDRCALNTHGCEHICVNDRSGSYHCECYEGYTLNEDRKTCSAQDKCALGTHGCQHICVNDRTGSHHCECYEGYTLNADKKTCSVRDKCALGSHGCQHICVSDGAASYHCDCYPGYTLNEDKKTCSATEEARRLVSTEDACGCEATLAFQDKVSSYLQRLNTKLDDILEKLKINEYGQIHR

SEQ ID NO: 6983 - protein, 622 aa, unidentified
MRGLLCWPVLLLLLQPWETQLQLTGPRCHTGPLDLVFVIDSSRSVRPFEFETMRQFLMGLLRGLNVGPNATRVGVIQYSSQVQSVFPLRAFSRREDMERAIRDLVPLAQGTMTGLAIQYAMNVAFSVAEGARPPEERVPRVAVIVTDGRPQDRVAEVAAQARARGIEIYAVGVQRADVGSLRAMASPPLDEHVFLVESFDLIQEFGLQFQSRLCGKDQCAEGGHGCQHQCVNAWAMFHCTCNPGYKLAADNKSCLAIDLCAEGTHGCEHHCVNSPGSYFCHCQVGFVLQQDQRSCRAIDYCSFGNHSCQHECVSTPGGPRCHCREGHDLQPDGRSCQVRDLCNGVDHGCEFQCVSEGLSYRCLCPEGRQLQADGKSCNRCREGHVDLVLLVDGSKSVRPQNFELVKRFVNQIVDFLDVSPEGTRVGLVQFSSRVRTEFPLGRYGTAAEVKQAVLAVEYMERGTMTGLALRHMVEHSFSEAQGARPRALNVPRVGLVFTDGRSQDDISVWAARAKEEGIVMYAVGVGKAVEAELREIASEPAELHVSYAPDFGTMTHLLENLRGSICPEEGISAGTELRSPCECESLVEFQGRTLGALESLTLNLAQLTARLEDLENQLANQK

SEQ ID NO: 6984 - protein, 847 aa, unidentified
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQASNILASFGLSARDLDELSRYPEDKITPENLPQILLQLKRRRTEEGPTLSYGRDGRSATREPPYRVPRDDWEEKRHFRRDSFDDRGPSLNPVLDYDHGSRSQESGYYDRMDYEDDRLRDGERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKKLVLRIPNRGIDLLKKDKSRKRSYSPDGKESPSDKKSKTDGSQKTESSTEGKEQEEKSGEDGEKDTKDDQTEQEPNMLLESEDELLVDEEEAAALLESGSSVGDETDLANLGDVASDGKKEPSDKAVKKDGSASAAAKKKLKKVDKIEELDQENEAALENGIKNEENTEPGAESSENADDPNKDTSENADGQSDENKDDYTIPDEYRIGPYQPNVPVGIDYVIPKTGFYCKLCSLFYTNEEVAKNTHCSSLPHYQKLKKFLNKLAEERRQKKET

SEQ ID NO: 6985 - protein, 613 aa, unidentified
MAAQAAAAAQAAAAQAAQAEAADSWYLALLGFAEHFRTSSPPKIRLCVHCLQAVFPFKPPQRIEARTHLQLGSVLYHHTKNSEQARSHLEKAWLISQQIPQFEDVKFEAASLLSELYCQENSVDAAKPLLRKAIQISQQTPYWHCRLLFQLAQLHTLEKDLVSACDLLGVGAEYARVVGSEYTRALFLLSKGMLLLMERKLQEVHPLLTLCGQIVENWQGNPIQKESLRVFFLVLQVTHYLDAGQVKSVKPCLKQLQQCIQTISTLHDDEILPSNPADLFHWLPKEHMCVLVYLVTVMHSMQAGYLEKAQKYTDKALMQLEKLKMLDCSPILSSFQVILLEHIIMCRLVTGHKATALQEISQVCQLCQQSPRLFSNHAAQLHTLLGLYCVSVNCMDNAEAQFTTALRLTNHQELWAFIVTNLASVYIREGNRHQEVLYSLLERINPDHSFPVSSHCLRAAAFYVRGLFSFFQGRYNEAKRFLRETLKMSNAEDLNRLTACSLVLLGHIFYVLGNHRESNNMVVPAMQLASKIPDMSVQLWSSALLRDLNKACGNAMDAHEAAQMHQNFSQQLLQDHIEACSLPEHNLITWTDGPPPVQFQAQNGPNTSLASLL

SEQ ID NO: 6986 - protein, 477 aa, unidentified
MFPVFPCTLLAPPFPVLGLDSRGVGGLMNSFPPPQGHAQNPLQVGAELQSRFFASQGCAQSPFQAAPAPPPTPQAPAAEPLQVDLLPVLAAAQESAAAAAAAAAAAAAVAAAPPAPAAASTVDTAALKQPPAPPPPPPPVSAPAAEAAPPASAATIAAAAATAVVAPTSTVAVAPVASALEKKTKSKGPYICALCAKEFKNGYNLRRHEAIHTGAKAGRVPSGAMKMPTMVPLSLLSVPQLSGAGGGGGEAGAGGGAAAVAAGGVVTTTASGKRIRKNHACEMCGKAFRDVYHLNRHKLSHSDEKPYQCPVCQQRFKRKDRMSYHVRSHDGAVHKPYNCSHCGKSFSRPDHLNSHVRQVHSTERPFKCEKCEAAFATKDRLRAHTVRHEEKVPCHVCGKMLSSAYISDHMKVHSQGPHHVCELCNKGTGEVCPMAAAAAAAAAAAAAAVAAPPTAVGSLSGAEGVPVSSQPLPSQPW

SEQ ID NO: 6987 - protein, 1003 aa, unidentified
MNGGNESSGADRAGGPVATSVPIGWQRCVREGAVLYISPSGTELSSLEQTRSYLLSDGTCKCGLECPLNVPKVFNFDPLAPVTPGGAGVGPASEEDMTKLCNHRRKAVAMATLYRSMETTCSHSSPGEGASPQMFHTVSPGPPSARPPCRVPPTTPLNGGPGSLPPEPPSVSQAFPTLAGPGGLFPPRLADPVPSGGSSSPRFLPRGNAPSPAPPPPPAISLNAPSYNWGAALRSSLVPSDLGSPPAPHASSSPPSDPPLFHCSDALTPPPLPPSNNLPAHPGPASQPPVSSATMHLPLVLGPLGGAPTVEGPGAPPFLASSLLSAAAKAQHPPLPPPSTLQGRRPRAQAPSASHSSSLRPSQRRPRRPPTVFRLLEGRGPQTPRRSRPRAPAPVPQPFSLPEPSQPILPSVLSLLGLPTPGPSHSDGSFNLLGSDAHLPPPPTLSSGSPPQPRHPIQPSLPGTTSGSLSSVPGAPAPPAASKAPVVPSPVLQSPSEGLGMGAGPACPLPPLAGGEAFPFPSPEQGLALSGAGFPGMLGALPLPLSLGQPPPSPLLNHSLFGVLTGGGGQPPPEPLLPPPGGPGPPLAPGEPEGPSLLVASLLPPPPSDLLPPPSAPPSNLLASFLPLLALGPTAGDGEGSAEGAGGPSGEPFSGLGDLSPLLFPPLSAPPTLIALNSALLAATLDPPSGTPPQPCVLSAPQPGPPTSSVTTATTDPGASSLGKAPSNSGRPPQLLSPLLGASLLGDLSSLTSSPGALPSLLQPPGPLLSGQLGLQLLPGGGAPPPLSEASSPLACLLQSLQIPPEQPEAPCLPPESPASALEPEPARPPLSALAPPHGSPDPPVPELLTGRGSGKRGRRGGGGLRGINGEARPARGRKPGSRREPGRLALKWGTRGGFNGQMERSPRRTHHWQHNGELAEGGAEPKDPPPPGPHSEDLKVPPGVVRKSRRGRRRKYNPTRNSNSSRQDITLEPSPTARAAVPLPPRARPGRPAKNKRRKLAP

SEQ ID NO: 6988 - protein, 248 aa, unidentified
MSLFPSLPLLLLSMVAASYSETVTCEDAQKTCPAVIACSSPGINGFPGKDGRDGTKGEKGEPGQGLRGLQGPPGKLGPPGNPGPSGSPGPKGQKGDPGKSPDGDSSLAASERKALQTEMARIKKWLTFSLGKQVGNKFFLTNGEIMTFEKVKALCVKFQASVATPRNAAENGAIQNLIKEEAFLGITDEKTEGQFVDLTGNRLTYTNWNEGEPNNAGSDEDCVLLLKNGQWNDVPCSTSHLAVCEFPI

SEQ ID NO: 6989 - protein, 388 aa, unidentified
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMTQSAVKSLKRPLEATFDLGIPQAVLPPLPKRPALEKTNGATAVFNTGIFQYQQALANMQLQQHTAFLPPVPMVHGATPATVSAATTSATSVPFAATATANQIPIISAEHLTSHKYVTQM

SEQ ID NO: 6990 - protein, 725 aa, unidentified
MAAASAVSVLLVAAERNRWHRLPSLLLPPRTWVWRQRTMKYTTATGRNITKVLIANRGEIACRVMRTAKKLGVQTVAVYSEADRNSMHVDMADEAYSIGPAPSQQSYLSMEKIIQVAKTSAAQAIHPGCGFLSENMEFAELCKQEGIIFIGPPPSAIRDMGIKSTSKSIMAAAGVPVVEGYHGEDQSDQCLKEHARRIGYPVMIKAVRGGGGKGMRIVRSEQEFQEQLESARREAKKSFNDDAMLIEKFVDTPRHVEVQVFGDHHGNAVYLFERDCSVQRRHQKIIEEAPAPGIKSEVRKKLGEAAVRAAKAVNYVGAGTVEFIMDSKHNFCFMEMNTRLQVEHPVTEMITGTDLVEWQLRIAAGEKIPLSQEEITLQGHAFEARIYAEDPSNNFMPVAGPLVHLSTPRADPSTRIETGVRQGDEVSVHYDPMIAKLVVWAADRQAALTKLRYSLRQYNIVGLHTNIDFLLNLSGHPEFEAGNVHTDFIPQHHKQLLLSRKAAAKESLCQAALGLILKEKAMTDTFTLQAHDQFSPFSSSSGRRLNISYTRNMTLKDGKNNVAIAVTYNHDGSYSMQIEDKTFQVLGNLYSEGDCTYLKCSVNGVASKAKLIILENTIYLFSKEGSIEIDIPVPKYLSSVSSQETQGGPLAPMTGTIEKVFVKAGDKVKAGDSLMVMIAMKMEHTIKSPKDGTVKKVFYREGAQANRHTPLVEFEEEESDKRESE

SEQ ID NO: 6991 - protein, 119 aa, unidentified
MVLPLPWLSRYHFLRLLLPSWSLAPQGSHGCCSQNPKASMEEQTSSRGNGKMTSPPRGPGTHRTAELARAEELLEQQLELYQALLEGQEGAWEAQALVLKIQKLKEQMRRHQESLGGGA

SEQ ID NO: 6992 - protein, 176 aa, unidentified
MARVLKAAAANAVGLFSRLQAPIPTVRASSTSQPLDQVTGSVWNLGRLNHVAIAVPDLEKAAAFYKNILGAQVSEAVPLPEHGVSVVFVNLGNTKMELLHPLGRDSPIAGFLQKNKAGGMHHICIEVDNINAAVMDLKKKKIRSLSEEVKIGAHGKPVIFLHPKDCGGVLVELEQA

SEQ ID NO: 6993 - protein, 1137 aa, unidentified
MFDCWRFILCKRPGSNSYSSPQRPNEAKKEETDHQIDVSDVIRLVQDTPEATAMATDEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKGWSKTSHSLEAPEDDGGWSSAEEQINSSDAEEDGGLGPKKLVPGKYTVVADHEKGGPDALRVRSGDVVELVQEGDEGLWYVRDPTTGKEGWVPASSLSVRLGPSGSAQCLSSSGKAHVPRAHP

SEQ ID NO: 6994 - protein, 146 aa, unidentified
MTMRSLLRTPFLCGLLWAFCAPGARAEEPAASFSQPGSMGLDKNTVHDQEHIMEHLEGVINKPEAEMSPQELQLHYFKMHDYDGNNLLDGLELSTAITHVHKEEGSEQAPLMSEDELINIIDGVLRDDDKNNDGYIDYAEFAKSLQ

SEQ ID NO: 6995 - protein, 246 aa, unidentified; identical to SEQ ID NO: 2586

SEQ ID NO: 6996 - protein, 955 aa, unidentified
MEVTCLLLLALIPFHCRGQGVYAPAQAQIVHAGQACVVKEDNISERVYTIREGDTLMLQCLVTGHPRPQVRWTKTAGSASDKFQETSVFNETLRIERIARTQGGRYYCKAENGVGVPAIKSIRVDVQYLDEPMLTVHQTVSDVRGNFYQEKTVFLRCTVNSNPPARFIWKRGSDTLSHSQDNGVDIYEPLYTQGETKVLKLKNLRPQDYASYTCQVSVRNVCGIPDKAITFRLTNTTAPPALKLSVNETLVVNPGENVTVQCLLTGGDPLPQLQWSHGPGPLPLGALAQGGTLSIPSVQARDSGYYNCTATNNVGNPAKKTVNLLVRSMKNATFQITPDVIKESENIQLGQDLKLSCHVDAVPQEKVTYQWFKNGKPARMSKRLLVTRNDPELPAVTSSLELIDLHFSDYGTYLCMASFPGAPVPDLSVEVNISSETVPPTISVPKGRAVVTVREGSPAELQCEVRGKPRPPVLWSRVDKEAALLPSGLPLEETPDGKLRLERVSRDMSGTYRCQTARYNGFNVRPREAQVQLNVQFPPEVEPSSQDVRQALGRPVLLRCSLLRGSPQRIASAVWRFKGQLLPPPPVVPAAAEAPDHAELRLDAVTRDSSGSYECSVSNDVGSAACLFQVSAKAYSPEFYFDTPNPTRSHKLSKNYSYVLQWTQREPDAVDPVLNYRLSIRQLNQHNAVVKAIPVRRVEKGQLLEYILTDLRVPHSYEVRLTPYTTFGAGDMASRIIHYTEPINSPNLSDNTCHFEDEKICGYTQDLTDNFDWTRQNALTQNPKRSPNTGPPTDISGTPEGYYMFIETSRPRELGDRARLVSPLYNASAKFYCVSFFYHMYGKHIGSLNLLVRSRNKGALDTHAWSLSGNKGNVWQQAHVPISPSGPFQIIFEGVRGPGYLGDIAIDDVTLKKGECPRKQTDPNKVVVMPGSGAPCQSSPQLWGPMAIFLLALQR

SEQ ID NO: 6997 - protein, 143 aa, unidentified
MQHRGFLLLTLLALLALTSAVAKKKDKVKKGGPGSECAEWAWGPCTPSSKDCGVGFREGTCGAQTQRIRCRVPCNWKKEFGADCKYKFENWGACDGGTGTKVRQGTLKKARYNAQCQETIRVTKPCTPKTKAKAKAKKGKGKD

SEQ ID NO: 6998 - protein, 212 aa, unidentified
MGVTCVSQMPVAEGKSVQQTVELLTRKLEMLGAEKQGTFCVDCETYHTAASTLGSQGQTGKLMYVMHNSEYPLSCFALFENGPCLIADTNFDVLMVKLKGFFQSAKASKIETRGTRYQYCDFLVKVGTVTMGPSARGISVEVEYGPCVVASDCWSLLLEFLQSFLGSHTPGAPAVFGNRHDAVYGPADTMVQYMELFNKIRKQQQVPVAGIR

SEQ ID NO: 6999 - protein, 1140 aa, unidentified; identical to SEQ ID NO: 2592

SEQ ID NO: 7000 - protein, 1541 aa, unidentified
MSFLEEARAAGRAVVLALVLLLLPAVPVGASVPPRPLLPLQPGMPHVCAEQELTLVGRRQPCVQALSHTVPVWKAGCGWQAWCVGHERRTVYYMGYRQVYTTEARTVLRCCRGWMQQPDEEGCLSAECSASLCFHGGRCVPGSAQPCHCPPGFQGPRCQYDVDECRTHNGGCQHRCVNTPGSYLCECKPGFRLHTDSRTCLAINSCALGNGGCQHHCVQLTITRHRCQCRPGFQLQEDGRHCVRRSPCANRNGSCMHRCQVVRGLARCECHVGYQLAADGKACEDVDECAAGLAQCAHGCLNTQGSFKCVCHAGYELGADGRQCYRIEMEIVNSCEANNGGCSHGCSHTSAGPLCTCPRGYELDTDQRTCIDVDDCADSPCCQQVCTNNPGGYECGCYAGYRLSADGCGCEDVDECASSRGGCEHHCTNLAGSFQCSCEAGYRLHEDRRGCSPLEEPMVDLDGELPFVRPLPHIAVLQDELPQLFQDDDVGADEEEAELRGEHTLTEKFVCLDDSFGHDCSLTCDDCRNGGTCLLGLDGCDCPEGWTGLICNETCPPDTFGKNCSFSCSCQNGGTCDSVTGACRCPPGVSGTNCEDGCPKGYYGKHCRKKCNCANRGRCHRLYGACLCDPGLYGRFCHLTCPPWAFGPGCSEECQCVQPHTQSCDKRDGSCSCKAGFRGERCQAECELGYFGPGCWQACTCPVGVACDSVSGECGKRCPAGFQGEDCGQECPVGTFGVNCSSSCSCGGAPCHGVTGQCRCPPGRTGEDCEADCPEGRWGLGCQEICPACQHAARCDPETGACLCLPGFVGSRCQDVCPAGWYGPSCQTRCSCANDGHCHPATGHCSCAPGWTGFSCQRACDTGHWGPDCSHPCNCSAGHGSCDAISGLCLCEAGYVGPRCEQQCPQGHFGPGCEQRCQCQHGAACDHVSGACTCPAGWRGTFCEHACPAGFFGLDCRSACNCTAGAACDAVNGSCLCPAGRRGPRCAETCPAHTYGHNCSQACACFNGASCDPVHGQCHCAPGWMGPSCLQACPAGLYGDNCRHSCLCQNGGTCDPVSGHCACPEGWAGLACEKECLPRDVRAGCRHSGGCLNGGLCDPHTGRCLCPAGWTGDKCQSPCLRGWFGEACAQRCSCPPGAACHHVTGACRCPPGFTGSGCEQACPPGSFGEDCAQMCQCPGENPACHPATGTCSCAAGYHGPSCQQRCPPGRYGPGCEQLCGCLNGGSCDAATGACRCPTGFLGTDCNLTCPQGRFGPNCTHVCGCGQGAACDPVTGTCLCPPGRAGVRCERGCPQNRFGVGCEHTCSCRNGGLCHASNGSCSCGLGWTGRHCELACPPGRYGAACHLECSCHNNSTCEPATGTCRCGPGFYGQACEHPCPPGFHGAGCQGLCWCQHGAPCDPISGRCLCPAGFHGHFCERGCEPGSFGEGCHQRCDCDGGAPCDPVTGLCLCPPGRSGATCNLDCRRGQFGPSCTLHCDCGGGADCDPVSGQCHCVDGYMGPTCREGGPLRLPENPSLAQGSAGTLPASSRPTSRSGGPARH

SEQ ID NO: 7001 - protein, 1274 aa, unidentified
MAVRQAATAGTPGPRREEEAALLFERAHYRHDPRWLLPVTPRLCLACALELLPDPGVSLVRKKHMLSCFQDALVRHTSLVTQLVSQDQRVCIHFISVLFGLLCSMEDGSVTDLCIEVLIQITTQLKLEQTIRCLLDECHKELCNMPSMRGSLATLTLLGKLVDAIPALADELVMEHGNLMEHLLRGLVYPSEGIQASVCYLYGKLYSSPVAAEMLSGHFREKLFPLFLSILDGAQTKELQINCLGLLRQLLKYDLFVSMIMNQDGLGESAKNIEGSSGNTSLPLVLKKLLLSRDETLQVASAHCITAVLVHSPAKHASAFIHADIPEFLFEHLSSSSEVLVWSSCNCLTLLVEEPLFFSKCHTVYGIEAVVRSLQGSLKMNNIELHKQGLLLFAEILTRQPEEIKLFTSSAMCRDAGRALQEAVSSPVLEVAAEALKATSAFLRKDHQSTPPVQYGELQALLEAMLNRCAEFSQTLLSRRPLGHASSRDSEKAILQRGKFLLSTLEGFRSACRLAIEFQSEPSAQENPFTAPSAKKEDTLEAFSEFLLSACDSLCIPMVMRHLEQTTHPALMEVFLSILHNLFVIVPHMKEKFSKKLASSSFIRLTLELKARFCSGLSHSALNQVCSNFLYYMCLNLLSAPEKTGPPSKEELSAVSELLQHGLPQISSRSPESLAFLSDRQYMEGAARQRQYCILLLFYLAYIHEDRFVSEAELFEAVQSFLLSLQDQGERPPLVVFKASIYLLAICQDKDNTLRETMVSAIRKFLEGIPDLQLVYTHHPLLLRFFLLYPELMSRYGHRVLELWFFWEESSYEELDDVTSAGQPALPASLVVLFQLLRSIPSILLILLDLIYSSPVDTAHKVLISLRTFLRRNEDIQVGGLIRGHFLLILQRLLVEHGASPSGASGNLPLLLSLLSLMQLRNVSEQELDSVAMKLLHQVSKLCGKCSPTDVDILQPSFNFLYWSLHQTTPSSQKRAAAVLLSSTGLMELLEKMLALTLAKADSPRTALLCSAWLLTASFSAQQHKGSLQVHQTLSVEMDQVLKALSFPKKKAALLSAAILCFLRTALRQSFSSALVALVPSGAQPLPATKDTVLAPLRMSQVRSLVIGLQNLLVQKDPLLSQACVGCLEALLDYLDARSPDIALHVASQPWNRFLLFTLLDAGENSFLRPEILRLMTLFMRYRSSSVLSHEEVGDVLQGVALADLSTLSNTTLQALHGFFQQLQSMGHLADHSMAQTLQASLEGLPPSTSSGQPPLQDMLCLGGVAVSLSHIRN

SEQ ID NO: 7002 - protein, 385 aa, unidentified
MDVQKWYLRTSKLALALAIIRSKPADKSSREYTEHLAMLLSEEQSKWRSKVEILEAEVMQLRQKLLVSRLCSGSFKSGYVSSQLEAQEPKSSESTLTSMEDSGCDLSNEQRTESSDLSQHFVESCTPTHFPPLPLVKRPCAILQNPLSSHMQFLQYLLELKNLTESGNLKRDLTHFEKDSSTVSDSVFQLLDGLITFYRNPKLPFSRFWTEAVGTLASLISDYNLSSHILKKCSKKLEEFEKTLLHAILGNNHINQFQVQHYVSQSLVTLGNCSLLRKSIISLLLSEVNGFADDLGAINQEQASYDVSRYENIFYLFWVLEQLLQKETEEGNTSSIGHDDQEIKKFLQKHDETIFQLSDAFPLFTFYLWRVGILLSSAQIETLRK

SEQ ID NO: 7003 - protein, 390 aa, unidentified
MAQRYDDLPHYGGMDGVGIPSTMYGDPHAARSMQPVHHLNHGPPLHSHQYPHTAHTNAMAPSMGSSVNDALKRDKDAIYGHPLFPLLALIFEKCELATCTPREPGVAGGDVCSSESFNEDIAVFAKQIRAEKPLFSSNPELDNLMIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQGDGLDNSVASPSTGDDDDPDKDKKRHKKRGIFPKVATNIMRAWLFQHLTHPYPSEEQKKQLAQDTGLTILQVNNWFINARRRIVQPMIDQSNRAVSQGTPYNPDGQPMGGFVMDGQQHMGIRAPGPMSGMGMNMGMEGQWHYM

SEQ ID NO: 7004 - protein, 375 aa, unidentified
MARRYDELPHYPGIVDGPAALASFPETVPAVPGPYGPHRPPQPLPPGLDSDGLKREKDEIYGHPLFPLLALVFEKCELATCSPRDGAGAGLGTPPGGDVCSSDSFNEDIAAFAKQVRSERPLFSSNPELDNLMIQAIQVLRFHLLELEKVHDLCDNFCHRYITCLKGKMPIDLVIEDRDGGCREDFEDYPASCPSLPDQNNMWIRDHEDSGSVHLGTPGPSSGGLASQSGDNSSDQGDGLDTSVASPSSGGEDEDLDQERRRNKKRGIFPKVATNIMRAWLFQHLSHPYPSEEQKKQLAQDTGLTILQVNNWFINARRRIVQPMIDQSNRTGQGAAFSPEGQPIGGYTETQPHVAVRPPGSVGMSLNLEGEWHYL

SEQ ID NO: 7005 - protein, 738 aa, unidentified
MRGPSGALWLLLALRTVLGGMEVRWCATSDPEQHKCGNMSEAFREAGIQPSLLCVRGTSADHCVQLIAAQEADAITLDGGAIYEAGKEHGLKPVVGEVYDQEVGTSYYAVAVVRRSSHVTIDTLKGVKSCHTGINRTVGWNVPVGYLVESGRLSVMGCDVLKAVSDYFGGSCVPGAGETSYSESLCRLCRGDSSGEGVCDKSPLERYYDYSGAFRCLAEGAGDVAFVKHSTVLENTDGKTLPSWGQALLSQDFELLCRDGSRADVTEWRQCHLARVPAHAVVVRADTDGGLIFRLLNEGQRLFSHEGSSFQMFSSEAYGQKDLLFKDSTSELVPIATQTYEAWLGHEYLHAMKGLLCDPNRLPPYLRWCVLSTPEIQKCGDMAVAFRRQRLKPEIQCVSAKSPQHCMERIQAEQVDAVTLSGEDIYTAGKTYGLVPAAGEHYAPEDSSNSYYVVAVVRRDSSHAFTLDELRGKRSCHAGFGSPAGWDVPVGALIQRGFIRPKDCDVLTAVSEFFNASCVPVNNPKNYPSSLCALCVGDEQGRNKCVGNSQERYYGYRGAFRCLVENAGDVAFVRHTTVFDNTNGHNSEPWAAELRSEDYELLCPNGARAEVSQFAACNLAQIPPHAVMVRPDTNIFTVYGLLDKAQDLFGDDHNKNGFKMFDSSNYHGQDLLFKDATVRAVPVGEKTTYRGWLGLDYVAALEGMSSQQCSGAAAPAPGAPLLPLLLPALAARLLPPAL

SEQ ID NO: 7006 - protein, 525 aa, unidentified
MRVFCVGLLLFSVTWAAPTFQPQTEKTKQSCVEEQRQEEKNKDNIGFHHLGKRINQELSSKENIVQERKKDLSLSEASENKGSSKSQNYFTNRQRLNKEYSISNKENTHNGLRMSIYPKSTGNKGFEDGDDAISKLHDQEEYGAALIRNNMQHIMGPVTAIKLLGEENKENTPRNVLNIIPASMNYAKAHSKDKKKPQRDSQAQKSPVKSKSTHRIQHNIDYLKHLSKVKKIPSDFEGSGYTDLQERGDNDISPFSGDGQPFKDIPGKGEATGPDLEGKDIQTGFAGPSEAESTHLDTKKPGYNEIPEREENGGNTIGTRDETAKEADAVDVSLVEGSNDIMGSTNFKELPGREGNRVDAGSQNAHQGKVEFHYPPAPSKEKRKEGSSDAAESTNYNEIPKNGKGSTRKGVDHSNRNQATLNEKQRFPSKGKSQGLPIPSRGLDNEIKNEMDSFNGPSHENIITHGRKYHYVPHRQNNSTRNKGMPQGKGSWGRQPHSNRRFSSRRRDDSSESSDSGSSSESDGD

SEQ ID NO: 7007 - protein, 234 aa, unidentified
MAASRWARKAVVLLCASDLLLLLLLLPPPGSCAAEGSPGTPDESTPPPRKKKKDIRDYNDADMARLLEQWEKDDDIEEGDLPEHKRPSAPVDFSKIDPSKPESILKMTKKGKTLMMFVTVSGSPTEKETEEITSLWQGSLFNANYDVQRFIVGSDRAIFMLRDGSYAWEIKDFLVGQDRCADVTLEGQVYPGKGGGSKEKNKTKQDKGKKKKEGDLKSRSSKEENRAGNKREDL

SEQ ID NO: 7008 - protein, 335 aa, unidentified
MVRRDRLRRMREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGIFPETHRPLLLQKLLKDGGVLSPILTRLMNFFVFSRGLTPVFGPYTRPSESELWDMWAGIRNNDGNLVIDSLLQYINQRKKFRRRWVGALASVTIPIHFIYGPLDPVNPYPEFLELYRKTLPRSTVSILDDHISHYPQLEDPMGFLNAYMGFINSF

SEQ ID NO: 7009 - protein, 1390 aa, unidentified; identical to SEQ ID NO: 2601

SEQ ID NO: 7010 - protein, 293 aa, unidentified
MGFPAAALLCALCCGLLAPAARAGYSEERCSWRGSGLTQEPGSVGQLALACAEGAVEWLYPAGALRLTLGGPDPRARPGIACLRPVRPFAGAQVFAERAGGALELLLAEGPGPAGGRCVRWGPRERRALFLQATPHQDISRRVAAFRFELREDGRPELPPQAHGLGVDGACRPCSDAELLLAACTSDFVIHGIIHGVTHDVELQESVITVVAARVLRQTPPLFQAGRSGDQGLTSIRTPLRCGVHPGPGTFLFMGWSRFGEARLGCAPRFQEFRRAYEAARAAHLHPCEVALH

SEQ ID NO: 7011 - protein, 311 aa, unidentified
MRGAARAAWGRAGQPWPRPPAPGPPPPPLPLLLLLLAGLLGGAGAQYSSDRCSWKGSGLTHEAHRKEVEQVYLRCAAGAVEWMYPTGALIVNLRPNTFSPARHLTVCIRSFTDSSGANIYLEKTGELRLLVPDGDGRPGRVQCFGLEQGGLFVEATPQQDIGRRTTGFQYELVRRHRASDLHELSAPCRPCSDTEVLLAVCTSDFAVRGSIQQVTHEPERQDSAIHLRVSRLYRQKSRVFEPVPEGDGHWQGRVRTLLECGVRPGHGDFLFTGHMHFGEARLGCAPRFKDFQRMYRDAQERGLNPCEVGTD

SEQ ID NO: 7012 - protein, 456 aa, unidentified
MAAALKCLLTLGRWCPGLGVAPQARALAALVPGVTQVDNKSGFLQKRPHRQHPGILKLPHVRLPQALANGAQLLLLGSAGPTMENQVQTLTSYLWSRHLPVEPEELQRRARHLEKKFLENPDLSQTEEKLRGAVLHALRKTTYHWQELSYTEGLSLVYMAARLDGGFAAVSRAFHEIRARNPAFQPQTLMDFGSGTGSVTWAAHSIWGQSLREYMCVDRSAAMLVLAEKLLKGGSESGEPYIPGVFFRQFLPVSPKVQFDVVVSAFSLSELPSKADRTEVVQTLWRKTGHFLVLVENGTKAGHSLLMDARDLVLKGKEKSPLDPRPGFVFAPCPHELPCPQLTNLACSFSQAYHPIPFSWNKKPKEEKFSMVILARGSPEEAHRWPRITQPVLKRPRHVHCHLCCPDGHMQHAVLTARRHGRDLYRCARVSSWGDLLPVLTPSAFPPSTAQDPSES

SEQ ID NO: 7013 - protein, 366 aa, unidentified
MARERPPGRGCGVLRRCLLGAVLLFGLRLCAELRRAGPGSPTRSAPPGPAWRPPGPHLPPAPGQPRGASRRQVTYVRSGRRAPPGGGGSGTPEPGCCAPRGRPRRKGPRWHIDLQPWAGSAQSLDEEAWRFLRYISTTQIACNHMNTDSLATDSSPTHKPWSVCLDDRFNLAHQIRNKQCRLYSLGLGSDDTHFEVSMANNGCEVHRFDPSVKSAHILESQHLWYHRLSIDWRDPHPAVAAQKPHSNTRKLGSILNEFGHHKIDVLKADLESAEWKVLENLILEDVLEQIGQLIFEIHLHWPGFEVSGSDSSVVRFWYSLLKELEQKDFRLFHSYKDLSKPQLFLKKDIFNASSCYTLSWVNTRWK

SEQ ID NO: 7014 - protein, 244 aa, unidentified
MDILVPLLQLLVLLLTLPLHLMALLGCWQPLCKSYFPYLMAVLTPKSNRKMESKKRELFSQIKGLTGASGKVALLELGCGTGANFQFYPPGCRVTCLDPNPHFEKFLTKSMAENRHLQYERFVVAPGEDMRQLADGSMDVVVCTLVLCSVQSPRKVLQEVRRVLRPGGVLFFWEHVAEPYGSWAFMWQQVFEPTWKHIGDGCCLTRETWKDLENAQFSEIQMERQPPPLKWLPVGPHIMGKAVK

SEQ ID NO: 7015 - protein, 318 aa, unidentified
MRLLAGWLCLSLASVWLARRMWTLRSPLTRSLYVNMTSGPGGPAAAAGGRKENHQWYVCNREKLCESLQAVFVQSYLDQGTQIFLNNSIEKSGWLFIQLYHSFVSSVFSLFMSRTSINGLLGRGSMFVFSPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVENVGGKWEKPSEILEIKGQNWEEQVNSLPEVFRKAGFVIEAFTRLPYLCEGDMYNDYYVLDDAVFVLKPV

SEQ ID NO: 7016 - protein, 659 aa, unidentified
MPSGSSAALALAAAPAPLPQPPPPPPPPPPPLPPPSGGPELEGDGLLLRERLAALGLDDPSPAEPGAPALRAPAAAAQGQARRAAELSPEERAPPGRPGAPEAAELELEEDEEEGEEAELDGDLLEEEELEEAEEEDRSSLLLLSPPAATASQTQQIPGGSLGSVLLPAARFDAREAAAAAAAAGVLYGGDDAQGMMAAMLSHAYGPGGCGAAAAALNGEQAALLRRKSVNTTECVPVPSSEHVAEIVGRQGCKIKALRAKTNTYIKTPVRGEEPIFVVTGRKEDVAMAKREILSAAEHFSMIRASRNKNGPALGGLSCSPNLPGQTTVQVRVPYRVVGLVVGPKGATIKRIQQQTHTYIVTPSRDKEPVFEVTGMPENVDRAREEIEMHIAMRTGNYIELNEENDFHYNGTDVSFEGGTLGSAWLSSNPVPPSRARMISNYRNDSSSSLGSGSTDSYFGSNRLADFSPTSPFSTGNFWFGDTLPSVGSEDLAVDSPAFDSLPTSAQTIWTPFEPVNPLSGFGSDPSGNMKTQRRGSQPSTPRLSPTFPESIEHPLARRVRSDPPSTGNHVGLPIYIPAFSNGTNSYSSSNGGSTSSSPPESRRKHDCVICFENEVIAALVPCGHNLFCMECANKICEKRTPSCPVCQTAVTQAIQIHS

SEQ ID NO: 7017 - protein, 183 aa, unidentified
MRAAYLFLLFLPAGLLAQGQYDLDPLPPFPDHVQYTHYSDQIDNPDYYDYQEVTPRPSEEQFQFQSQQQVQQEVIPAPTPEPGNAELEPTEPGPLDCREEQYPCTRLYSIHRPCKQCLNEVCFYSLRRVYVINKEICVRTVCAHEELLRADLCRDKFSKCGVMASSGLCQSVAASCARSCGSC

SEQ ID NO: 7018 - protein, 362 aa, unidentified; identical to SEQ ID NO: 2605

SEQ ID NO: 7019 - protein, 409 aa, unidentified; identical to SEQ ID NO: 2606
